United States Patent 11,001,841 (CCCTC-BINDING FACTOR (CTCF) RNA INTERACTOME) - sequence listing, part 53

SEQ ID NO: 125235 - DNA, 1020 bp, Homo sapiens
ctaaatcttaattatttccttaggatagaagtggaattactgggcaaagggtatgtatatttttctgtctttctgaatgactgtatttgtgctctggccagcagttttggagagtgctggttttctagaccagtgtttctcaactgtgggtgcatatcagaatcattgagggcacttttaaaagcagtgatacccaggaccagctcccagagattctggtttcatggatctggggtgtgacccagggtttatagtttttaaaagctctccaagagattttatatgcggccagtttgataggtgaaagtggtattccatttttttaattataattttcttctgaaattgtttcaggcattcagatttgggagaagtagccccagaaataaaagcatcagagagacgaacagctgtggccattgcaggtaaagttggatgaattggatgtgggcccactctggagctgaagtacttctcctgtccccttgggattctgggttccagcccctcctggacttgggattgtgcatctcaaaaataaataagtttaaggcttttatttttccttttacaagaagattccatctaagggtcttttaagcattcctcatatattcaaaatagtgttttttgtttgttttttttatgggcaacactttattctagaaaatggagtaagtgttcccaggattcagttaaacaggtgattatgacacaatttaacagaaacacattaccccaattttagcataactgccattgtaggtcatagttaaggtgactgtatagtttatcttctaaagtgggcacttctgagagtgaaagggatgtaatgttgggaaaacaggtataaattgggattgtcccagagcacactggggcttgtagtcttcctggttatggtccatacaggctggtttttctttctctgaggatttgggggtggggctgtaacgccaccctttgtaaattcacctttaaggtatggtggccacactccagatatctttagctctctta

SEQ ID NO: 125236 - DNA, 1461 bp, Homo sapiens
cggtctttaaagatagaaacttcatccctgacctctgtattcccttagaaagattccgcttttttctttgatccagtgggtaacagcaagtgagtaagttgatctccataagtaactctcactcctcagcgctttgtttcagaaaatatggtccctttctggccaggagaaatggagtaagacctgccctagaagggaggagctcggacacagaatgggtggaaggacctgtggggtccgagtggggctgtggagaatgcttagctatatagaggtgggactcatggtagtggatgaggtgactgagtgattgaaacccaggaatgtgtggctaattggggtagaggagaagccatcactggacgacaaacccaaggccagttgttcctctgtggactgagtccttgcctgaggaaggagggcacacgcaccttggcacctgcccctcttcttcccccctcctcctccctctccaccatcttctcctcccccttcccttcccctcctcctccctctcctcctcccttctctgttctgtctccgttcctcccctccactccttttctttcctctcgcctgctcctctctcctccccagtgacctcctcaggtcctttccccagcccactgttcctttaaacattcagctggagacctcatccaccctcctggctgctcctctcaggaacatctcggctcctgggaattctcaaggactcatctaccttggaagctgaaagcacccccattaacatccattggctgtcaaaagtacctgacttgacttttaaccttttgtctttgctgtccaggaagattctctcccaccactgtcattttatgggaagggaaaggctcagctttcccactggaggcccggcctggtctgaatgggccaggccacagccctagagctcacaggccctctacactgggtgaaagatgggtcctctggccacactgggggaaggggaaagggggccccgtaaaccacactgagaaggaagcattaagaactcaagatgtatctttgctcttgggagaagtccagcaggacccttatcttgctcagtagctgctgtgacttctgcagaagggacctagctttgccagcaggactgagactttgtattggctctctgctcacggatgtgggattgcccaaaaagccagcagccacccagagtgttccctacgctggacgtacgggagaactagcagggatagaaaaggccagaagtgtccctggttctttaggacagctctccaaacttcactcacctgcccatgggtggcagagtgcaccaggacttcatgggatgcaacagccatgccgttgacctctccatggggatggactgaagagcccaccccagctcaggggagagcctctcatccggaaccacgagtgacagggactttccagtcctagggaatgttcttttaaatttagatcctgccc

SEQ ID NO: 125237 - DNA, 1461 bp, Homo sapiens; identical to SEQ ID NO: 125236

SEQ ID NO: 125238 - DNA, 1461 bp, Homo sapiens; identical to SEQ ID NO: 125236

SEQ ID NO: 125239 - DNA, 1461 bp, Homo sapiens; identical to SEQ ID NO: 125236

SEQ ID NO: 125240 - DNA, 1068 bp, Homo sapiens
tggtgatctggactgggctagtcatagaggagtctccaaattgatgtttttattaagtgacaatctccatgagttgggaaggaaagaagaaacgctgaccatttttgaggaccttatgaatatgccaggcattgtgctaaataaaggaaatggcaatcaaaggatatgaaggcatcaaaggaaaagatgtgtttgagaaatgccccatggcccagtgtgtttggagctaagtggagacaagttcagaggatgagactgggaccagatgatgggacctggtcccgtttgtggactcactgcccaccactcgctgaaggtaaatgaaactatttgcattggtggagctctcagagaatcaatgtgacagcagtatagagacggcagagagggcagaagacagggagcagctcatgctgccatctcccctctttcgaacaggcctcactcaacagctcatctcttgtctttgccccttgcttggctgtctcacaactgcccagatcttccttgtctgccagctcctctgcctgctctttcactgttggggtttccttgggctctataatccatctccgctagtcccaacacatgttctctgcatggtcacatctgttttagtggctttaactgttgtctgaatcagaggttcttaacttaggctccatgattcatggatgggcttctgggggtccctttgttctctgaaattgtatgcagcattgggagtagtgtgtaattttcctgggcacaaggtctgtagctttcaacagattttcaaaggggctcttatccttaacaatgttacaactattcatcctaaatttccagattttcatttccaactacactagatacagctcctcaagtttctttaacctgggttagctgtgtgaagtctatatttttcagattgttactgatggataatttgaaaaacaataaataaagatcaagtataattggctttacatagaccaccgatcttaaaatcttaaaaagattttaaatagtcacttattcttatcagagtgacagctttacagaaacaactagcatccctcctccctc

SEQ ID NO: 125241 - DNA, 1068 bp, Homo sapiens; identical to SEQ ID NO: 125240

SEQ ID NO: 125242 - DNA, 1068 bp, Homo sapiens; identical to SEQ ID NO: 125240

SEQ ID NO: 125243 - DNA, 1068 bp, Homo sapiens; identical to SEQ ID NO: 125240

SEQ ID NO: 125244 - DNA, 1044 bp, Homo sapiens
ggtccgggtacgcgggcctaggggatccggggagggcgcgaggcccggaggtgcccggggcgcggcgggagcgagggcccggcgagcggctggggaaccggggtgcgggtcctcgccgcggcccggggcaacccgcggaggcctggaaatgcttcgctccggcgcctggtatcgatgttcctgggttttaaacttgctcgcgttgggagtggacgcttgtttgccgcgtcgttgagacgtacccagaatgtcaggatccgggcagatgcagaccctttgctgacagccggagagccgctccgggatctccttggtcggggccattgcctaccggcctgccttggggtggctgcgcttattttgatattacctcttttcaacttttttgatttaaatgttattccttttaggaaatgatggcgacacatatagtttgtaatttttgagaaaaaattctcacttggcaaactaaaacctcagtaattcattatttttttgttttttgttttgataattttactagtactgaaatttgggaatgacagtccaacactttcattttacaaagaaagaaattaggctcaaggtcatcgctttagttgttaaaattcttctttgactgttacccatcattcagagggtcttggatctagtggctgtgatagccattcagaacagttcccaaagagctttacaggtgtgtgttcagtggtaggggtggggaggggacggtgctaaggggccgggatcatggatttcgtgcctcctccagatgaggcctgagccatgccctggggtgatttggctcagtacagtgggcctgaatgaagcaagctgaatttgaaccccgcctgctgtctttctaggctttggggcagtggtcatttccgggaccaggccttttcattgccagctgactacccagcactttgagctcatgaatagagtaagcagggaaccatccctgggaaggccaggctgattgacctaggggttcaaggtcctgcagcattcctttcccccttgtcaggaaagggtgggcag

SEQ ID NO: 125245 - DNA, 1044 bp, Homo sapiens; identical to SEQ ID NO: 125244

SEQ ID NO: 125246 - DNA, 1044 bp, Homo sapiens; identical to SEQ ID NO: 125244

SEQ ID NO: 125247 - DNA, 1044 bp, Homo sapiens; identical to SEQ ID NO: 125244

SEQ ID NO: 125248 - DNA, 1018 bp, Homo sapiens
tcagcagcataacccactgacctccaccctcatcgtcacagccattaaggtagttactcagcagatactatgtggcagattcctgcacactgcggaaaaatatctggaccatgtcacttccgtgtctgtaactctacagtggcttcctgttgcatgttgaataaagcctagactccttgccctgctgatgccctgcatgacccagaacctaccacccctttcatttaccacactgtggccacacctgtttgtcaccactctggccgtctttctcttcctcaaacttacaagctggttcctcttcagagtccttgctctgctgcttcctctgcatggagcacactttttccacatcgtcccaggtggctccccagccttcacttcttggccccgaggttgccttctcagagaggccttccttgattcctagctccttgtttgtaggcactttttcccatctttctgtttgacttccttcagacacatgccagacacaaaatatgctggaaatccttatggattttcttgtcacctttatctcttactagaaggggtggggtgggctctgtctctgtcctcggtgcttgaggcacggttgttacatgtggcagatgcttagatgaaggatggaccaagtcatacagaaaaagtggtagagatatcagaggaagaagaggtggtctctagtttggtgggtcataagaggtttcacacacacagtgctggcattggggagggcagatagagtggggagcaaccatgacatcagctctccatcttggatctgtctcccgcccctgcttactccgtatcttggcatggtttgttctcacctggttcatgtgtcaccttcagcacctgcttcactctctaatagtacgttagtgttaggtgtgtgttttttcttccgttagaaagtaagttccatgggcaggaccttttagggattgttcatagctgcattcctgtaactaataagcagtaggctctcagtacttattttcaaaggcactattga

SEQ ID NO: 125249 - DNA, 1034 bp, Homo sapiens
taccatgctgttttgcttactgtagttttgtagtttaatttgaaatcaggtagcatgaagcctccagctttgtactttttgcttcagattgctttagctattcagggtcttttgtggcttccagatggcatttaaaattagttttcattgattagaaggaaggcctttgatgcaaattatgcctgggctgtctattgatacacagcagggaacagctacagaaggaaccactggatagcacagtggaggtcaagggtctcacgtgaactgggacaagaatgaggggtttgctccaagttggtttgtttgagcccttgaggggaactcgtgcctcagttttcagcagccagacaggtgccttctagtttcctgattccagtcctgtgtggtatagtagtggcccgtgctgtatggactgacaggagtttggcccatctcctgggcttgcaaagcccttctttcaagtgctgctcctgctgcagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtggtgagtgctgcttgcccatcgccagcccttttgttgctcagggcctgaggcagggggccaggaatatgcacttcccagcacccgggctggctgggcccatgcctgcttagtttctgcagatggtaacccctgagctgtggtgattgcccactgaccagatgagcaggaatagccctctgaccttgcctaggggttggactagctgttctggagccttcctctggagcccagcctgtgtggtcagagtggaggctctgcagcatgcatggctatgatagtctggctgccctcaaggtcatggcactggaacatcttgggctgcccctggaggtagccaccgtggaggaactaaaggaggcatcaaggcggagcctgaaaccagagcaggccccttggagtcacggg

SEQ ID NO: 125250 - DNA, 1140 bp, Homo sapiens
gtgccagtcactctgggcgaggccttactgcgcccatgcatcccgggcccatttgtcagcccttgctcttcagtgggagcccagctgcaagcccagagtctggccactccatagtcctgcacccctcttttgattggtctttcctttgcccagagaggggctccagagggagataggtggtgaagctcatgcagggattctgaggacctgatgggggagggccctgcgaggggtccaagcctacatcaagaggaattcagtaccagggggagctccccaccaccccggaaaagggagaggcccagagatggaggtggcttgtccagggccccacagtaagttgggatttggagccagatgctctaagcccagcccttccgtttcctagctgggtgtcccttggcagatgccacctttggagcctgccccacctcgggacacagcgagcttcgagtgcagtcagcccctgtggagtgtgtcccagttacacagaaatggggaaaatttcacaaaactaaaaaatggcttctcagccctcctttttcagtgaatgatgtggagccccacgcctagaaagcctggtccatgggcgagagactttgctgagatgagaagccagctggggctgctgcccacccaccctgcccaggctcctgaaggtggcctcaccttccaggtgcttgacaatgccccgcaggctgttcccgtgggctgcaatgagcactcgcttgccggccttgatctggggaacaatctcctcgttccagaagggcagggcccgggcaatggtgtccttgaggctctcgcaggtggggagttccccgggcttcaggcctgcgtaccgacgctcctgggggacacaggcacgctgctttccctcccaagccagtgggcccccacccgactccccactctgcagcttcccagaggccttcccagcaaaggcagcccaccttgctaatggagttgtagtaggggtgcttctcgtccatcgggggcggcgggatgtcgaaggagcgcctccagatcttcacctgctcctccccgtgcttggcggccgtttctgccttgttgaggcctgtgaggcccccgtaatgccgctcattgaggcgccaagtgcgcaccacaggcagccacatc

SEQ ID NO: 125251 - DNA, 1078 bp, Homo sapiens
gtggacttcctcatcacccaccccaaggagggtcaggaggcggggctgctgcctagagtgatgtgccgcctgcaggaccaggtgagggcctccctgctccccaagagccaccgctggccaatgccactgcctcctgctctctccacaccaccggatggtctcagccacgcccgcctctccccacagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaaggtaggcagtgtgccgctgggccgcctgggggtggggctgggccagccctgctgaggacaatcccttccctacagcttttccagcgggagctgcgccgcttcagccggaaggagaagggcctgtggctgaacagccatgggctgtttgacccggagcaggtacattgttggggactggggacagcaaacagcacccatagtccgctccctgacccacaatctgaaatggccccagacccctccagcctgaaacccataggacccgaatctgggtctccacacacagttcctggccctcaagagcacaccccacctcggcgctgggctcttccccaccctcagtcttcctgcagggaagcagcagtggcaagactcctaggtcacggaagtcctgcttctgttgcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcag

SEQ ID NO: 125252 - DNA, 1033 bp, Homo sapiens
ccagccctgccaactctgctcctaaatccacccttttgattgttaactcctcattgttttttgctgttggctaaggaggagaaccacagaaatttgttccaccttctgttaggtgggagaggcatggtttttccagtgacttaggagcccctcgtgctgatgtgttagggtgactgttttgattatgttggaatcacaggctagagctgtgtaagtccctttcatagaggagaggagaggggtgtgcgtgggtttgttcccagagacggcaggctgggtagtcaggctccaggtttgaatccttgccctgtggtctacggcaggttgcgagtggggacggcgcctgcctggtgcatggtgctccatgggccacaccgtcccggagcgggtgatcatccgagtctagccatgagagctctgcccaaccgggctacgctccttccccacagctcttcacccagatcttcggggtcggtgtgaagactgctgaccggtggtaccgggaaggactgcgaaccttagatgacctccgagagcagccccagaaactaacccaacagcagaaagcgggtgagccctccagagaggctgggccctgggcttccctaaactgcaccctggatccctcagcatcaactccctagagggaagggagcagtctggtgcagagggtttggtggcagctttgtgtggtgggcttcctggggtctccacccagtgcagtcaggatctatcaaagccttttctcagtggacgatgctgaccacagcaacttccatgatatgccaggggcttgtgtctgcctactggttagactttgaccagtgaccagggacagcctgggccttgggcacactgcccagtgtggtgcttggtacatggaggcctgcagaggtggcactgagcagcagaaagaacatcagctttcaagtttgttaggcctgggtttgagtcttatctaccatttgccaggtaggtgaccattgcccaagaaataacctctctgagtctgttacattttctgtaaaatgga

SEQ ID NO: 125253 - DNA, 1008 bp, Homo sapiens
atttttaaatctttctcgtaaagatggggtcttggtaatgttgcctaagctggtctcaaacccctatgctcaaatgattctcctgccttggtccccaaaatgctgggattataggcatgagccacttcgctctgccttgactgtttttgatggaatattctcaagtagattacatgctgtggcatcttaaacagagcactgtgaaccaaatgtacccttgggtgctgccactgagcatgctgggcttgcccttgcccgccttctgcaggaccttatgtgttattttctcagtgttgtcagcctgcctgtttccatggccaccttccctctgtttctgctcactcctggtctgatagggaaatgccgtctgagttcttttggatgcctcgggtgtgcctgctttgacacccttctgccaactggctttgtggctggaggtgtcacagcggtggccacatggataactgtcagtgaagtgtggcttcctgggtggatggggccttgggaggtcacacagaatgttgtcaggattgacagggagggcttcgaagaggagagacttgagcagtgtgtgcagggcaaatgggctcaaatatgcagggaagggggcaaggggcactggcagggacaggggaccagatgagtggggccaccgtggtgagtgtgggagtgaggggcctgaagatgatgaaatccccttgaagtggtgtgaggttagtgagtactttcactgtcagcctcagccccagccctgaaggcatctaggctggcagaaaattacattagtaatgagaagtttattaacaatataattgggttaatctcatcatttttagtcaggattctttgggttgcaagtgacagtgacccaccccacaccgttggttcacaaaataaaggaaaggagggccagcagagcccaggatggggagggctgtggccggtctgcaggacaactgggctcagcgacctgggtatcaccaggccactcctcctcccctctgcccc

SEQ ID NO: 125254 - DNA, 1078 bp, Homo sapiens
cctggtgagtggccgtcatccgcctggccttggggccagctgccctggctggttggactgagggcttccccagagtaggcctgggtggggttgtcaggcagctaccagcgctttcccctcagagccggaggaggagaccgagcaacccacactggactacaatgaccagatcgagagggaggactatgaggactgtgagtagggtcctgccagccccacctgggtcggacccctggcctgggggatgtgccaatgggcccatcccagccttgggccccactctgagccagcctccccctcagttgagtacattcggcgccagaagcaacccaggccacccccaagcagaaggaggaggcccgagcgggtctggccagagccccctgaggagaaggccccggccccagccccggaggagaggattggtaggatggggggcaggagaggaggtgccatggccacggcgctctggccccctcctaacctccccgcctccccagagcctcctgtgaagcctctgctgcccccgctgccccctgactatggtgatggttacgtgatccccaactacgatgacagtgagtacccagcaccccagagtctgagggacataggcaggtgggggtcggggctggggtgtggtcaggagccagctggggcaactcacccaccttgcaaccccacctgtgcccgtggttacctcgctgtccctgctgtccctgcgtgcccaccccagccactgccctgtctcctctgccctcaggctggtctttccttggccgcttccctggttcctgcttggctgtgacccccacaggggtgtccctaggcacacactctgccctgtcacccatgtgggttccagccctcccagtcctgtgctctaactggcttcccgctggctcgtggccactgccccactctcttcagggagcccgagggcttttgcctccctgttgctcatgcccctgcgtccctggagccctcaggttccctttcctcctgggtggcagcccgtgcatcgccatttccctgcccccaggtccccatcagtgcctccaatgtctccccatctcac

SEQ ID NO: 125255 - DNA, 1882 bp, Homo sapiens
cctttcctactcagattcttgggacccagaagggaggggccccgggagcccaggatagcctcgcttggctgccccagccctggaccccaggctggcctgcttcaggagggtggcagctccccagggcccctagtggctgggcgtggtagggggaggacctggggccttggtggggagtgaggacctcaggtaccttcacaggtatccctgcagggccattgtgcagacggtccccatctggatgacatctgtggctgcgccctgggggagctctacctgtgatttcacgtgtgtcccctgagagctgggcatggtcagcccgttctccagatggggcagctgaggcccagggaggggaagcacaggctgggattggaaacagctcctggcctggctttgagtcgattccaggtgggctggtgcagggcaccagggagccaccagctgaccagagctgccctctgactgtgcccccgatgtgccgggagtgggctctgggctccttggttctgggtttggtggagggaaggatggagctagtgagccaccattctggggtacgcgtcctcagagtgtccccccattgggatggagtcacaccgtattgaggacaaccagatccgagcctcctccatgctgcgccacggcctgggggcacagcgcggccggctcaacatgcaggtgggcattgggatgggcccatctcccaactgggataagggactcctccgcccatgctcagcctcccctgccccctggacagaccggtgccactgaggacgactactatgatggtgcgtggtgtgccgaggacgatgccaggacccagtggatagaggtggacaccaggaggactacccggttcacaggcgtcatcacccagggcagagactccagcatccagtgcgtggccaggctcatggatagttggcagaggggagtggctacataggcatggctctgtgtcccattaaggagattccagtgggcccttctttggcccagccaaagaaggccaaaaagatcagtgagggactcaccctgcccatccccactcctcagcctggtcagtcagcccctgtgtcctgatagcacatgagtttagggacagatcacctgcccatggctatgtgacgggcataggacccaggctcaacacctgggccgtgcagcaccaccctgctagctcttaaattcttggggctcggaagagggaggctcaggccacctgagggcctgggagggggaagacccttgctctgaccactgtccactccacagtgacgattttgtgaccaccttcttcgtgggcttcagcaatgacagccagacatgggtgatgtacaccaacggctatgaggaaatggtgggcaccatgcccaggctcttggctctgctcccattgtctgggcgaggggtgggctctcagaggggctggcagtactgctctgaggcctgcctctccccagacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccgtgagtgtggagggctggcaggggctctgagtggaggtggggtgctagggtgggccagccggcacccagctaaagacaaccccgcctcccttgcagctgtctacagctactacgcacagaatgaggtggtggccaccgatgacctggatttccggcaccacagctacaaggacatgcgccaggttgggagcatatatcctggggctgggggtgggacctgtctgtggctgacgggagtgtgtgcctggtgcttctgtcactgggccca

SEQ ID NO: 125256 - DNA, 1018 bp, Homo sapiens
caaaactgacccgttcatcttcccagagtgcccgcatgtctacttttgtggcaacacccccagctttggctccaaaatcatccgaggtaatttttgtcttctgggggcccaggctgatttgctgatttgctctcacctggggacaaggttcacagagaagaaaacctgcattgtggagtccccctggcccttgtgggatggacagctgaggtcttctgcacagctgccatttcactgtgggagccaagctgcctcgccagctgggcagggactggaacggctcccagcctgtgtgcctctcaaggctaatctctggtctcctattgtcactgccccactgtgtgccaatggggactcctgtttatttctggcagcttctctttgaggcaggacttacttggaacctacagtgggtcctatgtgacttctttgcaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcgagccttgagccctgggcactctggctatgggactcctgcaggggtgcccacagtgaccatagcccatgcacccaccagccggtctccctcctccccatccctgacacctcagaatgtgagcagtccgtgccatgagcttgttttattggagtgaccttggctccctccctctgcccctactccaacactgcagcaaccccatctcttacgagactggcaggtggagcaggagcctctacacagcctctggctcttaggtcccagtcatgtttgcaccccctcaaaggggcaggaccagcccttcctttcagtgtccataccaggg

SEQ ID NO: 125257 - DNA, 1035 bp, Homo sapiens
ccttgtacttgatgttctctcctggcaaggccagggccctgtgattggcctctcatggagtgctgggcagggcctccatggcctctgtcgggcgggggggctacttcatctctgagtctgtacccctcgtgtcccaggcagtggagtgggagtgaagaagctgtgtgaactgcagcctgaggagaagtgctgtgtggtgggcactctgttcaaggccatgccgctgcagccctccatcctgcgggaggtcagcgaggaggtgaggcagggtgctacacagtggggccgccaggcagacctggcctcccactagaacacctccctggaggtggggttgtggggaagcaggttcagagacaatggactccagaggggtgggggctgcggtgccagctcactaacaccagagctttggtgggctctggccccaagattatacctcctgtctctgcattccagcacaacctgctcccccagcctcctcggagtaaatacatacacccagatgacgagctggtcttggaagatgaactgcagcgtatcaaactaaaaggcaccattgacgtgtcaaagctggttacgggtagggagcccaatgagaggatgtgggtgatgcaggtgaagagcccagcggtggtgtgttagggatggtgtgagtggggagcctggggggagtgggggggtgtggcctgggcacacgtgtgttcttgaggaggtaggtgaggctccaggcggtcggaggccatcagattgggtgagacctggctgggagatgggtctccccacctccatccaagggcagtgactccaggaagcaggcatgcatcctggagtcctaggtgagaattcaccaatgtggttgtggagaactggcttgttttgcccgttggggtgactggaaggagtggtagcacctggggctccctgctcaggcctgatgccactgctccccagggactgtcctggctgtgtttggctccgtgagagacgacgggaagtttctggtggaggactattgctttgctgaccttgctc

SEQ ID NO: 125258 - DNA, 1043 bp, Homo sapiens
gcagactcccatttgagcaccctgctttgatggccctggttgccctttatatcacatcctcagttggaggctccttgtcagcacctcttcctctggctgtaccatctcctgtgactgttctgttctggatagatctctctgttgagcccatgatggaccttctccctttcaccctttgtatgagccatttcccacttctttgtcttggatgagcagttttccttttgttccatccagagtgtcttgcgctcgttctgtggacgagccccagcagacctgagccagcactcactatgggtgtatgtggcattgcgagggtctgtcatgtggacacagccataaatggttgtgcatttctgcctgacagtttttgcacactattcttctagtgcagttcttataaatgtcctgcttcttggaagttattgggaccttgagagcaggacctgcctcttgtttttccattgcattccaaattatgcattcaccaaaatgtaaaattgactgtatcctgtggaaaaaccccccagaaaattcacctgttttggtgagccaggtagcaaacagatggagctttcatggtgatgataattcataattatcagtatttgtgctcatttatagagtgtttgttactagggatgggagggaaaggaatgaaaccaagaagcaatgtctacttaatgtataagcccagaggtcactttccactgtgttggggacaaggtgataagaagtaggcaataaatacattttgtgtttcttagcgttcaggaattcatgaccttcacgagtcaactgattgtggagcgctcatcgaaaggcactagagcttctgtcaaagaacaaggtaagaagaccctccaacttctgtgcgtgtgctggcctggctgccatgcctcacctcacatagcacccagctttctcctttctactgggaccctactcctcctctagcttgttctctctttcccacctcttccttttcctatttatgcagaattctgtgcccactgttgaagtctgagcttcccagataaaat

SEQ ID NO: 125259 - DNA, 1034 bp, Homo sapiens
ctccagcctctggtggctgctggccatccttggcattccttggattagaggtgcatcacttcaggctctgcctctgccgtcacgtgaccttctgtgtgtgtgtttccgtttcttaccaggacatcagtcatggaattagatgccaccctaatccagtattacctcttcctaactagttacatctgccaagaccctatttctaaatatggtcacattcagagattctggggatgttaatttctgggatgcggttggggttggggggtgcggtgtgggtcactctccaacccagtacaatcatatagtgcccagctactcttttttccaaagctccatgcacacgcacatgtgcgtgcacacacacacacacacacaaatgtatatataaatgtgtgtgtatatatatatatgagttttcctggagtgctggttatctaagcctgtgctggggacagctttttgggaagtctgctacatcccagttagatcttctagatttcacgggaatgtcaccaggttctgttccatccacttggacagtaactattcttggaccgagtctcgacacctagaggtgaagtttgtgtgtgttggagaggaacccaggtaaggcactttcccccatgactgaaatatgaggggctcatgtcagggcacgtactgaacagagctggattctcttttcttttttgtccagcacaacaccatggagtctctgttagagcgaggtgagaagctagatgacttggtgtccaaatccgaggtgctgggaacacagtctaaagccttctataaaactgtgagtacccagcacctgctgcctcctgggtgttctctctagagagcagtcgcagcttgctgcttctggcactctccactatgaacgggtctttcttagactgttgaatcatggtggatgattccttgtgcggcaagagcctaaggtgagcgcctcaggcccaggtggttggaggcagttcacttgggcgccgttggagtcgatgcgggccgaggccttgttccactcctgcctc

SEQ ID NO: 125260 - DNA, 1065 bp, Homo sapiens
gggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggc

SEQ ID NO: 125261 - DNA, 1751 bp, Homo sapiens
cccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgctggccagcgctgcaaggggtcggctgcccacggtgctggctggcctcccctcctctctctttttgctgagtttcattgtcttttctttctgagccttgtaagtgtacaaaaattattcttattttgttctgtctcgggaaactgcaaataaaagaaaaacaggacaaactgcttcaagtgcagctgggtgctttagctggaatcctgccgacctcctgcgccaaaatacagactcaagcccggtccctggccaagaccctacttgggcccctcctccaatgaaaggtagtgctatgggagccctgagctggccctgacagtcctgagcccctctagggtgaacggctcaccccaggtagggcactagtcatagatcatagctctaccagctgtctccacctcttcctctggtcctctgaagtcttctgggcccagcgctgtccaccctgaatgctggaactgaaactggatcccagcccccaacacccctgacctctccattcacccccggtggccgctaaggatgtggccagggcagcctctgggcaggaaggagccccaggaccaagacctctggctgtcctgctgtttccttccgcccctgctacatgtattggctattctggatgctgaggacacacagtgaccacagagccgggctccaccccagtggattatgcagacagatggcacgcaggcctgtgtggacatcagcctcgggcaccagacataggcaaggcgcaaggtgatacagtaggcagccaccatgggggccaggaggctccagcagaggccacacaaccagcccagaatccaggacagagagctggaatggagacagggaagccagataccaggccagactggccaggtgctacaggcctgtgggccaggccaggcttggggacttcgtcctgggtgtgaaggagacaggcacccctgaggccttccctctgcatctccagcccaagctaagcgcaaactcttaggttggagtaaggagtaaccccctgccaagtttctcctgtcctcaggctccacccaccacctatgctgcctggccccatggggcacacgctcaggcccagcctgggaaagcaactgcacctgcctgtgctatgctggcccttctcagcctcaatgccctcctccctccccgacgcaccctcgtggcccccgctgggccccctgatgcaccctcatgtctccatggcaacctgctcagagtgtggccctgcccttggctcccctccacacctgtgtcccaggcagtgccacggcactttcctaaacagaaggatgggcttcaaaacagtcccaga

SEQ ID NO: 125262 - DNA, 1003 bp, Homo sapiens
aaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctgcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgg

SEQ ID NO: 125263 - DNA, 1044 bp, Homo sapiens
aaaggattaggctggtggggtggaagacgggcaccagggcagtcatggtaacccgagacccccgccccgcctgctgtccacagtgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaaggtgagtgttctgtgctaagtgacagctggggcagaggggtggcggtggtgtgagtggctgcagcctggggaggcgatggggagcggtggggcctgtgcagagccatgcctgggaagtccctgagctttcctggtgaggccacaggaatgatgtcaaattagggaccacggcaggctgggtgtggcaggcctccccagaggactggggagctggtgagggcctgagcagtccacactggccagagctgggtgggttgcaggtggatgggccccgggcagcacagtcctgggcaccatgccctgtttgtgaggactgttagagccccagatgggcgttccccaggtggtgggtgcagcgggcccagagcccagttttacagggatagtagtaattgggttgggcaccttgaacctctctcccgagtgggcccttttctggactttaaccctctctgcagtgccgcatggcagacagcagagcctgggggtggatgggagagggggctgctgaggagctgacccacccgccccatttcagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacga

SEQ ID NO: 125264 - DNA, 1059 bp, Homo sapiens
gaagagaagacagccagaagccagcagctgtggctcagatctgagcccgagcagcctctcgaggtggaggcagacaccccccaccccaccccgtgcagaaagaagccttgccagcctgccctgaggctggtacagagtccaggcaggctcagtggccatcatgcccctacgatgactgtcactccctctccgtgcgcctggcctctgctggctctggccaggggtggtcacagcactagggtggcagggtggcctctgactctgcgccagcctgcactggcctgtgctgccctggcctctgctggctctggctctggcaccggtcccgtgttggctccttcagccttcacatacctgctgcggccaccacaggcccaggacccccacaggtggccaccccacctccaccccaggagccccaggtatccagctgtcaccccctccctccctcctggcctccccctgtccttctccagttgccttcttttcctgcgggcgcaccacccacctgcctgcctcacctgttccgcctcagcccccagggtccccgacatcctgagctcagtgaggaggggctcgggagccccagaagccgaggggcccctgccctgcccatctccggctccctttagccccctgccagccccatgtaagtagcctgggtcctgctgctgtgggggtcatgttggagggctggcaaccccctagaggggccactccagagccgagggcaggctgagcgtggaccctggctccagcctcatcaccccacaatccctcactggggctttccagggtggccccagcccatcgagccccacctctttgtgaggagggccctggaccactttcctgctcaaggccactgggcaggatgggaggccctggaggctcgggcctcaattccagtcttcagggtcggtgcaggcctcactccacctcagcttgcgggcgggggggctccctgctattgaggcaggctctgattcagggcctgatcccagggcccaaggggtctagaacacgggacccctcccactggcctcctccgccttgccg

SEQ ID NO: 125265 - DNA, 1036 bp, Homo sapiens
gagaggcccagcctcccacccatgttgacttgtggatgtctctccaggagtgttcaggaagtcagtgaggcagaagataccctctccccaccaggaccccaccctcagctcctccaccatcctcaacaggccgacccacagaccactccgaaggtctggcttggtggggctgggccaggatctgcagggggaacagcccatagtggcacattccacggcccatggggagacggggccacggtggtgcagtagagaggtgtctaagccagtggcagccaaggggagggcttgccgtcacctctgtgttccctcagtgctgctctgtggctgcctgagaggcagggcttaggggctccctgccggggaggggaggggtccccaccatgctccgctccaactgcgcccctcagtgccccttgccctgggggctcctacaggtgaaccctatagcagtactcccaaggatgtaaagttgtggctggtgggtgccggccttcctgctggggcgctgtgctgtgtcccctcagctgtcctaagagctttggggcttgctggcccgtaggtccccatatttgctggaagcaggcttggtgtcccctgagaaccccaggccaggcttcgggagccagccccagaccgcccacgggaatactgggtttgccaaatggccaccttgagacccaggagaggagagcggtcctgggaggggcgagctgctcagagcagccaggccgtggctggagggtggcctggtgcagcctacctagggccttccagtggccagggcagcccacgtgccagcctcacagccagccccatctcggaccctgtccatcccatgtgccaccgccacccccatgacatcttcaaacctgtgccccccaccacgctggggcacaggttcaggcagtaaagggtagggagaacccctcaagaccgagcctggcttctctggctcccacacacattgtgcagcttgtcggggccccacacggtccatctcccaccctggacagcagcacctccgccagcctgg

SEQ ID NO: 125266 - DNA, 1040 bp, Homo sapiens
tgcatttctgactgtacagggcgattctgctgctgctgctgctgctggggttgggggaggatcccatttgagaagcgctgcagtcctaggttgaaacgtgcctgtctgtccccacccaggcctgcatgggcagcacgggatccccaggcaggaggacccaatttcatggcctggccagccagggtcctggagccaggcggtgggggagggatgggggattgctgtgccaccttccttcccggcttggcccgggggcaagcatcctcacacttcccatgtcgtcatccccttggctccagcctggctgcctctctaaccctgctgtaccggctggccgcatggccctggctctttttggtgagcgtggtccaggactggtgacctgtgagtcctgggcccgcagtcttgcgcccctgcccgaaccaacacaaatcttgttttctctctctctcttccttcctcactccctccccttctcacctttccttttctgtaaggtaagctgacttcctcttttggttttttatttatttttattttttagttctgtaattaaaatcctaacagccatggagggtgtgggcaccgggggctggggccaggcccctctgacctctgagggggaatgctgggtgaggcaggggccccgctgctgggaccaagtatcctcaggggcttgtgggcagaaaggcctgtgctggccccagtcagtgcacagaagcggccccaaggccagggctgctgggcagctcggaatgagggcgagcagggctgcccttggtgcctgagccaaggagccaatgggacagacctctgaggcctgggtgccaaggtatgaggtctgagagcagggtgagcgcctgggctgggacaaggccctctgagtgggcggccagctgcagcccacccacccctaccccaggaaggcagggcccgggagggcatgacctctggggtgctggctcagctgcccccaccccaacctgacacagctagtcctgagttcccatcagggaggaagcagcatcctgccttcctct

SEQ ID NO: 125267 - DNA, 1052 bp, Homo sapiens
aggtgtctgagatgcctgtgactgctccgcctaccctgggctcctgcggcacctaacgcatgctttgaacttgagacacagaaaggaagttcccgtgcccttgaatgctagtgtagatgggcatcgacaggactctggccacggtgaatctggagttagtcccaggcagagatgtgaaatgagcagccccccaaaaaatggttggccgggagccatgcactcaggagggccgggcccatgcaccccacactgcgcccaaggcgtgcacaagcgattgttttaaaagcgggttcacaaggaaggatgtttgggaactgactgagacaacagggacgtctgctgcagggcttcccagagctctgatggcagcgtcggcctgagtccttcgaggagggctggtttgtacgtggcatttgctgcccactggactgtgaacttctgtctttttatttcccactgctgctgtggtacatctccagtagcatagtttggaaatgcaggttttgatagactcaaggatctaaatagaaccctcttagtaccaaggactgtccggggtctctgccagccccgccgatgggcctaactgtggtgcctcctttcctgtgagaatcttctgaggacatgcccggggaaagagctcagttctgctgctgcctagggtgccatgctggccccggttccaatgcagagcctggctggaagtaccgctgggttggcggaggctacgtgcctgactgtcccctcgggggtggggtggaactagccttctgaaaccgcctgcttcagttggccacagctttttgaaatgtgtgtttctggaagggactgggtcccttccttgcctgttcagctccccacgacaaatgtcctcaaggcgaggctggatgcttccttcctcaggctcctaggaggagcccgtcccccagctgtgtcgggcagctggtcaccagcaaggacaggatccctcagctgcagcctcaggctggctggcactgggcgggtgtttctgggatgagttgtgtgtactggagatgggaggggagctgaga

SEQ ID NO: 125268 - DNA, 1027 bp, Homo sapiens
ggaccccagaggagctgccgtggtgaccagctgttctggtgacccctgaggcttgaggggtcttgaagcagctagaagctgtagttggtcaacaggtttaggcccagggtgtgtgtagttctggaaataggtgatctgtctcagtgcggctgctggcttcctggagctcttgcctctctggaaggctgaggtcatgtcagcctcatgacaatgaggctgagcatctgggcaggaggacaggggtcttatcctggccagaagccagcagggaacactgatgggatagccccggttttatctgtgtctctccccagggagccatcctcaccaccatgctggccacacggaatttctcaggtgagcctttcttctccagggagacaggcgctgccccctccctgctggcccacgcaggagagcgcctccttcctcaccagcctctccactcctcctctgcggcaggcctgccctcggcgtctgccctcagctctgagacccactgcccacctggccccgctgggctcccaccttgggtgataccacagggtccagccccccgaggccatcaccttcgtgctgggtctgtgtccctccaccccctgaacacgagcgtctgtgctgccccactggggctcacagcatcgtgtgtgtctgtccaggcgtttgtcgggcatctatgtggcctccttgtcattttgagtgctctgaacattgtgttttgtgcgggaggtgggcagaagggatgcggggtgatgcgggaggctcgggggcctccttccaagttctggatgagctgcagcctcctgtcccggctgctcagggtgggtggttgggaagcaagttctcttggcaggggggtggggtctgttatagacccctgaggcccagggcgctggcagacccatcgggcatgatgttagccccggagtggagccggcagcccaggtctggacaagctgtacctgtggcttctccgtcgtccgacactccgtgtgcgagcgtctgtgatccgtctctctcgttgtcc

SEQ ID NO: 125269 - DNA, 1225 bp, Homo sapiens
ggtgctcgctgggtggccagctggcccgcagggcccaaagcactctgctcagccctgccctctggcctgcccacccgggccctacccagcccgatcctctgggcagccctagggcttacaccgctggtggtgtgcctggacaggtacggaggcaggcaggaggtgtgtcctgggctattgccagcccctcatggcttctctgtccccacagtgcgtctccacgacagcatctccgaggagggcttccactacctggtcttcgatctgtaagttccagagctggggactctcgctgcactcactcccagccttggctcagggtgggatctgcagcctccccagccccagggaatagtccctacccgtgggctggccactcccttgagtgtgcttctgctgctggtccccttgctccaagctgtgcccagcctagcttccctcgcctcccctcatttgctttgcactagggttactgaggcccacagaggcagggctgacatcctggactccccctctcctccacacagaacagggcacactggaggcagcgggtgggtggaccccagaggaatagtcagtcagcagctgcattcaccttcctttccttggtgccctcatcccagctggactggggcaccactggctggcgtgagtgcacatgtgtgtgtttatgagtgtggctgtgaaatgtgagcacgtgcacctgtatgtatgtgtgtgggtgtttgcacgtgggggcgcgtgagcacatgaaatcagggtccatatgggtggggatgtgcatacatgtgcatgtgtattgtgtgaatgtatgagtgagcgtgtggaggtgtgtgcatgtgggtacgctggcacaagtgtatgcatgcacgtttgcatgtgtgtgcatgcatgtgtatgtgtgtgtttgcatgaatgtgcatgtgtgagtgtttcatgagtgcgtgtgcagtagctcagtgagaaggtgtctggggccgctgccgcctctcacttcctgccggatttagaagcagtgatctcatctccctcacttttgacagttcctgctaagcagcgctatatttagctgtctgtgagtcagtgctgttccaggaccctgacctgggcaagggcccataggccttagcctgcccctgtggcctccaggcggccacacagccagagaagcccagccttggtgctattgccatggttaccccaggccctccccatggctgctgtg

SEQ ID NO: 125270 - DNA, 1014 bp, Homo sapiens
ggctgagcaacctgccccaggtcacacagccagtgcaagtggcaggggctgggcttgccctatattttctgattctgtggaggcttctggggcctggcctgcccttggtggagggcattttgcctgaggtttaggagctaaggagggccattggtatggggctgctggagtccaggaatctgcaaggtgaggcctaggccccagaagccacatggagttcctggatgtaaggacgctatcaggctgggcccctgggagaaccagagccagaggagggagggcactggcagccagttagaaactgggacagcgccggagcatgcaaggaaggggggctgcttgtgcctgaggcccagggacctgcgaacctaggagaaggtggctacgtcttactgtcttacccattcagcgtctgtggcccagtctcaagtggtagaggagagccacacctcagaggttcatctctccaagacttgaggactggagggaataaggctggtgcagtgcaggccctcaagccagactgcccgctgagtccacagccctattctgccttttgtgagctgtgtgactatcagctgcttacctaacctccctgtgcttcagcttcctcatctgtaacttctcggggtggttgggaaggttaaatgaaataacacacacaaagtgcttagaacagccctagcgtgttggctgtcgtcgtcctcgttgttctagcaatcatcagaaccggcacgtgggagagtgtccaaaatgagtcattcctagaaaatatttgctgcttagtacagggcacatctccagctcaaggaaaagcaggccttgaggttgcttgctttgtgctgaaatcactcactgttccctcgcctcttcatccgcttgttcattcatcacatcctgaccagctcctgccctgcgccaggcagagttccagggccaggcacgcttcacatagattgtcatgggaagttgtgcaaggaggaaggagggaatgatggtggtccatcctgctga

SEQ ID NO: 125271 - DNA, 1019 bp, Homo sapiens
ctgggccccgcaccttgtggggtgggaggagagcggccagggcaggaggggccacctcctgcttcaccaccagtttactcctatctcccaggcgaggcctctctgaggctttcccctcctcctcctgccagccgggctctggggcacaccctcaaccccctcccggccccattctgacagcccctcccctgcctcggaagaacaaatttggcttcagccaaaagctccaaagagtatggaattaggacaaataagtggaggactaaatcagtgcaccgctgacttagaatcatccagggaaacttttagccccgagttagcagcgctcactacccgaatgggcctctccacccatcccaaacacaagccggctggtccctgccccagccttgccaccagtggcccagggggtgccacgaagggtgttcccttggtgggggcacaaccactcctctcgtcagaggccctggcacacccttgtgggcctctcctgacatggacgatccctgggccaccagttgctggcgcaggaggtgacgccttgtttttcctgtcccccagatcaccagaagctggagagagaggctcggatctgccgccttctgaagcattccaacatcggtgagcagcctggggtagggagcggggatgggtccccaccttctcccggacagcagcccattccggtttctctatcagactttcaaagagatgcagaaagacttccttttcttctctgttgaaatatcccaccagaagcccctgaggacgccccctcttctcccctgaccttgaggactttgtcgtatgtgacatgattcccgggggtgctcagagccggggcagccccaaggtggggctctgggtgcccagctccacccgactggacaggtccctttcccatcccactctgtcctttgggtcttgtcggtggcattggtgcagaggaaggtaaaggacacattcctcacagagccctctgctgagccagtgcccagcatgtgacccccataactctg

SEQ ID NO: 125272 - DNA, 1033 bp, Homo sapiens
aagccagggcaggagctcctctgcaggccaggctttgtggggtacgttcatggcctcttctcgatggcctcagcagccttaacccgattccttccttgtgtctcttgggctctggactgtggttgatgctggtcagctccctctgtcccccgtccctcctcccctctccctacccccaggctgtcagtttgtgaatgtcccttcgcccttactctgggcctccatggcctctgcgttgacacctggacagtggaggctctcaggaccctctcctccagcttttcagtttaaggatgtgatgtttctctctccctacaaaaccttccatgagtccccatgtctgactgcacaaatcccaatataactgccctctggagctgggccttccagacaaggccagctttatttgcctctggggaagactcagcagggcctcatggacgtggtacagagcccccgaggatgcctgctgagaggcctgtggacatggactcttggtccagccgacccacaaggatacaggcctgtaggtcacacaggagctgaacggggcccctccgccaccctcccgagggcctgactgatccttcttctctgcacagccccccagggcgtgccatctgccagggctctgccagccgtcgggaagccggcctctgttctgctggtgttgagtggggccagctgagagtggcttgtgaggggcacccacttcctcacagtttctgactcacagccatctgcccgaggccgggccggtggctgaatgcttaatggggagtgtttatggggagattaatcggctctctctctttctccttgtctgtctctgtctctgtctctcgctcccccattttcctccccaggggggctttctctgtggtccgacgctgtgtcaagctctgcaccggccatgagtatgcagccaagatcatcaacaccaagaagctgtcagccagaggtagggcatggggagtgtcctgcgcagctgctgtcaggctggggcaggggctttggaggccgtgccctgtgg

SEQ ID NO: 125273 - DNA, 1066 bp, Homo sapiens
agataaaatgtgatacaaagttgagccatatgtgtgattaaaaattttctagtacgtaaagaaaaaaaagaaacaggtgaaaggaactttaaaaatatatttatttaactttatatccaaaatatcattcagaggcctggtgcggtggctcgtgcctgtaatcccagcactttgggaggccaaggtgggtggatcacttgagcccaggagttagagaccgtgggcaacatggcaaaaccccatctgtacaaaaattaaaaaatcatttcaacatgtaatcaaaacagaaattattaagctattttgcattcctttttgtactacgtcttgaaatctggtgtgtattttacccttacggcacatctcagtttggaccaggttcttatgactacatggtgacagtgaccacagtattggacaacacagggccagagcttcaaaatcaccatgcttttttttttttttttcatttttcctggtttcttttaaggataatagttacagtcatagctgtcttagtctgttccagatttcttttgctctcctgaagacttattcatttattcagcaagtctggttgcctgtacttaccatgtgccataggtgcttgggaaacagtagtgaacaaagcagtcaaggatgcctgcccttagggagcttatatactgctggatagaggcaggcaataaacataaatactaaaaaaattatatgatagggtagaaggtgattaatacctctgagaataattaagaagactcaggagtgctagttaggaggaaggttattattataaaaaggatggtaaagccaagaaaaaagaagactccaattgctaaaatcaggaatgacacaggggaccttactgccaaccttacagaaaaaaaattataaggaaataactatgaataattatgtgccctcaagttagataacctggatgaaatggacaaatacttagaaagacacaaactactgaatctggctcaagaagaaatagaaaatctgaatagacctataacaagtagagactgacttagtaatttaaaattttcccacaaaggaa

SEQ ID NO: 125274 - DNA, 1047 bp, Homo sapiens
ccggctccaggcgcactgcgggcccgcgcgccgccggcttctctgggctccgggcccaagcgcacggccccgcgcggccccgacccgcgagcccccggccccgggcctggctgcctgacctcagcgcgcgcggccctgcccagctctgcccagcgcggctgccgggccggggctccgggctcgcgacttggcgcggcgggggcggcagcaggtgtccccggagcgcccggcagacgtgacgcatttggcggcggggaggtcagagaggaggggcgcgcgggggtggcccccgggcctggagcgccgggaggggtcggctgcggccccagagggtcgtccccgacgcgggtgcgctgtccccacccccacccgagcggcaggcggcgggggtggcgggacctgcttgcgcctgctcctgcgcgtggccccatccgcgctgggggtgccggcgtgggagagcctctgctgtaggtcccctggggaatctgggttctggaggattttcccccagattcttctggaaacaggaatttggaggtgtggggaggacgaggtcagggagcctggatcaggtcatggggatagcggggagagactaagagcctgactggattgcaaatttcagggtcatcgaggtggatgggggctggattttggactgttggcgggggcgccctaaaggggaaggggctttgaaggtttgtttgaagtgggacctcacggggaacaggtgctgtggctcccgttctctccttggcagtatgagcagtgtagggcgaaggtctggttcgtggtccccggacccggctttgcccctggggtgagatggggagcgcctcaggggcctcctgtctggcctggggtctcccgttctgagaatcaaggtggctgcacctggcatccctagggctagcttcagaactcctgaatctccagcctgactgggccagagccccatcctcctgcgtcctcccccatcctcctccgtcccttcagtgcaggcggtgggggcgctggcggtgctggcgagatttcctcttacacatc

SEQ ID NO: 125275 - DNA, 1052 bp, Homo sapiens
tgtgcccaccccatctccagcctcctctgaccctgctcacccctggggacaggacctaggggtgtgagaagtacttggctgaataaagactgtttcaaaggcaatccttagaattgcctagcatactcccagggccagaaataacccgccagaaaggagaggcgtatttgcccctgaagagtgcaggagggagaacagttgagaagtgttttgtgtggaaatgtgtccaagaggcgtcagctgctgcacagagaactcactgcccagaacactgcgcttggggaacagacctcacccccacctcaaatctgctctccactgggcctgttggcagccagctcagctggggaagggacagcatgactcgctttgtcgatgaaaagcacgaagttgtcagcacagaacctggccagtccttgagaaactccctccttggtggtcagaggtcaagcagcccatgtggcccacggtcctgaagaactgggctatgtccctgaggctcctctctaccgtctgactgtggggtctggggaacaggcatttaaaccaggctgctgccctggggagtgcccactggacgccagggtgccccatagggacagggtcacaaagccctggggcttcccctgccagtcctggtgaggacagtgtggtcactatctcagagagacgaaaaatgaatattctgtcatttcagactaaactactcacccagctcacactaatatggatttgttaattttacctttttttttctttccaactttaggttcaagggttgttacatgggtaaattggatcataggggtttggtgtacagataattttgtcacccaggtaatcagcatgatacctgatatgtagtttttcagtcctcaccttcctcccactcggttttattttttagtactgaaagtttaacagattggtcttacctcagagggagggaagaaacccccccatcgctgggctccttggtgtgacaggggtctggtaggggttttcaatcccaccacccattcctccacaccaaatgcctgaagtccccactt

SEQ ID NO: 125276 - DNA, 3142 bp, Homo sapiens
ctgagaatcccacagcctcgttttctgggcctatgctacagggttttgtgcaacagggactgtggatcatattggtagaataactactggccctacatagtctcttttgtctcttgtggtcagaaggttagaaggaaggagagatcatccctagccctcagtgtactcatggtggccaggtgaggagggcagatatagagtccctttgaggagaagagggcctgccagcccaggtacagatgcttccctcagggtccaatctccctgatgtcccctgccatggccacacactgagccttgcttctgatccttggaggctagatagttccagaatggccacacgttggcgagggcttagtcaaccagctctgactgcatctgcaaggatgcagtggggaattcctgactgacgggtctaccactggacattctgaggtttcttcctccgtgccacatcctgggtcaaccctggattgtctgatgatatagttcttgatgctgataactggggtgctagggtatctcctctgcacaccttagtcatgactcaggtggggcttgagcactttctctacgcaccttctctacaaccctggtgggctgggacactccctcttaatgccttagtcagtgcctggtgggaccatagatgttgcagggtgtttggaatttggacagagatcctggtggaaaagggacaagatgaaccataaagaggagccagtgcttgctggggacagaagatggagggttagaaattcagtctgtggagcagtcttggagagaaattggcaggcacccagtacctcccttggtcgaaggctgctccagggtagtacagttctctggccagccggtcttgccaggcaagtgcctgagccctgaggaagcaagaaggctctctacctgcagtcagagtctgctctgggagaaagtacacagtgcgttgtgatcccctttaatctctctattttctgtttgtagaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagta

SEQ ID NO: 125277 - DNA, 1114 bp, Homo sapiens
cccctaagatagcagaatgttggatgttgctcttggaagcaagagagatcactggagaggtagttggttgataagagctaagcagagccttccatggcaagcatgggggcaggctgggttggcccaggacaggtcctggtgtgggggggtgtcatgggtcttggaaaatagcctttcttcatgagagtgggcaaggtgtgcacatggaacaggcactgtcctgagtatccaggacctgctgaagaaggataaaggcatcttccagaatgtcagtcccctcaggtatgtgcctcctagctcttccctgggatatgttagcacaggcagcaaatgcattcccaggcacagagggtcctgccttgggttctggcaccccctcttgtctgtcacctccctttgtgtagttggtcctgagcttatcctggacacccatccctcagtgggctctgctctgtccccagccctggacacctgtctcaggtctctgactcaggtctctgtcctgcttgtccccaggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctggtacgagcatggcagtcctggagagtccaccctttaggcccttgtgctggtgacaaggccgatagtggcagaggggttggtgatgacggtggggaagaaggttgtgtggaccagcttcctgccatgtcctagcctagcaaggaacctgtcttacctgctcttgtccccaatcactgcctcacaggtgcactctggtctttcagctgtgttctcatacctgggctgagagcccagttaacaggacctcgaagggtgtcatgagatctgcccttcctgcaccagagcctggtaacatcaagtgtgttgatggcttttgtttgtgcctcatctgcacatatcttcccatgaagagtcgcttggtgggacctttggtagaggaggggagggagccagattgcagagccagttt

SEQ ID NO: 125278 - DNA, 1735 bp, Homo sapiens
ccagaagcattactctaaggaaagtagttaaatgtggacagtgacagcagaaacatttacacattaaaccagtttatagaacatgagaatgttcagagcataaagaagcttgtcagctcaatgacttacgaggcgtgggccattaaaaaaaaaggtctggagtttgggaaggagaaaggaatggggatctgcagctcagagtgagagatggaattctgtaaaggaacagtgtggagagggactccaggcaagtcaataacgatgttagaatgcccttgtttagaataattatcatgctaataatattgttcatattgtttttactaatatgctcatccttaaaaatagaagatattctaagggtactaaataaataaataattaaaattttgcaactgagaccttcctcttccagagcctttacaagaacctttatagacaacacctcaggtcctgtttgctgccccagcatggagggcagcccacttggttacagtgatgacagatggaaacttgactggagcaggtctggaaggcagaggaggcaggcctgtgtgtatatggtcaggacaaaggaccagtggtgctagccacacctgtgggatggctgtaattaaacacacacacacacacacacacacacacacacacacacaacagaagataacaagtgttggtgagggtatggagaaactggagccattgtatgccgctggtgggaaggtaaagtggtgcagctgctttcgaaaatagtatggtagttcctcaaaaagttaactgtagaattaccatatgacccagcacttctgggtaaatatacagaagaattgaaaacagggactcaaacagatgtatgtacatcaatgttcatagcagcattattcacaacagccaaaaagtgggggcacctgaaatgtccatcagttgatgaaacaaaatgtggtttatccatacagtggaatattattcaaccttaaaaaggaatggagttctgattcatgctacaacatagatgaacattgaggaggacattatgccaagtgaaataagccagacaaaaacaaacagataactgtattattccatttgtgtgaaatgtccagaaccggcaaatctgtagaggcagaatcattagtagttgccagtggcttggtggggttgagggaacaatttagaggaagggttagagcaaatggggagtgactgataattggcacagggcttctttgtgaggtaatgaaagtgttttgaaactagataaaggtgatggttgtgcaccattgtggatatactacatgccattggttcacttttgaatggtaagttttgtgttaagtggattttgcctccattagaaattgttcaatataaagtcggctcacatctcctcataaaataccacactgatgcacatgcgtgacgtctgtgagtgaggatggcccccttggagagctgcactgcccagcacagtagctgctagccacatgtggcagctgagtaaacacttgacaggtggctcacgtgactggagaactgaattattttattttaattaacttaaatttaaaacctacttgatttagttactggaaaaccttgaatatttttgaaacaacttgggcatgtgaatataccctttcaattgtaaatattatgaaatctgaacacagatgaagtatttctgatgaaaaagtgcagtgctcatcttaatttttgttgggttcaagtgtacttc

SEQ ID NO: 125279 - DNA, 3846 bp, Homo sapiens
tgtgagatgcagccaccaggcaggaggttgggggagctgtgccttaagaggatagctggatgtttaactttcatgccagggcccccggggccatagcacaatcccggcaggcctgtctccacctgtgtgttctgcttgagtccaggcttcatttgtgccctggctgcctttagtttttttagttagctttcatgaaacacctgctactcaaagagcttgtagaaattcagcagaaccattgcagactgaggggcacctgtcactgcccgtgaacacggctcctaaatattctctgctaaaaattcctctacaattgaaacactgcatgagttctttcccatggttccttaaagtgcctttattatcaatagatggcattgcgttcctaatgcaccttcacctgtgagaaatcaagtacctgaataaagaggagttatggagagcatttaaactcttcccatagtgctcccgtgcagggctctgcctgcctccacctctttctggaccacgtagcctctactgcagtaaacacagagtatatcacagaaactttgctgtttacaggagctaaggcgtttgttgtcttcttgatataattatttatttatgtgtgaccttttaagcccacattgtttcctctgattacatatctgagataatattgtgaattaatgagccgattgctttgattcacgaagatcctgtttgcctcccgcttgctgcatcacgtctgctgtgtggagcttggcacactgctttgagcgtgtggatgcagagagggactgcaggtgaatcagaggggctggctttgggttgcagctccctgtcaagcagctgccaggttttgggtcatctctttagccttgctgtacttccatttctcaccgttcaaacaaggttgagcactgtagtcttgttgatctccaatgtttgttggtttcttatcattaagtacccaaccctgtgcaggcactgggaatggctaaagaaagtgagttgagggctttgctctaaagggttggagatatcctgtgaatgtggccttatttgggaaaagggtctttgtagatatgattaagttaaggatctctcaagatggaatcaccctggattatccagtgacacctgtctttataagaaacaggagaagacagagatagacacagagaaggccatgagaagatagggcagagatgaatgatataaccaccaagcccaggaacacctggagccaccagaagctggaaatggcaggaaggatcctcccctagagtctctgcaggagcatggccctactgacaccttgatttcagagttctggcccatggggctgggagataataaatttgtattgccttgtatcgcctggtctgttgttccctgttagggcagccccagacaccagtgcaggtctcccatcacagcactgctgtgaggctgcatgagatgagaaggatgcaaagggatggcgtccagagctgcgctgctgccaccaccctcagctccttggttagatattctgaccttctgacctcctggcagcccagtgcagacatggccttcgcttcccagctgccttccacataacctgctcctccctgtgccgtggatcccacatcagccagccagggcaggcaggggtggctgctaaaaccgtatgacagttcttgcctccctccctccctcccacacttcagaatgttaaatgagacttcttgactcaggcaagctcctttcttggttacgaagatgtaaaatcagccgtggcaacggcaccagctcttttttccgatagctcgttcagtccccaaagctaggcagttggcatgcgcaccatcctcctttcttcctgcagtcgggggagctgacaggctgtcctccatgctgccgtgggtggctgctctgctgcgggggctcttggacatggctatgcttgagatggtcgttgtagctgtatgtgaggtgaatgccgttccatatacacttcttcatgtattgacgtggtgcgcacacaagtcatttaaaatcagtgaaattgctctggagtattctttgaggagttagaccttgaagctcaggctttaaaactcatcgtaatatatttgtttatgatttttgaaccctgtgagtgtttttgtgcaagctgtatccacctcctcccctcaatttagattatttctcaagagtggaattctagtgtaactgcagcctctgagctgttgctgtggttctccctggtggatgagttgtttctggagtgtcgccgatgacattagccctatatccccacatccccaccaacagtgggcttttcatcttcacttatctttgctaatttacccagatacttccagtgtcacttcttagaacaattgtgaggataaaatgaagatgggtggtttattgtctacttgtcctcattggcgagccactttcctgagtccccacaactttcctggctcattgaggccatcccatggattacttaacatacttcttcataaactcagagtgggaactacagattaaattaccttagcattttggcaagagcccagagcctggaaattagtatgtgaatgtaatgtgagcccttaagccttcagtgcaagtgatgtctctagggagagccctcagcgtttttcaggggaaatcagaatccttcatcagttccagtagggaagagctgaagcttacagatttaacagaaggcggtagcccaaggaaacctgttccagtgtgagtggaaggaatgtgctgagcagagccggctaatggtgcctcttggtggcaccatggacagggtgctgggcaccctcgtttcatggggttggaggagaggaaaggaacgcagctcggcattgctttgtcggccccatccctggaatacatgggccttccagccacactcagaccacagctgggtcctatctggcctatacagtgtcttaattttgtttctaattttcaagcttaaaaaaatatttgacagcattgaaaatcaggagattgctcataacagtgctgacttgtggtgtgtcctgagaagccagatctgctccattgtggcccacattcccccagcagcaggtgctgagcaggtgccctggacctctgccacgctgtcgtctcaccccgttatctgccctcgctctgaggtgccttcccggaaggaacgtcccacaacattcccataagtctcattggcccagtctcgatcacgcgggcagctgtgaggagtaaagtcgtcctcgctgggcacattgcttccctgaatagaaatgaggttccgttactaaggaaggaaagggatataaatgctggtgagtcatcagcgcagattgggggatgctgaggtaagtttattcatgttgaggtggaagtttctgtgaggacattttgggaacactgttcagcctgcagtctggggtccctcagaaatggactgattagaggtctgggactgggtagataaaagaggaacctggagcattttgttatgctggaaaatgagaacgtgccagggaaatgattgagcaccatcaaagtcaagcaacctccaccaaccttgtctgggattgtttcacaccaacataattaagcatggtaatgagttataagccattgagagaccagagaggccaggaatccaggggtcagtactgacagcaatagatagataatttcattgcagaagagaaggtgcttgcttcaataagatgcataagccatcagtcagtgtggagggactagggcaagaaagtcagcatttcccagccttcgtgggacagatgggaccggcagatgctatgcggggcagggtggagcagggatgcaggggttctg

SEQ ID NO: 125280 - DNA, 1002 bp, Homo sapiens
gcctcctatttaggccctacgtgaggccctatgtgtgatgtgtagagtttccagcaatggggcttggactggcccatcccagttctgactctcctggccacccagggcctacctctgctgatggccagtggtagatggcagtggttctttttctaaatctcaccctgtgtgctcccctgcccatggcattcagcagccaaagaccagagaagtgctcttctcctgcctgcaaatactgtgaagatcaccccatcacccagcagttcagttcctcatcctttgaccccagacatataaagcctgtgcattatgacacagcctggagccttttcccaagctataggctcctgtgactactaccagttcctttcctttatgtcatacttgactttgcagatgccattacggcctctccctcacttgagcttcacgtggttgtggaggtatgagagcatgagtgatgcactagtagtactggggccggctagcttgccctctgaaggtgcagccctggccgcctgtattacactagtgagcccgtgatcctggggttgccatctccatggactgagaggtcgtgatagccctgccttaaaacactggccttgactctcctgccttccgttgggtgaactcagtgcagatcatggagcaggtcacgatgctctcaagttggttccctctgagcgaggagctcttggtgagcaaccccgtgtgtggtccggttgcactttttagatacttcatgcagaagcccaaagccttagtcactggtctctgagcccatagccaccgtatttggaatcttttgggattacaatcagggtaccaatgattccttttactttacactatttgcataaatatgtgattattaatacatagctcaactcttaagggttttgttgacggaagtaactctaacttcttcgtggatatttcaaagccatgtttcttttttgtgtgcgttttgtacacttgtatgtataatacaagtggaat

SEQ ID NO: 125281 - DNA, 1083 bp, Homo sapiens
ggttttgagcccctttcatgaacgcttatcttttcccccttttacttttgaactccagaatttgtatttgattcttaaaaaaatggtaataataatttctatctcgttatcagtatcaatagtgatactgatatttattgatattctctacttaaaagacgttattcccatactttcctttagtaatttttgcatagttttcttagctctttgagcatatttaaaataggtgatttagagactgttttctgctaagttcttcatatgtgggcttcctcagggacagattttattgattgctttctttttcctatgtatgggccatactttgttgtttctttgtctaatttttttttttttgctgttattgagaaatggatttttaaataacacaatggggtgactcaggaaatcagatgctcctttcttcccatggttgctattggtacgtgatatagttgttcttgtttaatgacttttctgaactaattctgtaaagtttgtattctttattgtgtctgaccagtgaaatctgtacttggtgaacttagtggccaagtaattattagatggcgatttccttaaactcctgggatcagtaaacacctgtttttgtcgaggggcttcatctacctgttggagcataccttcattgcttggcctaacagttaaaaactgccttagcctttatttcctgctgatgttgagtcaaagtcagccagaggtgagagcttaaggccttcttaggtttttcctgagtgtgcagtgaagctctgtacattcatgtgtctttctagattcctgggaaaatgtcaaagcttttcaaagcccccacggacattttatttcccacctttgcctttggtttgcctcagttgttatctgccacctcaggaggctgcaaagttaaaacacttgccgtattttcaacagacactcctgggttgggaggaaggcttttctgagtttagccagaaacagtcagtcagtcttgcaaatgaggtcttacagggaaccatcagacaggtcaaatgatgacagttctttgagaatgaagctttgaaagagctctaagagcactgt

SEQ ID NO: 125282 - DNA, 1044 bp, Homo sapiens
gcagctgactccctctctctctctcttcagtgtacccacagaatagagacaaggaactttgagttaatgacagatgtttttgtgattgctcatgtcagacctgggtgattataaacctggcatttcattgaatcacagaattggaatgcttttgaaaattaaactccagagatttttagtttaacctctcattttgcagatgagaaaactctcatggtgggttgatggtagatcatagaccagaaccaaggtcccgtcacctccaccctgttttatggccttattgcaaatgaagtcatgattggatgttattgagtgacaagtgaatctgtttcccttgagtcttcttcctctcatagattgtgagtggtcctgcaggctggtgcagtcactgttgtgacctgccatctttgtcctcaccttgggtaccttttggaacaccaccttagccactaggtgtgtcatttatggctctaactgatccccaggcttagattcgtagtgaggccttgcctgtgagcttgatgtaagtgctggaatttgtgttaaaagctccataacgtgttcttagaagttgcttaggaaaaaatgcaggaaaacgttttattataggaaacttccataacagaaaagactaatagactgcattatttttgtatttacataatttttgagtgcataacacatttatatgttcaaaagcaaaaacttgtataacaacacaaaaatccctgtcctgcctctgtgtcttttctgtcttgtcctgacccctccccagccagccctaacctaagtcatcacataactggttttggggatatttcaacaaatatttttatgcatgtataatcaagtatgaacatgtattgctgtgtccccacctttagcacagatggtgcattccactttttaagatgatcttactgcccctgcccagtgtcattttggccgcaccaaagtgactcccatctctttttacttccatgtccccaagtgcctgaggggtgcccagtaaattctaggtagactttgctttccctggtc

SEQ ID NO: 125283 - DNA, 1039 bp, Homo sapiens
tcacaggactatactgacctggaggtcagggtgccagtacccaagcacgtggtgaagggaaagcaggtaatggccttggcgggtaggggtgggcggcttcacccaagccagtcaaagctgttgcagggaagacccaccagcatccttgagggagtgttgagatcggctttaggatgtgaggtgtgttccttctcctgccctcggaatgagctgagcacaccatccttgctccccttattctgtttgtgaggttctcccagctcttctgcagaaacctccctttggggatggtgaaccctgttcacactgcttcctgagagagaagcccacacatctgatgtcttcacctcttttataaatacagccatagactctcctggggttcctattgtagatggccagcttctcagttttcaagggaatactcaaacattattaccttggtgaattctcttttttcctaaagattaaatctgccttcagtttccctaagaaaagtccagtctactaaacgcacagtgatagctaacatacattcacatagcatctgtcatgtgagtttcctgggctttgccagcccagggtctaataaactcaaattagacaaaatgacacagtgggtagcacctccccgtgtatggtgatgagccatgcatcacagagatgaaaggtttatgatttaattctccacaacctttaatcacaggagagagctctaagactctgcagttctctcagggcaacaacatggctgcacaggagggatggagggagggacaggcccacctcatcccagcgtccccacttgcttcccttgctatttttttttttttttttttttgagacggagtctcgctctgtcgcccaggctggagtgcagtggcgggatctcagctcactgcaagctccgcctcccgggttcacgccattctcctgcctcagcctcccaagtagctgggactacaggcgcccgccactacgcccggctaattttttgtatttttagtagagacggggtttcactgttttagccaggatg

SEQ ID NO: 125284 - DNA, 1026 bp, Homo sapiens
gggaatctgcaggttccatgcaagaggagccaggccagggctactgaggacacggcaggaggatggggttaggcaggttctgtgtgatcagagccctttccaaaagcatacagctttactgcagcgtgtagtggcaagggtgtcagatgtcccccctcactcgaaggcagagactgacagccttttgccctggaggaggcagaacccatgtgggcatcactggtggtataggccaagtgactgcactgttgctggcggcagcgtccccaaggatatcccccggcattatactcattctcctttcttgagagagccgtttctttttcccaacttttgaggagtcttcatgtttactccctgatctctgccaagtgctggggccatgttggtcttttgtgtgtgtgtgtgtgtgtgtgtgtgtgtgtgtgagtgtgtgtgtgtgtgggtattttatttatatattttcacaattttgacttttttcaaatggtaatgtatgtacaaaagtgtcaatgaagagaagtctccagtttccagccataaaggtagctgctgctaccctattgttcttttggagatattctctgcatgtttaagcatatttatgtcagatatgagtcttaaagctgctgtcagtgctcacctagaaggatcctgtggaaacttggggtctgggtgagtccccctctctgtgtctgactccttcgtaccctgctccaagggtcaggctagtgctgctgccgtggccgtgggaccgcacctgggtacaggggctgcagggtgcatcactgtctcctgttagcattttttaaagagaaccatttttctcttggctataaaaatgtctacatattctagggagtttggataatacctaggtacaaagaagaaagattcctgttactctactatcagagataaccacaaaaatttaatgtgcttcctttcagtctttttcatatatatgtgcacacttgtgtgtatattatatatttcttcttagaaattaaagtcataccatactta

SEQ ID NO: 125285 - DNA, 1076 bp, Homo sapiens
ggacctggttggccagcctggggcctaggttttggggcatccctgccagccatccagccaccctcagagcaggcgtgcctggaggatcttggcccatttatatgcagaagaggatcaaattggctaacaccaaggctttataaatagtaggactgtttctccagcctgtcttcattctgttcacagctaaaatttcctggcagcttgtaactaatgagaacggaaaagtactgtttgcagagatttcagctagctgacttgaatgctcccatgatgctttgtcactgattgttgtacttactgctctctggggtggccattcccttccaagttgagctgggtctcaggtaatgaaaacagcaactctttgaccaagaccctaagatggtcacaaggaaagcccattttgtcctcatgagagtatgactacacacaggctctctggctgagaactgtgacacccagaggtcacaggcttggctaaggatgtctataggacttgaatagtccagcctcatgtgtcaattggggataatgtttggactggcatagacccataggtaagtgtgcagtaatgtcagctacagctaataggttgtcttacctgagctctgcactacttctgcaatggaagtgttgtttccctgactttactgatgagcaaagcggaggcttagagacacaaggttgtatcaccaactagtggctgggcagggatttttgactccagagtctgtgtccttaagtactggtttcggttctcctttatctggaattcttgaaagatgtaccttgcattaatcaaatcagacacgtaaaacctctttgccttggtttttcactttctcattagagaactcattgcttcatagagctttacatcagctgaaagttgtcgtaacggatttccatgcagtgtgtgtgactgtttgtgttgtgttcatttctgtctagatacaccttccactgtgcacacctgtgtgcacacacacaacccacccctcctcccctccaaaaacaaaacaaacaggaaaaagaccaaaaacagtcattgcggatgtggagcaacctgcaga

SEQ ID NO: 125286 - DNA, 2475 bp, Homo sapiens
cttaaacgtgggtgttctcaagattatatctataatcagccctttcttctttctgcagttttctcccttggagagctcatccattcccagagcctgaagccatacatctgtgattcactctgacctctgttccatgctctctaccactccctgtgtttggtcctagtttaatttggagtttagttgtcctaatgttctgtagatctaccagcttcctgacctcctttctctaggaagagttctaccattttcctcattgcccaagctcagggcaccttcttcccttcttgcttgtccaacatgctctaaatcatgctatcactgtgatttcccttgatattctgaacaaaatgagcacatccttaggaagcaagacctatgaagtagtttttttttctctctctctctttctgtattcttttggagtgggagtgggagagtggaggcggcaggtggtccatgtccaacttcctgcctgagctggagcaggggtctggaggtaggttcttgtggctactgatgcagaacagcgactcaggaaggtgtcactcagcttagactaaatcattctttggagacagttcccacatctaagtggagttttatttcaccctgatgttaacattaactgtggctctgggtgatgatcaggaaagctgaagaagcttctgtcagtgccagcaacattgagaagtataccatcatcatttgtgaattaagtgtaagacagaattacatcacagttactatctctccggcgcctcgggcaggtgttctgggggctctgtggaaagcctctagttgggtcagtagtcactctccacatctcctctgtggtcctcaggagtgaccacagacagactgatgaaaaggctgccctggctcttagaggacttgccactgttcgtgttcactgtgtgctgcacagaccaggaattaatttcaccttctgcctcctagactgttgaaattgggacaggcaggcagccgtgcagcaaaggaaatgagagaagcctattaaggccaaggagagtggaggctgaaggcacatgggagtagactacagtcatgccagtgagtatcaggaagctgagtactctgtggggaagcctatgttcagctaccaagtgtggtgggtgcaggcggcggcctgacaggtgcattacagcctgaagaactggggtgaggccagaatttggctcagccacttagggtatgtgactatagaccattcctttagcctctgggagcctccatttcccagagatgacaatttccaagggtgtggtcaattctgtgtgcaatcctgtgtggccagacagaggtgccccttgctgatggcctgtccctttttcttattcccttctaattgatgtcatatgtctcttgtcttcatgtgaacttgatatcacctaagatccatggctttgaggaaggctaatgcaaggatggtgtttcagttcatttgggctgctgtaacagaatacttgagagcaggtgtttatacaaaattttattttcctacagttctggaggctggaaaatccaagatcaaggctctggcaggttcagttgtcaagtgagggctctctgcttctaagatgggcctgatgctgtgtcctttggaggggtggaatgctgtgtcctcacgtggtgacagggacagaaggggaagagagctggatgctgcgtgaagcctgtttaataaatgccttaatctagtcataggggaggagccctcataacctaatcacttcttaataccgtcacattggccattaagtttccacacctgaattttggaggagacacattcaaaccatagtagatgggaaacatacggaaactttctacagaagaccttcgttacagtgtttgttggcctggggcaggctactcaggctcgtcacttaaagaattatttttattgtcttcctctggagacttttggttttgtcaggtgaacgttgtggctgtcaaacttgcacggaccatcccatgctgagatgggacttcaataagtgcgttaacagataggtatcaggtcttcttctcctaccaggcctgcccctagggaatgaaatggcctcatggcgaagcatctcttggttaaggctcttctaaggcaagaactaattgcttttccttggcagcccaagtaaatgttctctgtgagaaatgactttctgacatttgtttcattgtggctgtacttaccaaaaaacttttatataattcactacagagaattctcaaatgaatgtaatgaacattgccagaaactgggctggatttctgaggcattgttttacttacttattttttggattttcagtcaaatcatataatcatgtttgatggagtatctagttctgccagttaaaagggtaatagtatggggattgctaatttacacattagtcaaaaatactcctttgaaacactttttaagggaggcaataagaagtgactatt

SEQ ID NO: 125287 - DNA, 1013 bp, Homo sapiens
atcactgcactccagcctgggcgataaagcgagactctgtgtcaaaaaaaaaaaaaaaattagacattcttataggttcagtgtggtatttcactgtggtttgaatttgcagttccctaataagcaataatgttgccctttatattttctttgatgaagtgtcagtggaaatattttgtccatttaaaaaaattgggttgttttcttattattgaattttgagagctttctgcatattctggatctgagtactttatcagatatataatttgcaaatattttctcccagtctttggattgtcttcattttcttcacattgcattttgagtagcagaagttctttattttgatgaagtgcagtgtatcagtttttttttttttttttatggatcatgtttttggtgtcatatctaggaaatcttggcctaactcaaagtcacaaagattttctcatatgttttctattaaaagttatatagttttaggttttatatttaggtctgtgattcattttaagttatttttagtatatgatgcaagatacggcttgaagttccttttttgtgtgtgtatggatgtctggttacaccagcatcatttgttgaaagtactatactttcttcactaaacttttatatgtttctgcccctttccttctgcttctttgcatagtaagcctcctgtatccaataatcttctcctgctttgttacctgtcaagcacattattcccttttattttgccctgtgccttccttctttgtcttcagttccacccagtccttgtcttctactcttgagctgacatcagcagtttgatttctgcctttatgaatacagtggctttctcacaagctatggacaacttccttggggttagagtgagtggtttgtctttaggtttccctttattgatctcctctgatatttgatgccatcaactgtcccttttcgttgaaacacatgtgtttggcttctgtactttcctgattctcttcctccccaacgattag

SEQ ID NO: 125288 - DNA, 1028 bp, Homo sapiens
ctcaagcagtcctcttacctcagcctcccaagtagctgggggcgtgcgcccccatccccagctaacttttatatttttgtagaggtgggttttcgccatgttggctagactggttttgaacttctgagctcaagcgatcatcctgccttggcctcccaaagtgctgggattacaggtgtgagccactgtgtctggccatccctgggactctaactcctgttggcttgtccctgggacttgggatgggctgtctccctcctgggctgcccttgactctggtttgtatttagttttgaatcaaggcagccaccatcctcgtagcacagggaggacatttttgccctcatcagtggtactttctcttgactgtgcttttttttccttctctatagatgacttttctccacaaatggcctttgattttattcatgagatcattcccaacatagtgaatactttgttttgttttttctctcaggtgactctgtcaaccaccaaatactaactctggcttcctttcctctttttatccttcctctttgcccaccttcttttcaacttagtccattttgttttcttgtgtactaaactgcatgtatttaaagtacacagtttaataagttttgatgtatgtacacccctatgaaaccatcaccacaatcaagctaatgaacagtcatcacccccagaagtttcttcggaccccctcctgctgcccatccttccacctccattcccatccttaggcaaccacggctctgttttctgtcacgatagattatatttcctagaattgtataaatggaatcatatagtatgtacattaaaaatttatttagtttctgaaaattgcagtacaatacatataaaatttaccatcgtaaccattttcaagcgtgcagctatgtgacattaagtacgttcacattgtcatgcaaccatcatcgccattgagatcgaggacttttaaaagtctgttctcaaactgaaactctgtacccatgaaacagtgactccccttccccgtg

SEQ ID NO: 125289 - DNA, 2717 bp, Homo sapiens
atgggatgtgtgaaggtaatgcagggcaggggacagtgcccattgactgccccaaggacacctaacgctgcccacacactcccaaactcccaggaggcagggcctaccctccctttgagagctgctgatcaagtaggagttttctgttttcattcatatttgaaaagttggaataatctgctttatgatgtctttattccctgaaaagttaagctaataatattggtcagtgttttcctatttaggaacattttctgaacatgtggtcattaggggattttagagtataagttatgtatctgttaattttttctgggtaattatgtggttgagatgctagtggcacacattatggttacatttgttcagtaactgtaactcgagccctggaaattaggcttctataaaatttcatagcaattcatgaaatgttgtttgtaagcaaaatgtacccagctccttgactaaagttaccttaaatattcttaaagatagagaggtaatacgcatttctttttctctttctgtatgtgtgtatatatgagagagagagagagagtgtgtgtgtacatgtccctgataattcctatctcagagcagtggaagtcctctgagtttgataatatgctttgcatgtgctatatttgtggactgcctcagaacatctcttggggagactacctgggttcagggaccacctgcctatgcacctgaatcatgtgagccctgattttatttaccacggagccaggcacttgaacactgtcccatcccaactgtgtccatcccaactgtggacagcttttacacggtccacctccttgccttccaggaccccttcctcccttctccttggcttctgtggccctgcacccatgaaggccagcacaggcaccaccttctctaggaagcatttctggcatttgagaaaatgagctttcacacagtctgggttagggcccggatcccaaactttctgtttctttgtttcctccccctttcaaccattatggctgaggtgtggccattctgcatgtcacatggctggtgaaagactcctttctctctctctttggtgcttcttcaaaggctccttcactttcaatggtataggtcagattgtaccatgtgtctgcggctgactcaatcatggtagcttttctgtccttcccatagcatccctaacaggcaggaaatgatttagtctttatgagtgtgcctccccccacagggagacagccttttcctgttgcagatcacactgattttaagagaagacttctcttcatatgcagcttgcccttctatcctcccatcccatgtatatgtggcataccttctatgatgtttcaggctctgttctagcagtcagacatatagagtgggagatgctcaaggggctcacagtttagggggagcttggacaaactgttgcaatcccatgtgatgaatgcagaggaagggtccagacccattttctggaatgtcagaaatacttcctggagaaggtgatgcctgtgctggccttcatgggtgcagggccgaagaagccaggagaagggaggaagggattcctggaaggcaaggagatagaagaaagcatttgagttgtgtccagagaatccccttgggaggggtatagtcttgaaggagcgttttgagataagcagagttgaacccgtcgggtttttaggcctgttgtctaggactacctaggatatgtggtaggagaaaagaattatcacaccgttcaaatacatttttaaaaataatgaaagattttccaatggaggaaaactaaaatcctttaatgcagattttgcaaaaaagcgtttttgccaagtgttgactagtgtagagttaattcatttggagtaatgttttatagtatttgtgaaatttagtataggttagagttagtactggatccagggtttaaacttttgttttctctttctttccccccaaattaaagcatcctatccttttcatcttaatttcattcatatcttcatattacgtttttgagatagctgtttatttttttgagggggaaatagtgacataaataggtttagaacctcaggtggcttaaaaccccagatgtagtcagtggtaaattttttttttcttggttagtctagttttggtgttggtaagtattatatatgctggtgggtttttaaaaagggcacgtggtagagtctggcatactatttggagtcttgtggtagctgcccacttcctgctaatgcagtagagcatgttcataatggccttatatgctttccttcctagggcaggccgtacttagtcataccaggtaagaaatatgttttaaaattttagttaaacagttatgatgatagcttatagtttactttgcatttctttatttatagaaagattacattttctacacagtgatttactgttgttatttcctactttgttaactcattaactccacttactcattgatgggagtctggatattatccttctgtagttttacaaatcctcacattttcttattcactgcttttcttctatcagttgattcactgaatttagtgtggggattttaccacatcgatactgccttcagtgattttctttatgttagattttagaaatttctctctgctttaatgttgtaggctaaatataccattccattgtctactaaagggctcaagactgttctttaatattgt

SEQ ID NO: 125290 - DNA, 1338 bp, Homo sapiens
gccatcctctctcccttcctgactcaaattgtacaactgctcaaaggaagaaaaagaagccagaggttcctctgcatcagccagaggccaatcaccctgatccaggctgccaagttagaacccaagctcccagatcaagggacaagtcagaggtggagctctttgatcaaggggcaggtcagagatcaaggtccccattgaggcccggcagggacgaggcaaaagactggggcaggctggcaatcttaaaccccatttgccccaagcccctaaaaaaaaaaagtattccataaatacttgctgaatccaagaaccaaacctagtacttagcttatactgaaagctttaattatactatctcatttaatccttacaacagccctttaattgttatcaccctattgtatataagaaaaaaactaagacctcagtaaaaaaaaaaaaaagaaaagaaaaggctctcttcctcggcgctgcctacggaggtggcagccatctcctcctcggcatcatggccgccctcagaccccttgtgaagcccaagatcgtcaaaaagagaaccaagaagttcatccagcaccagtcagaccaatatgtcaaaattaagcgtaactggcggaaacccagaggcactgacaacagggttcgtagaagattcaagggccagatcttgatgcccaacattggttatgggagcaacaaaaaaacaaagcacatgctgcccagtggcttccggaagttcctggtccacaacatcaaggagctggaagtgctgctgatgtgcaacaaatcttactgtgccgagatcgctcacaatgtttcctccaagaaccgcaaagccatcgtggaaacagctgcccaactggccatcagagtcaccaaccccaatgccaggctgcgcagcgaagaaaatgagtagacagctcgtgtgcacgttttctgtttaaataaatgtaaaaactgcaaaaaaaaaaaaaaaaaaaaagaaaagaaaactaaggcccagggagacgaaagaatttgtttgttcaatgccagacagcttatcagtgtcagagctagcaactgaatgcccggtctctagactccaagattcatactcttattccataacataatttttttaaaagggggaaaaagactagaatcaggaagtaaaaagataaatgtaacagtttcagagattaaaggagcaaaccacaaggcaagagacaggtatcctccttgctcatccactgggagagtctagaagcctgacaccacagcaccaactaacacagcaggcccagctcttggcttgtaatctcaatctcttatcaaaacccaaggacttcttgg

SEQ ID NO: 125291 - DNA, 1259 bp, Homo sapiens
agttggtgctgtggtgtcaggcttctagactctcccagtggatgagcaaggaggatacctgtctcttgccttgtggtttgctcctttaatctctgaaactgttacatttatctttttacttcctgattctagtctttttcccccttttaaaaaaattatgttatggaataagagtatgaatcttggagtctagagaccgggcattcagttgctagctctgacactgataagctgtctggcattgaacaaacaaattctttcgtctccctgggccttagttttcttttctttttttttttttttttttttgcagtttttacatttatttaaacagaaaacgtgcacacgagctgtctactcattttcttcgctgcgcagcctggcattggggttggtgactctgatggccagttgggcagctgtttccacgatggctttgcggttcttggaggaaacattgtgagcgatctcggcacagtaagatttgttgcacatcagcagcacttccagctccttgatgttgtggaccaggaacttccggaagccactgggcagcatgtgctttgtttttttgttgctcccataaccaatgttgggcatcaagatctggcccttgaatcttctacgaaccctgttgtcagtgcctctgggtttccgccagttacgcttaattttgacatattggtctgactggtgctggatgaacttcttggttctctttttgacgatcttgggcttcacaaggggtctgagggcggccatgatgccgaggaggagatggctgccacctccgtaggcagcgccgaggaagagagccttttcttttcttttttttttttttactgaggtcttagtttttttcttatatacaatagggtgataacaattaaagggctgttgtaaggattaaatgagatagtataattaaagctttcagtataagctaagtactaggtttggttcttggattcagcaagtatttatggaatactttttttttttaggggcttggggcaaatggggtttaagattgccagcctgccccagtcttttgcctcgtccctgccgggcctcaatggggaccttgatctctgacctgccccttgatcaaagagctccacctctgacttgtcccttgatctgggagcttgggttctaacttggcagcctggatcagggtgattggcctctggctgatgcagaggaacctctggcttctttttcttcctttgagcagttgtacaatttgagtcaggaag

SEQ ID NO: 125292 - DNA, 2645 bp, Homo sapiens
aaatacaaaagacagtagacagaagaacatgactcctcatgtgctcattgcccagttccaacagcagcctgcttttctccctcctggtttattttgaaacaaattctgccttgtatcatttcatctgtaaatattttcagccactgtttaaacttccagttttcttatagtgtcctaattaaaagaaagttttgtttgaatcaggctactaataaggctccaaacaccaatgcctcatagtcaaccctccatttttctctcttttttttccctcaaaatttatttggtaaagtaaatcaagttgtttgtttgtatttcccactagctggattttgctgattattacccacatgtggtttagcatgtcctttgtcctatttcctataagttggagttggatttagggtaacatttttgaaagttaggagagtatgtaatagaagcaggttcttcctaaagatgactgttgttcaatatcatcttttgcaaaattttaatattttatatgtatgtatatattttccctactatatatagtacacatgcacagacaaaagcacatcagtgaatgttgcctttgtcatatccctggaatgtgctgtgaacccttgcactagataagcagctgacactgactgaatacttcctgttgccaggtagcttctccttagtgtacacataggtttttcactgtcctcacaactctttgaggccgttctgttgccttcccattttgtagtttaggaaactgacccaggctcatgttgttgagcagtggaacctagtttgcctttgggtggtttgccctgagattctccgctacgttaaaatgctgatgttcatattgtttggtccataaaacataaaataaaataaaatgcttgggtccttgctctagagatctgatttaattggtctgagtgtggcctcttctgtgtcatgtctggattttcagaaactttccaggtgactctgatgtgtggccaagatgtttactaactgccatgtagtattctgctgtgtagatcttattatttaatgagtccccaaggggtgtgtacttaagttgtttcccgtgtgccagcatcacaaatgatgttgcagtgaatatgcgtttaagtgtctcttggaacatgtgtatgaatatcagctaaatgaattcccagaacaggaattactgggtcaaagggtatggcgtttgtaattttgatggatgttgctaaattggcctcagggagtttgtgtctgttctctcactgctaggttgctaggttgtctcagagtacccgaccccatcctaggtgttagccagagtccctaactcctttctgggctactgttaccttttcttctttggttttctttgaaatgtcgttcacttttgaaatatcttggatttaactttgtatatgtttctgtatttttttccattctttgtatctacaaatactaaaccatttgttcattttgtttgttagcacaacgctattttgtttcatagctttataatacattttagcacttggtagaactagtgtttaatctttttacccccagacttttctcaaatattcccgtaaattaatttttgtgtatgaaaattctgttgaaatattcattgagaatacattaaatttatgttttggattagggagaattgacatctttacattattgagtcttttggtctaagaaaaggttatgtcttatttactcaagtcttgctttatgttcttttgtagaattttaatctttttattcagtaagtcctatacaccaatatcgaattctcttactggtttctaatagtttctcagttgattttcttggattttctaggagtgcagactatttcttatttatagtagtattttagtaacaactatatttagtaatacatcatttatgtatttgtcacatttagaattctaaatgtaattgtatttttttcctcctcctcaaaatttgttgctgagcaactggaaggatggaactggcagccactaaagcactggaggggaagtttctcagggttgattggggttggtcacggcttccatcaatctgagaagctgaccagtggttgaggtggcattactaattaggcaatagacacacgagtctggagttctgagaagagtagggactgggatgggcatttggaaaacattagcatttagatgcatttaaccatagactgggtaagatcaccaaggcagtgagggtggatggaggagacaaacctgagagcattccaggagcccttgtgaccggtgcagtaacccctcgattagacctgttgcttcatctctggtttgttcatggagtccggatgagcacctaaaatcctgtgtcattttgtgagtctttgtcaccccttgcttctaagaggtatatctaaggtctgtgtgtcacttctactctgtagtggcctcagtgtgtccctgagtaggtgattctgtgttctctatcctatgagtggtggctgtaaacacttctatgtgtttacacactcctatgtgtttacaaaaaacctctatgtgcctttcctgtgcaaactgtcctttgtgtgtcttttcttgtggccactcatgcttgccctgctcattctgtcagcagagaagtcaggaggaggggagtgggac

SEQ ID NO: 125293 - DNA, 2109 bp, Homo sapiens
tcccaataactctctggccctaccttctaaatgtatgattttaagcaaagcacttgaccattgtacatctcaatttcttcacctgtaaaaaggaagcagatcactggttctcaatttttggaaatacacatttttccaggggaaaaactccacagatgattctaacactcctcttcctcctccctgaccacatgctccctgaacccatccaactctgaaaacgttaagataccaggttattttctgatataacttcaatatccagcaaactcaacactgctttctaaaaatgaagcatataaccttcactgcaaaataaaaataaactgcaaaataaaaaataaaaatgcaatgtttcttgtgagaattttttaaaagtcctcctaacaacttaaatcaggttttcctgacttgtgatttaagtcaaatcgcttggaggcttcttatgcctgagctttcttaaagaaggtgcagtttcagggtgaatcactggaaaggtgaaatagcagctatgacacaagatgacactgagccaggtggcctaaggctcaatccccaggtggggtccacagatagctgaatctgaggggaaacagacagacatccctcaacccctggctttctattcattattctctctcagtgcatactatgcagcatatgccctcatccaaggacaagagccacttcaggtagacaacactcaacagtgtacatcacaaattcatttctttttttttttttttttgagacgaagtctcgctctgtcactccagctggagtgcagtggcatgatctcagctcactgcaacccccgcctcctaggttcaagcaattcttctgcctcagcttcccgagtagctgggactacaggcatgcaccaccacactcagctaatttttgtatttttagtagagacaggctgtcaccatactggccaggctggtctacatcacaaattcaaaatcagcaaaaggcatgcaggaaatgctaaggatactctgttcagcataaaagaagataaagtgtaataaaattttataaatatacatacatgtatttatgtatatgtttacatgcataagaaaaaaacaggctggatacagacactcatgcctgtaattccagcactttgagaggctgaggcaggaggatctcttaagcccaggagtttgagaccagcctgggcaacacagggagtctcgtctctacaaaaaattttttaaaaattagccaggcatggtggtacacatccgtgatctcagctactcaggaggctgaggtaggaagacagcttgagcccaggaagtcgaggttgcactgagctacaattgcaccgtgctccactatattccagcctgggcaacagagtaagactatgtctcaaaaaagaaaagggaagaggaaaagaaagaaggaaagaaaagaaaagccatagaaaatatcccaaaaagttaataggaagtgaagggattttctttatatactcatctgtattttccaaatattgtacattgagtataatcagaaagaaaaatgaaaagctttttcttttttaagagaaataatagtaacgataatagctagtatctacttgagtgcacactctgtcaggaatcatgctaagtaggtctcattcaatcctcaccacagtctacggggttgggtatatggagagaaggggattctgattaagcccccgtgactctacaaaggggtctcctgcaatgggcacctgaaaaagcctcgactagtaaaggaagaagctgtttaaagacgaaacaaggaacccaaatttctcaggcagtgtgagcctacacacggaaagaagtctcaggcctgaagcacaggcacctttctattctcctgacagcccacccgagggacatcaagagccacagatgtcatgataggtgtgtgagtgctatagaaggaatgtttgtgtccctccaaaattcatgttaaagacctaacctccaaagtaatgttatttggaggtggggcctttgggagacgattaggtcataagggcagatccctcgtgaatatgagtagtggccttataaaacaggcctaagggagttcatttgcccctttcaccatgtgaca

SEQ ID NO: 125294 - DNA, 1055 bp, Homo sapiens
cagacatttattgctgacagcctctataggaggctagaagtccaagatcaaggtgccagcaggttcagtggtgagggcccacttcctggttcatagacctctgtcttctcatcgagctgtcacatggtgaaaggggcaaatgaactcccttaggcctgttttataaggccactactcatattcacgagggatctgcccttatgacctaatcgtctcccaaaggccccacctccaaataacattactttggaggttaggtctttaacatgaattttggagggacacaaacattccttctatagcactcacacacctatcatgacatctgtggctcttgatgtccctcgggtgggctgtcaggagaatagaaaggtgcctgtgcttcaggcctgagacttctttccgtgtgtaggctcacactgcctgagaaatttgggttccttgtttcgtctttaaacagcttcttcctttactagtcgaggctttttcaggtgcccattgcaggagacccctttgtagagtcacgggggcttaatcagaatccccttctctccatatacccaaccccgtagactgtggtgaggattgaatgagacctacttagcatgattcctgacagagtgtgcactcaagtagatactagctattatcgttactattatttctcttaaaaaagaaaaagcttttcatttttctttctgattatactcaatgtacaatatttggaaaatacagatgagtatataaagaaaatcccttcacttcctattaactttttgggatattttctatggcttttcttttctttccttctttcttttcctcttcccttttcttttttgagacatagtcttactctgttgcccaggctggaatatagtggagcacggtgcaattgtagctcagtgcaacctcgacttcctgggctcaagctgtcttcctacctcagcctcctgagtagctgagatcacggatgtgtaccaccatgcctggctaatttttaaaaaattttttgtagagacgagactccctgtgttgcccaggctggtctcaaa

SEQ ID NO: 125295 - DNA, 1059 bp, Homo sapiens
aaaaattaaccaggtgtggtggtgcgtgcctgtaatctcagctacacaggaggctgaggcagcagaattgcatgaacccgggaggtggaggttgcagtgagttgagattgtgccactgcactccagcctgggcgacagagcagagcgagactccatctaaaaaaaaaaaaaaaaaaaaaaaaagaattgttcatagtaaagactttgtaaaaagtgaaaaagtgccatttgagcctcagtgtttatgtaatactagactgggtgaccagtgcctgcagacatgattagcactgtggaagagaggggcgcaaagtctgcagcatcttatgacgtagtcactaatcaggcatttctcaagagctgcctgttagggtttgcctcttggatgacctcacggtagggtttggtgttggtttcctgggcatgggccgtcagtgtcaactttcatagcacctgcagttcaggctcttgacctgcaggtgttgctgtagacagtgggatggtgactttgcctttgcttgtgctgggatgctgacaaaaatctctgaaaggctgtgtcagtcctgggcttttccttttaaaaatcacgagcagaattctttaacagagaagaaggaaaatatggtagcactaagaatgtcagttactgcctagaaactgttgtctttgtcctttgtgcttggactggttatctttttgtcctttggatgaggaacagagtgctccaacactgttggtgtgcattgggcagtgacagggccctgggtccaactaggccattcctcctgccctgggcagggaagcagagtagtgacagtgtacaaagagggtgtcatggaacaatctaacatattaaccccttctaggacaagcccgttagaacataatacctgagaaaactgttcagtactttctcttgctttgggtagtgtggcctttgtgcgcagttacagggacctcggtgcttcttgggaagggaatggcatcatttggaagataaatttcaggtttcctaatagtgtccttggcagatacttcatcatcatcatcaggctgctc

SEQ ID NO: 125296 - DNA, 1052 bp, Homo sapiens
aatcacagagtggtggaattgtgagtgttcttcatttttatctttgtcccttactatattttctaatttttctgtaatgaccatttattttgttttattaatttttttgtattccttttatgatctctaaaaaatgaaaggagggtattggttttgatttctgagtaatagactagaatagctactttgttgttttgtagagaccctattttaaaattcttgaaccagtgaattttgttctgggttagaattagagttagttttgtgagttctaccttaaaaataagtatagagtgaagacttggatatgtttcaggaaagctaacctttctacttggtagctctttgttcagaatagactggtaccgcaagaatcctaatcaaacctttccaaggactggaacattctcagcttcagttacttgttttccttgaacaaaacaggaagttgtggcaccgatctctagttatacctgaaatgtagtgttttagcagatttgaaaatagaatgtgaaagaccatccttttccttgttctacctttagctgcaccccaagtcctcccaccagtgttcaggatggtttatcctataaattatagatctgcagttcttttaattgagtaatttaaggtagttattctgtagaagaccacacagaagcaccatcttttgtgagcactctgtctaaaatctgagaatctaagtcttagattgctgatatctgatgactcttacttgacatgtttttcggttctaaccagtattaggcaaaaactccctttttgtatactacagtaaagtcacatcacatgcttatttaatttaaataaattcagtgtaagtgctgggaaagaaagaaacaagattaaaaataatgtatttatattttgtatatatgtattttgaattttatttttttagagacaggatcttgctgtgtttttcaggctgaactcgaacttctgggctcaagtactcctcctgcctctatatatgcatttttgttgtaaggtgttcattactgtatacagacaattgttttgtgttttag

SEQ ID NO: 125297 - DNA, 1047 bp, Homo sapiens
atagactacataaatttattgctcacagttctggatactggaagtctaaggtcaaggtactggcagattcagtgtctggtgagggcccacattctgattcgtagttaccttgctgtgtcctcaaatggtggaagaggtgagagaactctctcaaatcttttatgagggcactaattccagtcatgaaggcagagccctgatcacctcccaaagtactcatcccaatatcttgggattaagatttaccgtaggaattttgggacacaaacattcagtctatagcattgttcacttcagttctatttattccaacattacttatattagcaaaattttggaagaatgctgaatttctgtagtaagggaatggagaaatacatttataaaatgcttttaaagactactgacatggttattgtgatggtcagtttcatttgtcagtttggctaagttacagtcctggttattcagtcaaacactcatcttggcatggctgtcaaggtattttgtggatgtgatgcaagttaataattggttgactttaagtaagggtgattgtcctaggtgatctgagtgggcctgatctatcagctgaaagcctgaagagcgcagcagagctcccctgaagtagaagaaatttctccgatggacagcagctgcactcagtttctggagagttccacattggcctgctatgtggatttcagactggcctagccagcccccacaatcatgtaagccaatttcttgcagtaactctcttaataaatacacttatcccttggtatctgcaggggattggttcctggtccctcgtggataccaaaattcatggatgtctaggtctcttatataaaacagtataatatttgtgtataacctatgcacattctcccatagactttaaattatgtctagattacttacaatccctaatacaatgtaaatgctatgtaaatagttgttacactgtattatttggggaataatgacaagaagtttgtacatgttcagcacagacaaaacaatccattttttttttttttc

SEQ ID NO: 125298 - DNA, 1029 bp, Homo sapiens
gactccttcctggggtctgcctctccacccccaccagatgtgggatgcttggtgtctctgctgaatataggcagagaagaatttggatgggagtgctgggctgcatcattgtggaacttcaaagcgttcccttaatattttggggagtacagtgttggtgtagagttaggcagctcatacgtttccttttaaaagtttgcatagcctggatacacagcttgaagaacctcagcaggaatgatgtatgtgaaaattgcattccattttataatacattagtatgttttaagacaaaaatcgtttagactgacaagccattcattataatcgataatgctgttttttttggagtccactttgagaagtgctcctttgtagaagtccttgaaactagaatcaggaaagctagctacatcctgttccttacataaattgttgagaaatcttgggagagtcacttcacctcttgtcagctgagaagattgattggaggttacagattagagttctcttccagccctatgttctgtgactctagaatgagtactgagaacatgtgatagttgggaggttggcagtggtagcacttcctggtggtgtgaatgggtaggtcagagaaggctggatgtactgagtgagcagaggcagctgcatggtgaggactatcaagtctgggggttctgtgttcgaagtctcaggtgttaggagagagagatcttgttgctttgcttttgtggagttaagatgaagatctggagtatcagcaggatgagcaactctgaaagcatggactcaaagcggtagagaccctaatgttagaatgaagtcagggcttcaggttatctgcagaagtaaaaatggttctggtgttgtttccagtttttaaccttttaggattttattgatttttttttttcccctctgcctacatcatcatctccccacactgtttggtgtgtgctgcgtagttttttacttcttttgccagcaggagctggggcaagttacgtaacctttccaagccttatt

SEQ ID NO: 125299 - DNA, 1050 bp, Homo sapiens
accattccatagtaggatgagaacacttttgtctagattgattgtagtttgcagaaagatgtggaggagaaaggagtatatactgagtaatatgtatagtatcagatgttttatattctggggtcgttatcttatttaacccttaatataacctgagaggttggtctttgtttcacagatgaactgacagagcactcattaacctggtaactcatttacctggtaacacctcttacaagacacttccataggttaggatttggtgaccagtctaatgaagtagtggagatggggagcagggatggaggaaggggagggatgggtcaaagatgatccaaggtttcaacttgggtgactggaatagtgataatgcgttaactgaactgtcacctgggtttaggggaaaaagttcagttttagacaggttgaacttgaagttgcaggtaggagtccctgcccataggctattggaattactggactagatcttttgggagctagagcaactggagtggtccgagggagagagaagagccaaaggtgaagaacaggccttggggaataatcttggtggagagcaataagtttcacagaaaccaaggggacaacagtctccagcagatgcttaagagaggtgtcatgttttctggaagtggttctcaaccatcagcatcgcttaaggaacttttttctttctttttttttttttttttttcctggagatggagtctcactctgtcgcccaggctggagtgcagtggcatgatctcagctcactgcaacctccgcctcctgggttcaagcaattctcctgcctcagcctctcgagtagctgggactgcaggtgtgcgccaccacgcccggctgatttttgtatttttagtagagatggggtttcatcatgttggcgagactggtctcaaactcctgaccttgtgttctgcctgcctcggcctcctaaagtgctaggattacaggtgtgagccactgcgcctggccaaggaacttttaaaagcacatattcctggatattttggttgggtagatcag

SEQ ID NO: 125300 - DNA, 1011 bp, Homo sapiens
agcaggcaggaccctccctctgtgtcacctccatgactcagggctcagacaggaagccctcatcctcgtcctccacgggtctcatgtttgtcaaggccaggggtatcaggcgtagtaggcaggggcccatgcctgctcccatctgggagaccctgcttcaggcccctctcatggccccttttgttccccacagctcactgtacaacttgttggttcaaggttagaaaatgcagttttgtgttgagggggaccatcacagaagacaaagggtccaggatgaaggctacccatcagcttgcagggctgggacgaatgtgagaagcaactgatgcttgtacagtagagagtaagcatgtagggccagtccccagaccttgcctcccctcagccttgacatgtgatctccatttctggtggctacccctgctagtggtctggcttcaccatcttagccctgcccaggctaagaccctcttccatcagaacctgcagctgggatgctgggagcaacagtcagggcagagctgcccatcctcccattcagggagccctcaggaagtacttgggaccccccgaccctttatagattcagcctgcctcatcccctccatggaccaacacgcccttctcctcagcagtgggctgggggaccaggctcctgaactgcttgtggctgttccagcagtggggagatggagggtcacacagtcctgagtctatggctttgacagcaacgggtcctgactgcagctgtattcgtgaagcgaagtacctaatacaatcaccgaaatgtacaaattggacccctataggttcaaggattcttggtgtaggaggtatggcccccgccccgggaaccaggacctcagcttttagaagcaaaatgcatgaatgcagtgatggttaggccaagtgccaagggagacagccaacccctgctatcatggccagaggagggagagaccactcaggcctgggtggtggtagaaatcctcactgccaaggagattg

SEQ ID NO: 125301 - DNA, 1704 bp, Homo sapiens
agcaggtgtggcccggggcatagacttccaccatgtgtctgctgtgctcaactttgatcttcccccaacccctgaggcctacatccatcgagctggcaggtagtagtgtgacggcccaggcatctgcatggtaggcacactgagggacttggggtgtgctggacagagcctgcgggttggagatgcaagctgcactgtcttcccttgcaggacagcacgcgctaacaacccaggcatagtcttaacctttgtgcttcccacggagcagttccacttaggcaagattgaggagcttctcagtggaggtaagagcctggctcttgtggtcctgggccagggtcaggcttcttccacaatgctttaaaactccatgataatgatgacagaggtcacaacatagtgtgacaggccacttccaccatccatccttgttctgccctgagtggcaggcactgtcccccttgagagataaacaaattgaggtaatttgtccaaagttgtgtttactgtctgcctcatgagcgttgagtgacctgacaggctgctgtgacagctcaggacagcacctgaccccagggtgctgggtggtcctggactgctctctgtggccgtcgtcatgggggtaccttgactcccaaggaataccatggggtactccttgggagaggagaagagagtgggtgacgggttcttgggcttggggccacacaggccacccccatccacacacggggacagatgggtcatcactgtaagaggcccaggtgcagctaacctgcatgttcggcatcccaggaaggcggtgggtcccctgctgctttcccccaagggggaggtgcaggaggcctccaatgaagaccctatcctaaggcctcagcctgtgggaccctcgctgctttcttctccacagagaacaggggccccattctgctcccctaccagttccggatggaggagatcgagggcttccgctatcgctgcagggtgagctgctgtggtggggaggggaatgagaggggaggggctgtggcccagggattgcaccgtcttgctgagcatccaggtgtgaagggaggatttggggcagcctcactgtcttgaccttcagtgtccacccccaggatgccatgcgctcagtgactaagcaggccattcgggaggcaagattgaaggagatcaaggaagagcttctgcattctgagaagcttaaggtgagtggatgggaggtgagaaggggatagatcttagacggctgccctttttggagactggctgagctccgagtggtgagaagcagagaactgggcagttttctggcctttggcacggaaggggaggaaatggacccagaatcatggaaggaagccagtctgttctgcttggtggtaaattggcacaaccttatggtggacactgtccagcagaattacgagctcatgtgtcctttcatccgaaattccacttctggaacttaatcctggtcacgcttgtgaatgtgcacagtcaagcatgtgcctgcattcatccatccatggcattatcatggaaccaaaagatggaaacagcctggggccaccatagggggcttgctaggtaaactcaggtgcattcagagccgaaggttacatgggaaggaatgaggttggttgcgtgtccatatggaacagtctgtaagatgatgcccagcaaaaaggggtacagggt

SEQ ID NO: 125302 - DNA, 1795 bp, Homo sapiens
tttcaggccatgctttgcctaaaatcctgagcaaggacctcccctaaggggcagctttgagcagcagagccaaaattctaaggccaaggttctcatcttaagtaaactttacctttcagaaggcctgttgctgtaggccttcccttctcaatgtagtcctttattgatgtgtttctctttgttctgtgcttggaagtattttatatatggtttatatggtatactctatataccacaacaataagggcattttggggttttaggttacaaaactggaggagagttagggtgccaggaatccttaaatgcatctctgccctgcactaaaatgttgatgctttggttggtgagtaagtggccatacatctctgtgttcttttcctttctgaccacaggcctgttttctcccccaggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtctgccacagccaacatcttggttgaaataagttgaagatagagatggaaaggggacccagttaatgttctgtttcttaagcacttagtaggggccaggttctagatgtgactgatactgacttctcccaactccaaaatacctatcatggccgggcaccatggcttatgcctgctgtaatctcagcactttgggaggccgaggtgggcggatcgcctgaggtcgggagttcaagaccagcctggccagcatggtgaaaccccgtctctactaaaaatacaaaaattagctggacatggtggcaggcacctgtaatcccagctactcaggaagctgagataggagaattgcttgagcccgggaggtggaggttgcagtgagccaagatcgtgccattgcactccagcctgggcaacaggagtgaaactctgtctcaaaaaaacaaaaccctataattatttccagctgaggaaactgaggcacaatgattaagtagggaaagagattaagaagaggaaaaaggaaagggtgatggttactgtgatactagggatggcagaggggccttgagcttgctctgctgagctgattctctgtccgctcttggctgcaggtgccacatcatctcacagttcaaccaaggcttctacgactgtgtcatagcaactgatgctgaagtcctgggggccccagtcaagggcaagcgtcggggccgagggcccaaaggggacaagtgagtccatgcctctttttccatccctccccagaaatgcctgtgtttttagctttttggaagactaaaaccagagtgcacagagcagggagccaaaccttccaggcctggctggtagtgtagcccagagagccccacaggttcttgctcagctgcctggatatagagaagggagtggatggtgcacactgcacatgcaccacgaagggcaaaactgccggggttgttggcatgcagagccctgcaggggagatggcccatcctgcattggtggtatggctgtgacttgcagggagcatatttctgaagggaaaaggaaccccccaactctccagtctctgtccagctgaaggcttgactagctcagagttggttttcagatcaccatgtagggcaatgagtt

SEQ ID NO: 125303 - DNA, 1078 bp, Homo sapiens
tgtgccacagagcaggccctgcctcactgtctgctggtcagttctgggttcacttaatggctttgtgaatgtaaataaggggcaggtcttggccctagaggattgagatgtttttctaaatcttagaactatttttggataaattatatattttccttcctagtagaagtgttactgcctgtaactagctcaaaataccaatgcagtttctgcattctgggttttgtttttccttttttttttttttttttttttttgagttttgctcttgtcgcccaggctggagtgcaatggcgtgatctcagctcactggcaacatctgcctcccgggttcaaatgattctcctgcctcagtctcctgagtagctgggattacaggtgcccgccaccacgctcagctaatttttgtatttttagtagagatggggttttaccatgttggccaggctggtcttagactcctgacctcagttgatccacctgcctcagcctctgcattcagtttattcacatatttttggtaactcccatggcagctcctaggatttcagcggtctgtgggccagaaagcaggcaccagggctgacctcaaggccgtatcagagggccaagcagagttcttttggatacctgcttttcatcccacagggccttagagtcagaggtaaggtagcaacagagctagaatggggcaatgcactcttaccctccttctcaacttttatttaagctgtgctaaatgttttcttcaagggaaccagatttagttctttacagaattttccagtgaaataaaacatgttgtaatagctgtgtttgagatgaaataagaggttgtgggtagaggggaggcacctaaaggaaaagaggaaaggtgcctgggctacctatgcagataacctggagtggacttcactgtggactcgtggtactaaggcttggcctggacaggcagtctagggggtatgggaatacacggtgtggttgttcaactatttgcaaaggtcaaccaaatagaccacatgttcgcaaagtatcatctgaggaaattaagtaccttcttagccctctcagtcat

SEQ ID NO: 125304 - DNA, 1025 bp, Homo sapiens
gggctttttgtatttagcacagaaaacacttgtgagcccgagctgagaacccaaaaggcacgcttcaggccatcgtagccaccaagcctggtcagattccgtccaccgtctccttggtgctccgagacccaaatcgctgactggggccgagggcgggcgtgactgcgcaggcgtgcctcccctgcgagatgccggaggtaagctgcggggtaaggggcgagaaattaagggcgaacgtcattgcgcatgcgccctctactctcgttgcgggggtaggcgggcgccgggctgtgtgagggggcggggcgcggcagtgttcggtacggatggagttgcaggagacggcgagtacatatcactgcgcaggcgtcctcttcccctaactctcagggtcgctagggtggcgcgcaggcgcagagcgatgcgcaaatgtgcgcaggcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggtcaggcgggctgagggtggggaggccctttgtacccagctcagccctcggcggcgctccctcctcccgagcccagccgggtcgctggctcccccagtacctagcctgagggtgccccgaggacgccaggccccctgcctagagctccgggccgcacgtcggagggggccgggcggagaggcggcccactagggccggtcgtgactatgtgtctgccccgcaggcaactatcgtacccagatgtgggataagcagaaggaggtcttcctgccctcgacccctggcctgggcatgcacgtggaagtgaaggaccccgacggcaaggtaaggctggcgttggcccacgcagccgttcttcagtggagctcccgtggggtgtaaagcactgcctggaggaggcctcaa

SEQ ID NO: 125305 - DNA, 1043 bp, Homo sapiens
cacaggcatcctgtgttagtaggtgcaagagtgtgtttcagtttcacacagtcacagctctgttgtgctctcaggcacatgaactggtggcactgagcaggtagcactcttgtgaatacatttataggccagggtctttctcctcaacaattagagttgaacatgttttgtttttgtttttgtttttctagtagcttttaaaaaaaaattatcctttctctagagcatcaggatctagtagccttgtctcctaaatactcatttttaaaacctttctttcttgtttttttttttttttttttgtacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataaggtaaggctcgcagggctgtgggtctgcctcatgttggtgtgttggcctgttcctgactggtcaccaggtaagtgtgtgcgtcctgaggagtcagcgggcagacaggcagctggagcgccataccaaccaccgtatctgtatcggacccagcatagccccagcagaagccatggtccctggattggcgtccagcagtagacactgtgcttaactctgcgaggatgtgaagaagcatgtgtgtgaccctccagcatctccgcaagggctgcttcaggatgaagccgctgaagaaagaagaaagaaagaaagtgtgtggaaaagagcaggacctcaggaagctcctccattctaactgtctggagaggatactttcatttgtaacatgccgtagtcacctcatgtaatttctgtatgaatggccttttagctcattatgttcgtatttttttcctgtttgtttctaacttctctgtattacatataagg

SEQ ID NO: 125306 - DNA, 1065 bp, Homo sapiens
cctacacctgcagattatatctagaataaaactgagccctgaggtttcagaatcaaggactattatgtgcccaggcctattcttttgccttccttttctcaaacataaccttttcttggaaccaaccaagttgttttcagtgatgttaggatttggagtcagtagctcctaaatgacagtgcctagtgtctgaaaggtaaagagcacctggctgagactgcatgtccttgtgaaggtttggtcctcagtgattcatgggtaaaaggtgcactctgtgagcagtgtggccacagtgctgtggacactgggcctgttgccatcatagctgctcctgctggaagcttttgaagatggtttttgtgggggcatggtggctttatgtctttatgcctgtttctgttgctgggagtctccagggggcacagtgtgggaatcacatgcatgctctgcccctccctgcttgtagaggggaggggacaggatggttaaaagtgggcgtgccctccagcaatcccggttgtcatccagcacggacttcatcactcctctgccatcccagacggcaaggtgggtcctctttaagttgaattgggcccagtatgtggtgtgtgcatgttttttgtttgtttgtttttttgttttgttttgtttttgagatggagtctcactctgtcgctcagactggagtgcagtggtgcaatctcagctcactgcaacctccacctccgaggctcaagcgattctcctgcctcagcctcctgagtagctgggattacaggcctgtgccaccacgcccggctaatttttgtatttttagtagagacggggtttcaccatgttagtcgggctggtcttgaactcctggcctcgtgatccgcctgccttggcctcccagagtgctgggattacaggcgtgagccacggcgcctggccatgtgcatgtttttcaagggagataatccataacttctgtccaaatttcaaagcatctgtcacccatgaaagtttaggatccatagccttagaggcatttcactttatttgtgctcttattttagatcacat

SEQ ID NO: 125307 - DNA, 1135 bp, Homo sapiens
tcaaacgtgggtgagaattaagctgtaaatgctaattttaatgtaattttactttttttttaccccttccctctttttttttcttctgtccttttgtgtgtgtccttccctctcatcgttggccactcatagatacgagggcaccatgtagcacagctggaccccctggggattttggatgctgatctggactcctccgtgcccgctgacattatctcatccacagacaaacttggtgagggtctgagagcagtcagctgcgttgcttgagctcctctcgctgtgccacgacctgtggtagccaggatgtccaggcaggagggaaaggctcttaagtttcctttcattctgatcacttgaaatttatcggtattgtagccttagtgtgttttgggcaagttatttttatcttactttttcagccagattgtcttaagtctcaaaatttgaaaataaaattttggacagaaaggtttgtggcacagggaaaaagcttgtccacctggggcaggtggatcagaagcacttcagagtatagctcttttggcttcaggttttcaaatgtcagtgcagcactgccttcagtgaggcatgtccatgaggccttgctcaggaactgctgacacagccatccttttctgaagcccagtgtggcctgcccttgactggaggccatgtcccttaggggacgaattctagagcaagttgtgcagttgggtctcctgatttgtaattgctggtgatcacactgaggaaactttggaaggcattcccacagcgtcaggaggtcagggcctttgggaggtgcatgtatggagcacactggggttttgtcacggttgccagaagatagtcccacctacaccccctcctcctcatgaagtgaggtgggtgttgtggctgggctctcacctgcagttgctttgcagagttagtctgctttatgtcactgtgctgctaacctgtactaaagaaatgatgatgtgactaatttttaaatggccagggtgttcacaatagacactgtgcatgctgatgaaattgatgatcacttacttgcctaatactcctcttgggatgggtacgaaattagcctcctcacaggcacttttggggaatggtacagacagtctct

SEQ ID NO: 125308 - DNA, 1858 bp, Homo sapiens
gctcttgggttgttttcagctagcaagcacttctttcctagtttgccttcttgaaatgggagatcaaggaatccttccattctttagaattcttcaaaatcttacggtttagagtagtctgccacctgaatctagtgctgagaaatatctgctctaaaaattaggctttttcattttcttttcctcaattttcatctcaaagtagtgacttcccaggaaagtgctgttatccgccacttcttgaagctaaggagatgaggagctctcaaatgacgctgcctgatggctttccatcgtcagggtgctaacctcccctccttctgattcaccttattccagctgttctatgaatcatttccatgtttaataaaattgaccccctgaccatgtaacccacccacttctcccttgatgtgtgtgtgtgtccctgtgatggtgtctgtgctacctgttactgtggtaatggtgtagggttttggtgtttgggtcttttttaaactaactctcacctgtctttttccttctgcgctcacccatgataccccactctgcctctcagatcttgcagttttcaaggaacgacttcgaatgctaacagtaggaggtatgaaaataatgagcttttcaccttttcagagttgaggacttcatttgaataggatgtgcaacttttcctagcatgcaatatggggaaagttgacgcaacttctgtcacgtgtttttaagtttgttaattgttctgaaatgtgtttttcccttcctttaattattaaccaataagtagagctacttatatggtatcgttttgtttctgttcatttgtgtttcaaagagcacttttcatcttcacgtgtgcttcatcgcttcactgtgagctgccatcttcagcataattcacctttagctgctgccatagccagctgggcacatgaagccatgttcagctctgcatggtggcttgtcctgtcctccacattctgtgctgaggctttgactggactctggattcttccagattctgcttcctgggcattttgggcaagatttccaaaatgttttatgtttgaaggccaactgaagtattaataaaaacttactgagaactcttagtgaccctcggttgggcaaaacacatttgaggaatccagagtcgaaatgctgggggatcatcagcctgttgtcatccaccctggtggccagtctcttctttacactctggcttctctaagcagttatcttttttatcatccttctaatatctgtgaaactctactttttaattacacttttaattttgagattattatagatccatatgcacttgtgacaaataacagttctgtgccctttggccagcttccccagtggtaacatcttgaaaagctatagtacaacatcacaccactacactaaattgataaagtaagactctagacatccatcaccacgaggattcctcctgttgcccttttatgaccatatctacttccctcccatcccagccactacttgtattccctggcaaccactattttgttctccatttctgaaattgtcatttcaggaatattataaatgtagaatcacagtatgtaacctttggggattggcatttttcaatcagcataattttcttagagattcatgcaggttgttggtgtgaatcaatagtttgttcctttttattgctgagtagtattccatggtgtggatgtactatgattgtttttaaccattcacctgttgaaggacctcttcattggaatggattgtttccattctttggctaataggatcttttgcagagcagaagtttttaatcttttttccccctcgtttcctacctcagcttctatgc

SEQ ID NO: 125309 - DNA, 1042 bp, Homo sapiens
ctgtgatggggttgggtgctagggcccattacagcctggtgagggtggggtcacagtgttttctctggtatttgcctgtagtagagcagtttttgtctaaaagttttttgtcttgataggctacctctttcctggtcttttggtagagagcagcttttgtcaggcttttgttatcaaatacacctcttaaagttttggggttgctggttcttctgctccaggtctgcaatatttgaagcaaaaaagaaattccagggaactccctggtgtgttttgccttgagacctccctagctggtgtgccttattctctccacctttcagagttgtcttatgattgttttgcatataatgtctaggatttttagttgtacttattgggggaatagggaagaatatgtgtactccgctttcacaaagcactcatatatagatctagtttctcaaatagctaaagaactaaaagtgtaccagcagttctgaggctcagcagtatagcccaagaactatgaactcaggatgatagaagtgaaagaccatcacatggtgaggtcaagggatatctgtaggcacctacttcacagggtccatgctgaaagactgcaaccaatacacagcgcttatctgggggcatacactggaccgatatagtttcacaatcaaaatatttcccaacaaaatgtgcactgttattctggtccccagtcagctgcacctggcctgagttttttagtcaggaaaaatttctcaaagatgattctgtttttcctccataaatactatagggcaattgcccaaaagccaggccataaatggcaagagccacgtgcttcacctaggcccaagtggttgctgtgccctcagtgttgacagactaacaggagggaatgggtgttcaggcttaactaagccactactaccatcaccaccctccaggttaaaaaaaaaaaaaaaaaaaagccagatttgctttgttttaataaaacaaacagggcttggaaaatgtagagtttgcttttaagacttaaaaaacaaaacaaaac

SEQ ID NO: 125310 - DNA, 1100 bp, Homo sapiens
tctggccctgggccatggggcagacattcccagggaagcagtgaccctgtctgtgttgatcgggcctgtgtgcagcctgttggccgaggtgagagggggtttggggtggtacaggcaaagctccatctgcacatgtgtgaagagacaccagacaagtagagtcagccttcagagcaacctccgcctcctgaattcaagtgattctcttgcctcagcctcctgagtagcagggattacagaggcacaccaccacggctggctaatttttatatttttagtagagatgaggtttcaccgtgttggccaggctggtctcgaactcctgacctcagctgatctgcccacctcggcctcccaaggtgctgggattacaggtgtgagcctccatgcctggccagaatcccctctttttggtcaggaagagtgacattgcccttcaaggtggcttggttccctgtccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacaggtacagccaagggcgcgcccaacctggtttctcaccatccctgtgggctgtgtaggaggcaccaggtaaaggcactgagagagcagctgtttcctccttgagtgccagttgtgagtctgggctcatctggtacctgagggtgtattgctttgcaggggattctcacattgcctgcctctggaggactgcaaagtcatggtcacctccaaagccacatgtagtttcagactggcatttggccttacagtgcatctttatgaaaattaaacccaagttcccttgttggggtctaacctggagggaaggctgcttcctgacattgaaggggaggccaagactgtgaaaatagggaaggtgtggggagggagaagggtaaggaagcctcaggcccatggcattgctgcatcttctatctttctgctgcccactgtggccttgattgcccagcacggagaggctcggttcccacattagctccagtttacagctat

SEQ ID NO: 125311 - DNA, 1093 bp, Homo sapiens
cctgacctcaagtgatctgcctgtcttggcctcccaaagtgctgggattataggcatgagccactgcgcctggcctggaccagttcttaagaaaaaatgtggtgggctgggcgtggtggctcatgcctgtaattgcagcactttgggagactgaggcaggtggatcatgaggtcaagagatcgagaccatcctggccaacatggtgaaaccccgtctactaaaaatacaaaaatttgctgggcgtggtggcacgcacttgtagtcccagctactcaggtggctgaggcaggagaatcgcttgaacccgggaggcggaagttgcagtgaggcaagatcgcgccattgcactccagcctggtgacagagcatgactccgtctcaaaaaaaaaaaaaaaaagtggtgaagggttaggggttcaaactccgagcagaatctctacccagcaaatgtgaggaagaaacttttgggagtgaaaagaataaaatcttagaaaggtgttatgcctattgagaaggagcaggcccagaggctgagatgttttgcatccacgaagtgtgggactatgggtgggcatgcacgggagttgtgccaggggtatggttgggcttgcgtggtggctgtcagaaagtgtgggggtacaggtgggcgtgtgcagtagtcatgccctgtgccagtcacgctgtgttgtgcccaaccctccaggaggaaatttccaagtatgataagatctgtgaggaagcttttgccagatctaaagatgagaagatcttgcacattaagcactggctggactctccctggcctggtgagtgaagaaacagtgccacaaataagctcctttgaggatctgatgtaacgaggcatcctcttcccagaaaaaattcatgctttccactttgtacccacaatgcacagttgtatgcaccatttcagcaaagccccctgcagaccctggacccagacccctgcattaatgttttctggggaacacagtgtgagctacattgtctctcaccctgcttctccccaaaatcacgtgtctgccattttgtggtccctggaaaagtagagcagatgtcatgcctcagttg

SEQ ID NO: 125312 - DNA, 2579 bp, Homo sapiens
tgagcgatgaaggctggccgggccttcgctccaacctgatcgttcctagctttggggccaggcagtctcacctacatggtacgcccctccgctcctacttacgtgcccaccagcacggcgatgtgggggccgtctgaggccgtcacctgctcgcggaggagctgttccgctcctgggctgaacgacgctgagcggccagcccccagctgccagttttgatggggacacccctttccaaactggacatactgaagctcaggcgtgaggatgccctgctcccctgaggtgccttgtcttccctagtgccaggtgtccttcaccgcggcacccccacccggtgccttgtttacccctccacctaccgtgtctctcctcccattccctggaccctctgccctgcagtgttctgcctctccttctccctagggtaccctctttccagtattacagaacatccatggtggtgtctttaatttgtgtcatcgcagatttcacagggacacacacggaacatgtgacttggtctgagaccgtggtgattacggataggatggacacagactcaccaccaagttctggcaagctagaaccagagggcatcccttgatgcttagtgtggaaacaggagaagtgaaggaatcttaacttccagaggtactgacctctagcccttgtcatgcccaggggatagttacaagctggaagtgtaaatgaagagaacaagcaggtgacagttgccggttgtagatttctgaaggacaggcctaagatgtttggggagcatcctgattattgggattgagctcccaagggctgatgacatgaaggtggtcatgtgtcctcagtcctaggatgctaccagatatccatcttacacattgtaaactgatgccaggttaaggttgtcccttcagctgttcactgaaatgtctcatgcctgggccattgcttattcctggactttttgatgaactctgcatcctgacttagccccacgcttagacattttagtactgtggccttacaggtagagggggcaggactttcagctacctgtatatgtgagtaccccactttttgctaccaaggaccccgctcctgcaacattccacagccatcatttcttcaataccctttgactccattgtcacctgggttggatcctgaccctgcaatcttggagacagtgagtcctgatgtgtgacctattgagaagcgttgcctgccacagggcccacttgctggtcctgctcctagctgactaggcaggcagagaggtggcatggaacaaggctcaggaggtcaaccaggagacttgggggtgcagctactctgggacatttggggaagagaggtctggggtagtgagttctgtaactctgtctagaggaagatgtgatctgacccccgagaaagccttgtggccctctagactgaccttgtccatctctcaaggggtcctagcttccagctggagttagtttacaaggaaagcgccaggcactaagacccttggtgggcatgggccttgcatgatctgggatccagattccaggctccaggcttgttcccaacccagactcaaagccaggagatgagaagaggatctgcacacacacaacgcagaacactatcctatcatcaggggcacagggtcaaggataccagacctggagactggaagtcttttcagagagactgtcctcagagaggagaccagaggcatgagttcgggtcggcaggaaatccccctgtgcagtgaagagtaagctcagagggaactggaaatctttgtggtctctgtccacagcagagaaccatcaggggtggaattccccaggctcatgtgacataggagcctgctgtgggctcctcccctccttgtacctgccctgtgctccttctccccagctcactgcatttcctagatctgaggttctcaaactacagttcctggaccagcagcagcagtagctgcaaacttgttagaaattctgggcttaggccccagcccatcctactgacttcaggtggggctgggcagcctgtcatcaccagctgcgagctggttttgatgtgctgcagttggggagctgctgccctaggtgacctaaaatgaggcagtgctgcacagagtgctgcctgcactttgaggcctttgaccacgggcgggggagggggcacatctgcttgcctgccagattccctctctgttcttgggacagcaaagtggccagccaacccaaccagctttctagtggggaaagattgtcacagcagttctgcggagacagaaggctggtggtagcagttgtattgtaattaaactttttattttgaaattattggctggacacagtggtgctcacctctaatcccagcactttgggaggccgaggtgggtggatcacttgaggtcaagagttcaagaccagcctggccaacatggcgaaacttcatctccactaaaaatacaaaaattagccaggcatggactatggtggtgtacacctgtagtccagttactcaggaggctgaggcaggagaatcgcttgaacctgggaggtggaggttgcagt

SEQ ID NO: 125313 - DNA, 1021 bp, Homo sapiens
aaaaaaaaaaaattaaagattcatgtgcattataagaaatgacacagagagatttattctgtcctttacccagtttgccccaatggtaacatcttggaaaactagtacaacattgcaccaggacactacactgatacagtaaagaggttacagcctgttgccttctattttttttttttgagatggagtttcactcttgctgcccaggctggagtgcaatggtgcgatcggctcactgcaacctccacctcctgggttcaaatgattctcctgcctcagcctcctgagtagctgggattacaggcgcccaccactacgcccggttagtttttgcccagctaattcttatgtttttagtagagttggggtttcaccatgttggccaggctggtctcgaactcctgacctcaaatgatctgcccacttcagcctcccaaagtgctgggattacaggcgtgagccaccgtgcccagcctgttgccttcttatattcacgcccaccttcctcctgccaaaattacagaaatggagaagagattagtacctttctctttacccccacatttaacccctggcaatcaccaatctgttctccatttccctaattttggtgtgtcaagaatgctaaataaaggaatcgtacaccgtgtagcctcttgggattggctttttccaccgagcattaattctctggagattcatccaggttgttgcatatatcagtagttcattcctttatattgcatccgggctatggatgtaccaccgttgatttaactcttcatccattgaaggacatctgggctgtttccattccatagctcttgcaaataaagcagttataaacatttgtgtacaggtttttatgtgaacataagttttcatttctctgagataaatgcgtacaagtgcagttgctgggtcatagtagggtagctgcttgcttagttccatatgatacggccagactgtttcccagagtggctgtacattttacattcccactagtaatgtgtgagag

SEQ ID NO: 125314 - DNA, 1061 bp, Homo sapiens
tataagtgtgagccactgtgcctggctgagaattctttatatgttctagatactagtcctttgttggatatgcagcttgcaaatatttctcctggcctgtaacttatcttttcatcctcttagcagggcctttcccgaaggaaaaattttaattttgatgaagtccagtttatcagtttttttcttttatggatcatgcctttggtatcaggtctaagagctctttggcctagatcacaaagattttctcctatatattttcctgaatattttatagatttatgttttacagttaaatctataaaccattttgagttactttctgtataaggtgtgaagtttaggtgttttttgtttgttgttttgatgcccagttgctccattgtcccagcaccattggttggaaaggctgtccttcctcctttgaattgctctcgcacctttgtcagacattgtttgggcctatttgtgcaaatcaatttcagattctctggtctcgcctgttggcccatggttctgttcccatgttggtaccacacagttttgattaccatatctatattctaagtcctaaaatctgtgtatggctgctcaaggccccacccagcagttctggggaggagtttctggctgttggcaggttcctctgtcccccaacatcactattcctgagtcaggctatgggactgggattgccacccctaccttgcctggctgggccatctcagctcccaggcctgttcttgcctagagtccaggtgcctggagccttctggagccatcagcccctggttttcttcacccctgcttcctgggcaggacttggtctgggggagcaaggggaggagcctatgggctgggaatcaagtcttgcctcccctgagggtgtgaggaagtccagaacactgccctctccctcttccctaattggtaccccccagtcccagtgctcggtgatgggaagatccagtgaaaggccacatgcttagactccccaggcagagctcagctctacttctcacctgctctggggccctgggcacacagctcgccctcagaat

SEQ ID NO: 125315 - DNA, 1036 bp, Homo sapiens
caccaggtcactggtatccactcagccccatcttgcagagtcacttcaatgtctccccagcccctttcttagaaacactggccaagtcacagtccctgccaggtctgtgggtgcccaccctccatctattgtgctgtgtgtccctgccctctcctgggggtgtcatggatgggccagtgggtctgcctgcctggcccctaggaccatatcagcctcgggcagcccccacttggtggaatctgggtcagttctgaggtgccctggcctggagcccttctactaccctaaagagggccttcttgttgggaggggctgctagccagagcccaggttactggccccacaccccatttcaggaggtatcctgcatgtccctccccaaggccaggatggagagttgttggttgaccactgcactcctgtgatcaccgcacccctgcactctcctcctcggctttctcagcccctggcctccagaaccgcctatgcccctacctgggctactcagggtagacaagacctttagcagggagtcccctcacctccactgccctctgtccttcaccccagggccttctgtggggttactggctactggctcctctctaaaccccagtttccacggggtagctaggattgtccctggctttataaggatagccaggcctcggtgtgggcgggagagtggggaaagtatttggaatcgggaagtccatctctagggctgatccagggactctgggtggcagggcctggtcagaaagggttcatgctggcctccaggctgtatttgtgggggcagatcctcaccagagtgagtggggtgggtcagtactaggcccctccactgccttgcctgccatcagagcccaggggtcccttattgagaaagaggtggggcctgctggcaccggggtccctccaccctgctgaaagggtctcctggctgcatcgcagctaacatcccttccttcctgtcgggcagccagagcagctgagttccagataaaaactgtcagacccggcctgtaggctg

SEQ ID NO: 125316 - DNA, 1268 bp, Homo sapiens
tgacacaagacgctctggctggggcaacccagctcacagccagtggcctctgctcccaggaagcgggccttgtgacgagttgcggctgaccttccctgtgcgcgatggggtggtcctggagcccttccgcctgcagcacaacctggctgtaagcaaccatgtcttccagctgcgagactcagtctacaagaccctgataatgaggtgagctccgcctggcccccacctgacccccacgaggctctgttcctcctcccacactctcagggcccgttttctgggtgtccacccatcttcctgagcaggcctgacctggagctgcaattcaagtgctaccaccacgaggaccggcagatgaacaccaactggccagcctcggtgcaggtcagcgtcaatgccacgccgctcaccatcgagcgtggcgacaacaagacctcgcacaagccactctacctgaagcatgtgtgccagccaggccgcaacaccatccagatcaccgtcaccgcctgctgctgcgtgcgtgtcctgcgccgagggggcggtgctgtggcgtggggcggggtgtggtggggcctggcccagcggtgccgtggggtggggcggggtgtgggcggggcctggcccagcggcgcagtgggagcggagccaggacatgggcgggccggcctgcagcaccatcagatcatgccgccgtctgctgttttgctgtccaccgcctgctgtagcatgtgtgcccccttgcagggtggagagcaggacgtgggggctttattatttcagaaaaatgcgttgcttctctttgttactgccttgtatttctattttaatctgtcatccttgccctttaagaaagcgatccagtaatataccctagctgttttccagttagagtaaattgactagatttgatgctcacattaattatgtaagagaaaccaggatatgcagaaagctcatggagctcggagtccccggctgatcaagcattaccggttctagcaagcatcagggtcacccttgggctagagaagaaagacatggcttatgagtgcactagtcagcctgggcatgagggccttggggacgggttggccacacaccacattgtctgggatgtggcagatgtcaacacagacccagcatctgtgactgtggatgtgcgagcagggggaacgttcaaggggacttgaggtgattctcttcatggagaagtggtgactaggcaatggttagaccggcaggatgcccagcacagctgtagagatgga

SEQ ID NO: 125317 - DNA, 3091 bp, Homo sapiens
cggggtgggtggtagcgccccaaaggcccgggcgcggggcgaccctgcttgaggggcgagcgcgggcgggctgcggcgccatttcctgacgaggggccattttgggaggtccgcgagtcgcggggaggaggccgggacggcggcggacaaaggcaggcggggcggctgcgaggccgttgggggagggggcccgcgtccgcccgcccgcctcatgtggccgcgccctgtcctgtccgacgcacgtgctcggcggccgcgctcaggtccgcgccttgagagtcgttgggctccgccctagcttggcctgggcgccgcagaccggagccagaagcacgctcgcgggggcttgcgaccgccttcctgggaagctgtcccctggcaggcatgggtgctttacatcctgagctgggaagctgtttgcttgagggtttttctcaaggatcgaggcgcggtgtgagcccgtccatgctcggtcctgtagatcccgggaggccatgttataaaaggagacttgctgggatgtgacgggttgccacttgaaatatcttccatttggataaagtaggaatatttatacatgtgccccaaacgtccctccgtgtcccccacccccaagcggaaatgtgaaaatgggccttgcctttgctggtgcccaaggaccgccttccactgcagtgacggcgctggcgggggaggcgctcttgagcccctcccgattgtccctctgcctagcaagcaagttgcgactggccacaaggcaggcctcttccgaccaaggtggattaccagtgattacctaattagttttgagagcgttaaatgagttcttaaagatcagttgtaattatagcatagtatctaaacttggcgcgtgtcttcaaagttaaatattgagtacgattccgttccagttaacatggatagaccttagggagtagcgaaataggatgttagtggttttattcctttaaatcacatctcaaaaggccaccaatggctagtttgggatcttattccgaaaatagattgatcctcatgcagtcttcgtgaggacagagcgatttccttgttgcctaccctgtccatagtgcctggcacataggcactgaaacactgcatgttaatccacaccccaccccacctatgagtgtagtcaaagctggtaagtgacaagggctttcgtggaaacttggcctgacctaatgttgggcatcaggttacccaaagagcttcagggaaatgagaaaggacttgcaggtcttgatgagaatggaggggtaactgccaatgagggctttggctttagcgaaagtctgaaagggaagccataggaacttaaacgtaccgactataaagctctgagaaaagctgatgttttagaaagaccatacattctaggtacaaatacctaaaaactaaaaaataagtacgttggccaggcgggcggatcacgaagtcaggagattgagaccgtcctggccaacatggtgaaaccccacctctattaaaaatacaaaaattagctgggcgtggtggcgcttgcctgtaatctcagctactctagaggctgaggcaggagaatcgcttgaaccccggaggcggaggctgcagtgagccgagatcgtgccactgcactccagcctggtgacagtgagactcttgtctcaaaaaaaaaaaagtacattgctataagagaagtgcacacggatactagtagttaattcagtcacatctgtgaaatagcttataaaatgctacttttaaacaagctgtttttatgaaagggcttgtaaatgtttatggtatttaagctacctctctagccataacgtattatacattcaagaaaggttcaaaaccagatatactagaaaccaatctttattttttaccccactactaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttgtaagttctagctcaagttggggggtggtgatagacatttaagaagccatatatcttttcagaagtaggtgtgatgtactaaaagtttgagacactttctagaagtctcactatttaagttatgactagtattggatttttggcatgtctttgggtttcatgtttcttaacccaactgcctgcagggccttatggctgtcaggagcagttcttgggaattaaagtaattactgaagaagtattctagtgagaaaatgaatttatgactcagaagcccctaaagacatgggtactaagcaacaaaataagcagatgttaattaactgtaattttctcttacagctgtttgcagacaaggtcccaaagacagcaggttggtccattttctaagtttaacaaagatgttccaattgtgacagtttgtgtgtgtgtgtgtatatatatatttttatgtatgtatatatgtgtttaatttttttttaaacagaaaattttcgtgctctgagcactggagagaaaggatttggttataagggttcctgctttcacagaattattccagggtttatgtgtcaggtacgaaatttactgaattttattttatttgggttgctcccttcatttgggattgagccagaatatttcaggatacacatatctgaactgttactctaccatttcggttctatttaacccttctattcagtttgaacttgggtttaaagtttgaaccttgcagatttggcacacttcatggttatgttgtcagaagtgacatttttcctatatgttgacagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggtaagggtacaacatggcacactaaccacctgactaaatgaaaagttgccctggggggaac

SEQ ID NO: 125318 - DNA, 1049 bp, Homo sapiens
accagcctggccaacaaggtctaccaaaaaatacaaaaatgagccaggcatggtagcacgtacctgtagtctcagctgctcgggaggctgaggtgggagaaattgcttaaacctgggagatggaggttgcagtaagccaagattgtaccactgcactccagcctgggtgacagagtgagactctgtctcaaaaaaaaaaagagatgttagcccaagcccagggttacatggctccagttggtgacacaggaatctgaacccaggtcagtctgaccacaaatccaggtcagtgcaaaaagtcacgagtctgctcaagggggtctgcagctggcccgtggacatgcgatggcacttacattcttctggtttgcttgaggccacatatagaaaagtatctataaagccctcatgttaatgtctcacatgtagagccaggtggccttttgagcttaggtagctttgtgcctatttatcgtctgggctttcaaaaagagtttgtggaataggtatatatgagaggtacatgtatttcctggatggacagaagccgtgactccctgtttagtatggagccaggcaagtctggcactcagtattcagtttagcacttcctgcacacaggcaggctcatctagtctccagcccagccctacaagcccctcacatgcccagaatgccagtgggaaactaacactctgggaattgcctataagcctgtagactccatagcctcctgccacagctgagtgtgagtgtggacctcagcagctgaggaactctgctccaaggctttgcttggtggagttcagcagcaaaaccctatgtgacagcctgtcctgtcaaaaacttgctcctgctcccacacaagctgccttttttttctcttatcaggagcatcaattcctcaatccccattccgcttttactgcctctgcccacttcctgctatcttcttccccaactctgagtacagccacatacttctggaaactcatgataatctgtttcagatattcttcctggagcacattcatactgtattcacacat

SEQ ID NO: 125319 - DNA, 1866 bp, Homo sapiens
actccgcgtcacttgcagcttgcaatccgtggtgatgaagagttggattctcttatcaaggctaccatagctgggggtggtatgtattactacttaagccttgattcttattggtctttctgactaatatatcgttcagatcaatgatatagtatatttgatcggttaactagaaagcatataaactttaatttcataaatactaaatctataacaattctaagcttttcataatgatctgaataaatatttcaccttctagccatatgtaatgctatttttattttagccagttctttgtctaaatttcatatgatacttaaagcctgatgtttaacatatttcccatacttttttaactgtgtttgaaaaatgagttggagaagttgcataacatacactggaaagggttgaaataaatacacttgaaaagtgggtcaggatcaatgaaagtgagaggtaagttggtggttcttaatcttctttggataaccctcaaagaacctcgtgaaagctgtggttacagctgggcacggtggctcacacctgtaatctcagcactttgggaggctgagaggccccggatcacccgaggtcaggagttcaagaccagcctggccaacgtggtgaaaccccatctctactaaaaatacaaaaattagctgggcgtggtggtgcacacctgtagtcccagctactcaggaggctgaggtaggagaatcacttgaacccaggacagaggtcgcagtgagccaagattacaccactgcaccccagcattggcgacaaagtgaggccatctcaaaaaaaaaaaaaaaaaaaagctatggttactcttctcaaaaaatgcacggaaagtcacacaattttacatacagttttaaagggttcacagacccctggggtgtagccattggtatagatagtttaacagtatcagaatatgaaaagggacttaagtaaatttcattttttctataattaactttttacttgaggcaaaaactttaaaagtttttaataacttttttaaatttcattctaggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttgctgccacattatagatgtggagcctaagggtcacagaaattgtgtgctatgccaaaaaacattgaactggtagatagaaaatgacagagctaggattcaaacc

SEQ ID NO: 125320 - DNA, 1041 bp, Homo sapiens
caaaaccctgtctctactaaaaatacaaaacagccaggcgtcctggcgcgcctataatcccacctactcaggaggctgaggcaggagaatcgcctgaacccgggaggcggaggttgcagtgagccaagatggcgccactgcactccagcctgggtgacagagtgagactctgtctcaataaaaaaaataataaagggcacagacaagtgggatcaggatactttgaaatgagaaaaataccctctttttcagaaagtagaaagaaccacaatgagataatagtattgatttttcttaactatcagatcacctcttgaaactgaagaaagaacatttaagatctgaggaaggtattggaggttcaaagttgcatgtggctattatgtgaagaaattaactagataggaatttgatccatgggtcatgttgaacgtacagttgatgacagcccagcgtggtatttcttcattttagagtgatatttcccatattatgcagaggttaaagattttggacagattaccagaacagagacacaggccctgggaactattgatgcgtaataggtttggcttctgatatgtgtgatcaagttttttattatttcatgcttacattgttcagcctttgattacagtcagtgcaatgttaagactctgcagtgcttcccactaagacatctctcttttagtttcctgtgggccgcatccacagacacttgaagactcgcaccacaagccatggaagggtgggtgccactgctgccgtgtacagtgctgcgattctggagtacctcactgcagaggtttgtacaggaatgtctgttgtatatggccatccagaaggtgcactagtctcagtgacagaaacccatggaatatatttgaaaaaagacatattatgctcactggggcttttttgtttgtttgtttggagacagagtttcactcttgtttcccaggctggagtgcaatggccagtctcggctcactgcaacctctgcctcccggattcaagcgattctcccacctcagcctccca

SEQ ID NO: 125321 - DNA, 7186 bp, Homo sapiens
ctaccgcaatgccatcaccgtacccttcaaagcctggggcaagttcggaggcgccttttgccggtatgcggatgagatgaaagaaatccaggaacgacagagggataagctttatgagcgacgtggtgggggcagcggcggcggcgaagagtcagagggtgaggaggtggatgaggattgaaacgggcagcttcccctacaggcctccacccaaccaccatccccttggctagagaattccctttcctgctcatccccagtgagctagtggagagggagcaagggaggccgcagagggaaaaaacaaaacgtaacacagttaagagaaataatcgtaagagaacagtgacggacaacttgagaaaagcagtcaagttccaaggaactgacagcaacctgcaaagaggaaaacagcatctcctcacctgcgtaaaattgtctcagcttctgttgtttctcaactgaggttcgtaaacccatcaggataatccctggagggaatagatccttgcacatccagggcaagaaacatgtccaagttacccagaccattgataacagttgcatttaggttgcacctgggtaatctggcataaaagatctctctaggcctcactgttgcggtgtctatcccttcacctccattgaaatcagcattttggatctaggtcttcatggaatccttgagaagagaggcctttacaattacccagttctgagggttcaggttcacgaaaagaaatgcaacttgggataatcatgaacaggttaaagataagatttcaagaagccatctaagaatacagaaccaaattggatccatttttttaaaaaaatggttttgcatggaacctggaccaaggcaaatgtcttttcttcgcagaattgttttccaggatgccagtggattcagatagcaatgcttggagtagaatccgttactaaaatagtttcaaagttgacaaaaaattttcaaagataaaagcagttttacattgggggttgctgaggtaggcacaagaaaaagtcaggcataaagcacaaggcagactgtttgagtggattggttgctgctcactaaagttgttcccctgatctctaaatatggaggtcattaccaagaaatgctttggtatgaatgagagccagatctccactgtgtgagccagtgaattatggctaattcggctgttacagccactggttggctggattttaaaccataaaacttgaagattacctacaaaagtaacagtgtggctataagcctgagctttaatggatatacatcctcacagaaaagttggaaataaccaaaactgaagtcttaatttaccttcagtttaatctgtggatttgttcaaatactaaagatcctcaggtccagaattccagcatcatttattcttttaaaatttttaagaacttgatccattgtatcagtacctcacaatcagagttggcaaatgatggatgagtgattcaagcagtgcacccggtggaagctgaaatccatctgtgaatggaactgaagtgaacgtgaatatgctgactatatcctggaagcatttttataccatcttgaaatttcaacaaactggcttttgccagttaatccagctgtctttcaagaataaaagttggggttttcaaggatcgcctcttctatattttaaatggattttcagtagaaatgatttttactaatcaagttaatcccaccccatcaaaaggtattcctagaaatgtcatagacctaggtaactttgaattgaatgggagctaacgttctttccaaagttttcaggtattctttgtgtgacaccttctcaaccaggaggcaagtaaccccgcctccacaatcttagtattttttttaaactgcatgcctgccccttatttgagctgcctttttaatttattgcatatcctttttattatcttattttggtattattcaatctatacaatctttttgtatttattgggaaatgagtaatatacaaaaaggttttcatgtatttgtggctgagagggcgggaaataattgtgtacataaaattaggcttttttaaaaaaatagattatgatgcagaatattgttgatcttagattaaaaagtggaagagccacaaacattggtgcccttttcagactatttctctactctcatcatccacagtagaatttttaaacagatttttttaaagcttttcttttaaatttttctccgttgcaaagaatgtttcctaaattgtatgggagcaatagtatttttgatgttttaatgacatccgtatacttgtactgtattttgtactacaaggcagctgtttttcaataatgtcctgctgtatttacctacgtgttttgagtgtctatttctttgctgcggagaacaaattcctaaatagttttagtaaaggagctgagaagctagcattaggtttgcagaaactatttaagtttcaactctgaggcagcaatgaaaatttaagttgcagctattagttgattgctgtaactttttcattttcaaaccatgtacaattcttgtatagaccaacttgttttcttgcttcagtggtggttctgttgctcagctgcagtgagccagttcaattttgcaaaggtgcagtacctctcctttttaaggggttggtttattcttttttctttttgtttggctgaattgcagtaactagccttgcctttctattctgtagaaatgacagggtcttcacaatccttcaccagtggctactaagctataattagctgaatagaaagaatgtggaagtggtctgaggcatatagagtatatgccaagaacactaccatatatggcatcagctttggttaccagagaaattttcttagtcattagaccatgtaacagtaatatatcatatgtaaatctttagatatcaatttgaaaatcctccaaaaaaaggagcaaagaatgcataagctatgtgttggcaaaagtaatttatattaaaattttgacctgcctatgtaagattaagtggtaatgtcatagtggtgggtttttaagtcttaaccaatctctaaggtttgtttctcctgcaagggatggttcatggcctctcttcccactgcaggaagattgcagaaggctgtggattaattgtagcatttcactgatcttcactccagtcactagggacaatagaaacctgcaaaacacagattcattcgtaaatattattaatagcttattaaaggaaatggtctttgttaattccagtcagataatggcattgtacagacatgggaaacaaccaatttttttgtttttcagttgttgctatgaatgattttgagcctttttttttaagcttggcaaacatcccagctaatcaaaatagtcatattcctgagaagtaggaaactaaaacttcttttcatataattgttagaaggtttgtttcccaaactaccatagttacaaaggtgaaaagccaaattttaggaacagaatcaaaagaataaaaatctgtgaagagatcctactactcttccttctatgttttggttttggtttctattgtccctatcatttcagcaagtggaacagcagcaagtttttcagtgcatatgctgcacaagaacaaaatataaatctgtatggcaccaaaaatcaaagtgaaaaccaaaccaaaaacccaaacaccctatgtaactatcggaggcatatacgtggtataaatgactgtagctgtgatacacacatggctacttgtcacatcactttccataattatttactgcaaaatgattgagaggcttttggtgcaggcagccgttaacctcctgcttcctttgttacctctggattactttgcagtaaattgcaggtcttttaagagatttaagcttcagttttctcaaaacaaaacaattatcctgtcttatctgaagatgcagggttgtgggcaaaagaggctggttataataatgccctcatattgagtggtctgtaaacggctgcacacttcaggcactgtagttgctgaagatgctttgttaaatgtgaccttgactggctttacaggggtgtagaatgtaatctacacaaggtgactttgcatctatcttgctcttgaggtggatgaaattgagaagctggagtgtgtaagccatgcacataagtattcttcactgtaaattttgttttcatttttaacccaattatggtactttatccaatgcacaactgatctctcagtagatattcatttgaaaatagtgtggccttgatcagtgagaaagggaaggagaaaagtgacttttttgcttatgtagaaatgactcatttgctgagagtttgtctttctgcagcactcttggtatatagtgatcggtctcctttttgattggggaaagttaatgtttttgaccctggagttaattcagttgagttatcttatatttttaggaagtatcagaattgctctgatgaataacaaagttgactgttttgatgtccaatctcaggttttagaatatagtggtgtaaagtcccactatttttaattcttaaaacaactttaatttcgtacaccctaaaagtcacatgcataaggcctgttcagagagcagagcctccatctttttgctccttttctactttgtacttcacttgaaaaaatatcaagtgactttacattgtatatttccattgtaaccctgacatttctcaaagataaagcactttttgatcatgaaatacatgaaatctttgtgtgatgtggatcatagtttctcaggctcccttagataattgcttatgaatattgttctaactctgtgtaagaagagtagaaatctttgctaatgttagaaggtttgtattattgatccagaatgcattttgctagtttccaatggatgggagagtaaataatgctgcattcacaatttaataagttactttcccttgagccttaaggtaactttttctttcctgtcaactacagcactgaagttatagtaagtgaatgagattatcagttttcagggttggttttagagtactgtaaatcaattagctgtcttcctaaagagttacaactcccattcagtatactggataatgggtgtgtgggtggggctggggagggcgggagatagtttgtagaaaagaaaaaagaaaaaaaaaaaaacacatttaccttaagaaaatacagacaaaaaagaataaagtatgtgtcatatgctccatttgagattccaaatgcggccgggcgtggtggctcacgcctgtaatcccagcactctgggaggctgaggtgggcgggtcagttcaggtcagcctggacaacatggtgaaaccccgtctctactaaaaatactaaaattagccgggcatggtggtgcatgcctgtagtcccagctacttgggaggctgaggcaggagaatggcatgaacccaggaagcggaggttgcagtgagccaagatcgcgccattgcactccagcctgggtaacagaacaagactccgtctcaaaaaataaataaataaattccaaatgtaaggtggaaatggcagattataacttcatttcccccatttttaacttagaaaaaacaaagtccttaattttcaagtattagccccccagaagtttcagcagatagctggactcttgaataatgatttcttttgatatgtctgactttgctatttaaagtctcctttcccagccctcagtcttaaaactcagttttattactgacggatttaacagactcttacttgaaaattgtccaattatcagtactgaaaattagatttggaaaatgaaaaaataataaaatcgcatcaagaaaacttattaccttagagattcccaattgatatctgtacccctgatccaagtaaggcctttatgaatgtattttatatttcctaaagaaatagggaatatgccatcagtgtaatcacctctattcacagtcatttaatttgaaaatctaactcatgtctcttgaattagacattccaattgggataggtagagtcatgttaaaacaatagaatagcaactgccatattggtagtttcactgctcaatatgatttctaataagagcagagctttattggaagctaaaactcatttttctccatagatgattctaacagtttaataaaaaagtataattatactttaagtgtcaacagattttgagtctagaagcaaatttcattttccttgtgttatatctaatatccattgacatgggtaagaaaactaattatgtctttttagtatgatgaaatgtgggcccagagtattggaaagaaagcaatagccctattcagtgtccactaggatggatattgcagaaggcatgagtttgtccttttttcccccttaccttaaataacacttcaatagctaactttttccaaaatatccatttaggccatctcttatttcttaaagccaaatatttcgtccccagtcttaactctgagttgcaagatcaggctggttggaagaatctttatatttagaaataggatggtgagtggtttgtttattctcttgtaaaattcctttttcagagacataactgcagggagagtcccaagagaactgaagaactggattatatcattaaacacatttgtgttgtaggaatttgggagtttcattttgaactgataagatattagacataaacccttgttccagcccacatgtgtcatccctgtgtacaaaagctctctggattctttttttttttttgagacggagtttcgctcttatcgtccaggctggagtgagtgtagtggcttgatctcagctcactgcaacctttgcctcccgggctcaagcgattctcctgcctcagcctcccaagtagctgggattacaagcatgtgccaccatgcccagctaattttctgtatttttagtagagacggggtttcaccatgttggccaggctggtctcgaactcctgacctcaagtgatctgcccgcctcagcttcccaaaatgctggaattacaggcatgagccatcacgcctagcctactctctgaatttctaaaagtcagtaggttgaccaaaaagtctagaaactggctttaagtcagtatgggacgtacttataaagagtccatggttttgcacgtttcggtagacaag

SEQ ID NO: 125322 - DNA, 1267 bp, Homo sapiens
taaagcactggctaccccttttcacttactatcttttcaagcatgttctaccaccttggaaggtaagaggttagtaccttcttccagagcagagggcaggcattcttgctgtgcgttgtgaaagggtagagtcctgcgctcctttcttgtagtagtccaatggctcatgcaggtgcctctgactcccctatgggaactggggcttgggagggtggtggaaaatgctgatgctctggctattgctattgttttgaataatcagtggtcccttgtccctaatcgaggaattttgtattttctaccagtgtccatgaaactgggaggcgaccgtgttagctgccagttcctgacagccacctctcaccagtggcttcactctgtgtccctgacccagcacatggcacaagagtgcctgccatccgtcagtgtttctacagcagcaatcccaagatgctggagctagaggggacctgacctgagagaagataccttcagtggctgccaggctgttccttggaacctgtgcaggggtaagtgtgcaggaaggtctgacctggcaagtcacttcactcctgttttatttagagtcacctggctaatgaaaagtattttgaccttcccgtatggtaagtcaggtgattgaatcccagaaaggttcattgtcttcaagctcacaatactattttgggacaaacagttgtctagtgtttggactcatgaaccctgattcttgagggtggtattttactgcttttgtgatttggtttcaacatatatagtcttttctccggagttaccttaggtcagtggccagtgtttcagcccctggaaagggcatgggctgccactgaggttggtcacaggcctctcagctcatggtgggagtgggttcaggagttggtaagtagggttcagttctgttgttgccaccgatggcaacaggggtttgtaataatccctagttgtgtcaattatgtcacttaattttcacaacaggtctctgaagtgtttctcatctcatttttacagatgaggcctgcctgtgttaatacacctagtgaggagtggagctgaatttgaatgcaagccttggcaccttaattgagcaagtttgaaacctcgcttgttgcccttctggaaggagtcaggaatttccagttctgggcctgggctgtgggtctggcagacagacctctggccctaggtttgggtgccaggttctctgcttccagaatgagaagctttgctgtgcaccaggacctgggcc

SEQ ID NO: 125323 - DNA, 1210 bp, Homo sapiens
gtggctgaggtgacggtctcaaagtggaagagcttactgtcacagcaactcctttgcaagatgccccggtaaatcacgttgcagagaccccaactctgccttcctggaactaggcctgcgttttctctgaaccattatttcatggggaaaatgaaatctacttcatgtgcctggtctacttactccttcagaagtgatttctgagccgtaagatacatgagaaaaaaatgaaggggaaaaggcagtatttatattaactacatgatgataaggatgtttctggtcacagtgaaaagccatgctagaattgtagtgtcatagaataatgtggaagtttagttcgtgttgtctgatctatttaataatttaataaggttatctcttccaagacaccttcccttcttcctcagccagaaaggatctttccctgagagtcattagtagctctgggctcctggaaccaagctcaggtgcctaattgaactctggtctcttcccacagcccccagcagggactggtgcttagtgagagtggactgccagattccttgagtgtgggggatttgggtgaatgagggtagcaagcctccagcgtgcttgggtctgcggtgaccctatgcattccttcagtgcttgctagaacagttttgaaacggtttgaggccttgccctgctccatccagagcaaggttatagaaatttcagacaatgacttcctccctcctggatctagtgtcctgggccttgtatagatccgtgccatctaatgtggtagccacttggcacacatgattaaattaaatttggagttttatttcattttcacactagccacatttcagatgatcagtagccacaggtggccagtggctaccatattggaccgcacagattagagggcatttctgtcgctgtggaagttgttttggacaatgctggtgtgaaaggtgaagggaatcctgagtgtttgctgtgctccaggctcagtacaaattttattttattatacacttaaagcaaaagtcttataaaagttgaggatgaagccaagagtggtggtaagggtaggagttgaaacagtgaagaggaataacagggaagagtcctgccctgagagactcatggaataggatatttacaaggcaaagcaaagagaaccaaagtctcagttctgcagaggagctgagtgccccaggagctagtggagggt

SEQ ID NO: 125324 - DNA, 1047 bp, Homo sapiens
taaatgctttataatcttcacgtcttggctatcattttctttttgatgtgtgtgtgcgcacttttatccacaagtttaaagcagacctcgataattcctaactatgattttactaccctgaactctgcagggaagtgtcctttaattgacagctactcaccaccttgtttgacagagtgccccatttaaaagtcctgtttgaaatagaatgtagccaggtggccttcagggagtcctgtggtgctggttctctactttctcaactcattgtttcatgttagcaccatgcatgtctaatttaggtgcagtataatttgcggttatctacaaagatgttttaagtctggaaaatagctcaagatagtgattcagcctgcaggtgttagattagagatgcgtgctgcgcacagaagagggaggagccaagcagtgtaaaaggagttagctggaaaggagaggtgctaacccggtggctgcttagtagggaccatcaggcccgagtgtggatgatgctgagctttgcggaaagtgagccatgtgctctgtggaatgccgggatccaagagcgcgctaaggactgatgacctcattgtgcaccgcttacaggagtacctggcccatctacctgtgtgtgataggcaaggatggaattgagtgatttttttttctagagctgtctatcagctttggtagaaacatgaaacacccagcaaatagggagagagagagagaagcagtaagactgtttttggggtacaagtgaaaaaacagtaaaattatcaagaattttccagttgggtaatgaaaaaatttaggcataaacaggttaattattaatttcattttctcactagaggagataatcagttgttatgtagttgcttaagccaggggttttgtgttttttctgtattctgccacttgtcttagcttgtttcctgtagacaagccagacaaggagctttggggcatggattcttctccaggtcatgacttaacactacctcgtgtactctgccagttgcaagctggcagaaccttcctgct

SEQ ID NO: 125325 - DNA, 1139 bp, Homo sapiens
gggaaagaattgcataaaaaacatatgctccacttgttgatgctagcactggccacaccttccacctgccttcctggagttctcagaaatgaagtgtcccagctgagctggaaagagttggagtgatgttatgttttatcttctgtggggaatctcccccttctatcattgtcttgccagataaggttacctggcttctatgtgttgtaggaacaggtgaagaacaaggtgcctccatgccagaggctgcatggcagcccagccccaccgtgccggcctgcgtgctggctgtggtccctcaggcttgtgtgctgttggtacctttctcaccagtctggcagtcagtgatccctgttgcatgggggccatggtagtagttttggctacttctgtttgttaaccataggtacaacacaaagcatttgtaaataatgaactccaatcattgccgtttctgcctgcagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaaggtaagtcgtcatgggccacaggacgtgcctgccaaacgacagtgacggtcatgcttgtatccaccagacactcttgagtttataagacacagccacacaaacaccttagtagttgattatcccacccattgtcttgtctatgctgataaatttaataattggataactgaaaacccagattctgtctgctgaccccagtttatttttttctgtagtagcaatgccaccttctttctctcgaagacttggctgtgtgagtagtatgtgctgctccaccagaagagggttaaagagctgggagaaaactcacatctcctgtagtttgcagttgaaaagagttacctggtcaaggccatgaccttgcaggtctaacagtcaccgcctagaattcagaccatgtgtttgaggctcatcattgggtctcaaaggcctgaggccaaaatactgtgcataaaccatgtgacgtgcataagttgatttttaatccctcccctaaaatga

SEQ ID NO: 125326 - DNA, 1031 bp, Homo sapiens
ggcccacaggcaggaagcagggcataggtggtcttggtgggggtggagggaggcgtgaagaaggaatcagggtctgggggaggggaaggcacagaaagatcaccctgagaacacagctcggggggtgggtctgggcttgcgtgcccaccctcctggtccctgagcgctgtccgggcagctctgggtgacaggagggcctggcacgtctcctctcccatcacaatccggggctccagggtggccgggagaggagcctccgtggacagagcctgggaagacaggccctcagggaggagcatggggcttgggccgccctcccctgggtccgcccaggccgagggtgccccaccaggccctgcatcccagctggctccctcgggctggggccgggcacccggcttgctgggcaggaacgtgagggccaggtggctgggccctggggtcagagcacagggctcccgccggtcccctcccaggatggtggtggcagcggccgcatcgcaggacagatctgtggagatagagaagatcatgaggtgcccctggatgcatctcccaggcaagggccaggcccggggagatgaattccggctgcatagggcccagaggaaggtggatccaggaaggcaggagagaaaagagaagaccctctgcacgctgcgtttgagggagaacttccaggagttttgacagcagagagcagatgctagtggtttcctagagaggggttttgagggaagtgttgctgggagtcatgaacagacctgtctggcggcttttctcaaggacacctcagcaaagaactagcatttcagcctctctggggagactggattgcagtttccattccacagaatcagtgtggttcagctgggctcggtgggaggggctggtggtgggaatctgccaggcagtgccagtcccatcccatgacctcccaatagatgcgccacatgaggcaggtggcaccagcacgacgcgcgcagctcgaacactctgggcttcatgcctcgctctgcctcctctctctg

SEQ ID NO: 125327 - DNA, 2256 bp, Homo sapiens
gcctcgaggtggccacgcagtatggctgggtgctgggtgagggctccccctggttggcacagggcctggcattgcctgagtctaacgggactcttctaacccaccccgtctgcagcaagtactgacctagggagctgcagggtgtcagcctgggctccccacagtcccatctttgttcatctttcctgtgggggggtttctgagggatgtcccccaacatgttctcatcccacaccccttccccagatgctgaggtgctgctggacagtgacggcgagtttctgcccgtaagggactttgtggcacctcaccttgcccagccaactgggagccagtcaccacctccagggtctaagaggtaggtggccagggacctgttggccatgggggcaccatggctgttggactgcatattctttgctttccatctttcccctccgaggggctgggagagtggaagcatgtcagccacctcttcttccttccaggctagcgttcttgcggtgggagttccccaacttcaacagccgaagcaaggacttgctgggtcgctttgttctggcccggcgacacatagtggctgcaggcttcctgatagtggacgtgagtacctcttgggcaggtggtcactgcacagggagaatccccaacccacgctagagaggggatcaggtggaactgagccagcaggtatagacacatgccctgcccgtggccccgggcctctcccaggagcccagggagggagtttactgtggatcctagctgctccagcctcccctctaaccttcccagcatctcaccccgtgggtgaacccaaaaaggcaaccaagcctgcttattcagcttaagaggtgggcagggtagggcccattcacagatgagcagcttgaagcccaagaggctgcacagctgttggggctctgagtgcagctgctctgcccccttggtcagcgcctgttgtcaggaaaagtaggaccagtggaactggcaggagcagaaagatgcaggtcttgggcctgactctggtttcacacctgggagaccttggttaagatcaaaggtggtcaccttccctgggaagggccagtgaatgaacatgtggcttcatgagccacacaagggttctgtttgcttctttgggttgttgtgagttttttaactgtttaaaattcagaagcccttcttgggcctccgagtagtttgcagacccctccagcactgacagtgctagcacctctccccgcccgcactgcctgcagttcatgggctctgccttgaagacttggaggccaaggggcaggtgtgcagagctgttggtcagcagaggtgttgggtgaggggtcaatgtgaggacagcaggcaagcaggcagagccactggctggaagggatctccttgcccatgtgacctgtctcccctgcctccttctaggtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcg

SEQ ID NO: 125328 - DNA, 3603 bp, Homo sapiens
ttcacgttgccagaaactgcgagattggtttgttagagaacagtttaggggttggagcttctctgactcaaaaacaaattattttcctggagaaaagccagtgtgttttgttttgttgtttgagacagagtctcactctgtcacccaggctggagtgcagtggcacaatctcagctcactgcagcctccaccttccaggttcaagtgatcttcccacctcagcctcccaagtaggtgggactacaggcatgtgccaccacacctggctaatttttgtaattttaataggcacagggtttcaccacgttcaccaggctagtctcgaactcctgacctcaggtgatctgcctggcccaagtttttaatacctaaaacttttaatgtcgttgcaagtaaaagtcacgaatgataacaaaactgatcttagcaagcgtaagtgccaccttctctgccatcaggtgacatccatcaggctcaactttttctctgacctcttgtattgatttgacagctttacttgcagctgaagtctacgtgcccactacccagagctgtagccaggaccatgtaaaagagtgtggtctctctttaatcaactacattaggtcaaaacttcattggggaaacttggagaatttcccttgccactctagagttcttgcttgcaagcaattgcaaatgacctcagccaccttgagcagaaatgtgctatttattgtagcctagaggatcaggctcagaggtgtacccttggatctggcctgtgcctgaggggtgctctggctctgcaggtgcttggcagccatgtcaaattcagtgcctgccctgtctatggtaggcactggcccagaagactgccacagaaacagtgactcacaggccctgttactgtgtcccaggctcagggataaatttggttacagacaccaagcgtctaggcctcgaggctgagcaaggctgtgaggagcagccaggcactggggccctgttacaatggagtggggaactgatactgtcttctctgaagagttgtagtaaatgctcatgaaacaaggttcagagaggtagcctccagctcacacacaggactgacagtgccacatcatttctcctgtgtcctttctctgcctagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaaggtactgggcctgaaagcaggtggcacccagcctgcctcccctgggctttgggcttgttctttgggtgacagttgtctgcagaggggtgcgttgtgtgcactgggatcagagccctgggagcttctgtctggagcctcaggcatcacatggggcaggaccagagggctcggagctgcaacaggtggttgccctgtggctgcattcatcaagcaccacttgctcctcccaacacaggcgcttccctgattgcacctttatctttcccccaaaccccatcacagcacgatcttgagaggggggcatggcaggcagctcctgaagtaacacagctactgcccaggcctggcttctggctagaactctcctggagatgtgctaacccctatcggctgtagccctgcagtcaagtcaaattcagtgcccgtttctgtcatagcgggggctggcccagatggctgccacagcaagctccacagctcatgggccctgggtcacctaccctgggacctggggataagtttggctgtggacagtgctccaggtccaggggttccctggggtggatgaggaggcaggccctgcacagtggtcctgtgtttagtcagctcaggcccagtctgacaggggctgtcacaggggctgcactggatgggaccatgggacccctgcccccagctcatctctgccaccccaggccattgagctgacctctgcgcggctgtggttgacagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggtgagccctttggacagaacggtggagagaggggagcgctggccctgcagatgcctgcagccgtgtcaaattcagtacctgtcctatgcatggtaggcactggcccagaaggctgccacagaaacactgtgactcatgggccctgttcctgtgtcccaggctcagggataaatttggttacagacatcaaatatctagacctcgaggctgaggtggggtggagctgctgggtgattgctgactctctccagctaaaccctgtgatctgctctgtcctgaaggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccaggtgagccagggcctggccccaactcagagaagctggcttcctggccatctgctgggaaccattgccttagtcgggaaagtaaagccagtctgaaaatgctcacttgtgggggcaaatacatatttcttgcattttggcttattttgaaagggctgctattcagttctcaaaaaagtgtttgagaactgtttcctctgttctttcactgaccattataagtgcttccatccattttggggtagctgtagcaggtagcagcatggctgatgagactgagaatccactgagaactgtctactgaatcactgatccccctcgcaaagtggaactgtacagaaagatgacacctgcagttacgtttatgtgtgaccagtctaaactaagtttactggttggagaatatttctaaatcccttatcagaaagaagcagcttctaggtgtccccagcctctgtgggtagttgctgccaggcgaaggagtgtctgggcctgtgtaagtccttctctgttcccgacacagctcatgggccctggatggagggtcctgccattgcccctggccatgcaggctctcctcagactcagagccaggcaggaggacagcgtgctgggcagagagcttattctgtccctctgctatttctgacccacccagcacgtcctgaacagagcgcaggacatcaccctgccccacctgtgcagcgtacttctggcttttgcgcgtctgaacttccatccagaccaagaggatcagttcttcagcctggtagggcctctgggctcccactgctcgacctttatcctc

SEQ ID NO: 125329 - DNA, 3217 bp, Homo sapiens
tgcacataaaaatccagctgcaagtgggcgctctggagttccccagtctccactcactcgtcctcccagcccccacaggcctcaacgtcgcctatcccactccaccagcccagtcttccaccgccctaggaactctcctacgcctacgcaagcagggagggatagggtgacagcaccgacaacaaagggtcgtctcccgcactccgtatgaggatggcgtactggtcggggggcaaccgaagcctttcttcctaggttctttatcttttctaagtttcccatgacctatcgctccgcttgagccctcagcaaagatgtcacccgccgaaaggtgtggccggaagctggaggcgtggcttccggacgtgcggggcgaggctcgtctcgtttccgccggcgctccgagtgacgtagggaagcgcgccgcgcacctcatggttccggggacagttagggcggcggatggaggtcagcggtggtgctcgctgcgtaggtcttgtggcacggggagaaggggcggctgatcgtgggtttcgagtgcacaacacaggcgtggctgggaaggtcctgggatgcggtggaactggggagcaggctgggacgcggtgggatgccgtgggcctggccgtctgctcgttccgtgctggcttgccagtgcgcacgcttcctctctagcccgcgcggccaggcctggaagacgccgcccctgttgaccgtccatgaccccagcgagccagttttcgtgacttagtgcaagttgttttctctctgcattttagaactaaagttttggattgctgtttgcctaaactcaagtctggctcctgggcttccgtttactcggctaaactgctcttagggctcttaaaaaattggaaaggcggccgggcgcggtggctcactccggtaatcccagcactttgggaggccgagacgggtggatcacttgaggtcatggtgaaaccctgtctctactaaaaatacaaaaattagccaggtgtggtggcgcgggcctgtagtcccagctatttgggaggctgaggcaggagaatcgcttgaatccgggaggctgaggttgcagtgactcgagatcgcagcattgcactccagtctgggcgacagagcgagactccgtctcaaaaaaataagtcggaaagatttctacactgtgcttaggctcaggaagtggtagatgttgcgtttgggcaaatactccgactctctgatctctctctctttttttttttctttaagtggagttagactaagctttttacagctgctttaatcccctcatataaaaagaaaatgtgctggccatataccaagttccaggaagtggagaaagatcaaacgtacattctgctttggcagaaatgaggcctaggtgaacgttttatcttgcccttgtcgcatgtcttccctggatcatgtaatcaccgtagggagctagactagctgatagaattttttttctttttttttttttttgtgacagagtctcgctctgccacccaggctggagtgcagtggcgcgatctcggctcacttcaagctctgcctcaccctccctagtagctgggactacaggtgcccgccaccacgcccggctaatttttttgtatttttagtagagacggtgtttcaccgtgttagccaggatggtctcgatctcctgacctcgtgatctgcccgcctcagcctcccaaagtactgggattacaggcgtgagccactgcgcctggccgatagaattgttaaaagcaacatcaaggctatatgtaacacattgctggagatggcaacattgagtttggccttggaaggatgagatgtattttaaagggtcttatagggggaggaggagacccagataacaagccctgtaaggtgaagtggaagtgcaaggcctgtttaaaatggggccttgtgttgctgggaggcagaaaaagctaagactgagaaaatcattctgggccatgttatgaagtgcttcttattattggttcagaatttttgctgttagaaatttggtgggggggttttagtaggctagtgatgtaatctaccttggtttcgagaggctcacacctatgtctacagtgttaaaatatatccacagaggctttgggaatgtgaatttttttttttttttttttttgagatggagtctctcacccaggctggagtccagtggtgcaatctcagctcactgcaatctccgcctctcaggttcaagcaattcttgtgccttagcctcccaagtagctgggattacaggcgtgcaccatgatgcccagctaatttttatatttttagtaaagatggggtttcaccatgttggccaggctggtctcaaactcctgacctcaagtgatccacccgcctaggcctcccaaagtgctgggattacaggcgtgagccaccacgcctggccaagcccgtaatttttaatcctggttacccttgaaataaaaaaataaaaaaaaattaatgctgtctaggtcgtgtctgcagagatgccatcatttaggaggccttgggcaggacctgggaatctgaattattgaaccacatcctaggtgatttcaaattacaagcaggatggaaaccctcccacccaggctgtaatgttcctgagttttgatatttgatggcattctgtactgaaacaaaaatcctgtgagacttttgctttagaaaatactatcacatacctatggattgtcaagaaagacttagtctgattttacagatagagtggctttgactatttcatttctcaagtttgtgagtcaggaactgcccctgtagtagccccttctctctcctttttctcttcagggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctc

SEQ ID NO: 125330 - DNA, 1051 bp, Homo sapiens
ggtggggggtgatagtggaagtgtggaggtggtggtggaggtgtggaggtgatggcaaagttggagaagtgatgatggaagtgaggaggtgatagtggaggtgtgggggtgatggtggaggtggggaggtgatggtggatgtgatggtggaggtgagtaaactgatgatggaagtgaagaggtgatggaggaggtgaggtgatggtgcaggtggggagatagggggagtgtggacaaagggtctcagttgtgaagggaggagagggcagatgtggtcaggaggttcaggtggacatctgcctagcagggaaacaggtcctacgtgtagggggctcttggcttcttgggtgatgcatgttacagttatctttccaatttcttatttcagtattcttacacttcctctgttgactggagagggtaaaaaatctgtccctaaacctggctttgagcagtgacattttgggctcagaatttgccatgtcagaatagtagctgagcattatgctagttgttgctgggtctggtatatgtgtgctcttctgtcttactctgttcatttcatgacagccctaggaggaagggattgttcccattttataggtgaggaaactaaaccttcaaagtgaaccaacttgctttagacactctgaggtttgcttgtttttttttttttttaaagattctgtttaaaagtatttattttattaaattgtggattccacttaaaaatacttttcatgcaagtatagtgtgcttagaatggtttgagtgttgcctatttgggattaatgctttacataaatatcactcaggtaggagatggtgtttgagggacctgaaacacttttccttttctgctgttttttgctggttcttctggatgttggtgtcaggcctcactgcccatttggcctctgaagacacaaaaggtcaatagaaactctcagtccttcttatgttgagcaccacagactgggtccctgcaaaccaacactcattcattggaaatgagttgaggtttgtgggtccatcagagtcagtcatcctt

SEQ ID NO: 125331 - DNA, 1031 bp, Homo sapiens
ttatcagtacacacatattgagagtcccacaggagaggagaaagaaaaaggggcagaaagaatatctgaagaaataatggccataaatgtcccaaagtttttggaaaacgttaacctacacatccaagaagctgagtgcactccaaggtgggtaaactcaaaaagacccacactgagacatgtcattatcaaactgtcaaaaactaaagatatgagaacaattttgaaagcagcaagagaaaaacgagttatcatctacaagggatcttcaacaaggttatcagctgatttttcatcggaaaccagggaggccagaaggcagtggaatggcatgttcaaaggttgaaataaaaatataattctgtatccggcaaaaatcacaagagcagcacctgctgttaccaccatgcagaatcttcttctcccagtgtctgtgtgcccctttccccctctgcccttcttcaggacccccgtgaccaatcctagttgacagtacacacagctccatatctgacttccctgcttttccatagttacatgtgtcacctttgatgttctctgcatgtttgccccttccctgaatagaatggagtctttctgagggcagtgaggtttgttcaaatcctttttttttgagacggggttccactgtgtctcccaggctggagtgcagtggcatgcttcagctcactgcaacctccacctcccaggctcaagtgatcctcccacctcagcctcccaagtagctgggactacaggtgcacgccaacacacctggctaatttatgtattttttgtagagatagggtttttccatgttgctcaggctggtctcgaactcgtggactcaggtgatccacctgccttggcctcccaaagtgctgggattacaggcatgagccaccatgccctgccatgaatcttttattcactgctaaatcccaagcacctagagcaatgccagcacatatagccctcaataaatatttgttgaataagcaagtgaataaatgaattagaatacttaaaaa

SEQ ID NO: 125332 - DNA, 1148 bp, Homo sapiens
cagctaaccctactcattcatcactgtgtgtgtggctgttttccagggaggggttggcctgtggacagcccatacacatgtctgagttggcactgagtcccagcgctgaccatggagcctggcacacaatggctatccccgcctgtttaagtgggacagtgccatgccagtgtgtcctctccgatggattctagactccttggcctgttacctgaagctgggggacctctgatggcgcccacatatgagaatggccagaggaggggctggggtggcctacaacaggcactttttggccagcaggagcctcatttggggaagctgagttgggctgggagcagggtcagtacctgggacagctggctttgggtttccttagggctcaactatctgtgcatgatggctctgaagagcaggggccacttcttaccctccccatagctgtaaacaggctccagaatccactcgtggggagatgcatctgcagagcaagcacaagtctgactggctgtcaccaggtggtagtgagtgtcctgtggggttggagggaggataccaagctccccaagacccccggcgcccacttcgcatatgcacagccatggctgagcatgaggctgcccctggcaggctcctggtggggaggttctttgctatttctcagcacatgattgagaagcaattgtcatgtcacctgggacaccttaaggtggattcttaggccagatccagaaccactcatcagagtcttagggataaggaatctgcattttgctaactgccctggattttgcaggccagaggctgagagccactctctaaagcttgtgctcgtatacaggccactaggcctcagaggtgggtctcttggcattctccactctgaccccatgggttttcctcacaccccaaccttccagccaagtgagcctctcgctttccctgcctgaagacctcggtttccgccatccatctccatgctcctgcccatgctctagcccctccagacccctgcacagtttgtaatggacagaatggaaacacatctttcttcacacagcagggaaagtgtttccctgtcctgggatccttgcagagtgacctgcccagactctatcaggggtggagggtgagcggtttctggagga

SEQ ID NO: 125333 - DNA, 1022 bp, Homo sapiens
atggggaaagggagaaggagatcaatgtgagcctggtcccagccctcaagactgtgctgaccacgcaagggtgtggcctgggcgggaaggtggtggcccaggtgcagcatgtcttgccagcgctctgtggccaccagtgtctagaggtggtggagccagcagtggcgctcacagcctctgtagcgctgtctcttaccatgtgccttgcccttccctgaaggagaaccactgtcgccgcatcaagattctcggggactgctactactgcgtgtcgggcctcacccagcccaagactgaccatgcccactgctgtgtggagatgggactcgacatgattgataccatcacgtaagtaccccgtggggctgagaggagtggcctggggcatctacacattgaaatcctagaagctgagccaccttctgccccatgtgggctcccctctcagggtctcgctttgtcctgatgggtctgtctgaggctgcagagaatgatgccagcattaggaggatgctgggttcaggaaagcatgaaaggatgcttccgtgattccctgcctttacatttcgtgtgtggctgtatttctttgtccacaggaatcctgcatattgtcaggtatgcatgagtcatacaaaaataaattagtctttagcttagccagataagacatacagaaaggtttggccccaatctagctgaattctctattaaaaggaagtaaatatgtgtgtttctcttcactcagcaaggtaactgggtctcagatgctctctgtgtggggagacaggcttgggatcggggcaggtgagtcttcatggaatgaatattacacctgtgaggccaggcctgcccatttcttggtcagtcttatgttgtcattgtccttatcagagactgggatgaagacacagatgtttttgtcaagttagggaaggtgtggagctggaaggctgagctaatgtatggagtgtagatccaaacaaacatctcaaaatgtggagaggtgggtatgctccaatgag

SEQ ID NO: 125334 - DNA, 1033 bp, Homo sapiens
atctgcatctggctggcaagcaggcatgggtccctgcgagggagcagtggcctcacagagccttatgttaatctgaactgtcctgatgccacactccacagtaatgaccaggtccacctgggatttggggactgccctggtcagggagggccctctaggaggccatgaatggaactcatgagtctggtgtggacatggtgcgagctggctgggagcatgggccagagccacccctcctgcctaaggccctcagcccacaggtgggcaggaaggctccatgtccactgactatgccaggagacctccacgctcaggccacatgcagcaaggacaagacccagtttccctggtgctcacagcctagcagtgcagaccaaggtggccccctgggaggatacaaggtgggccctagccccacgctctgtgtctgtgttgcagatctgtggctgaagccaccgaggtggatctgaacatgcgtgtgggtctgcacacgggcagggtcctctgtggtgtcctgggcttgcgcaagtggcagtacgacgtgtggtccaatgatgtgaccttggccaatgtcatggaagccgctggcctgccagggtaagtcggggatggggtggggaggggagggaggtgggtgatggctgtgcacccctgggctaaatccttgcttcaggttctgggctgtgctcttgagggcacttgtgtgagtgctcctggaggagcctgcctgtcccagccgcacctgccaaccagactccctgtggtgggcgtcccacccagcctggctgccagtctgtgctgggcccagctgagcctggcgcacatctacaaaaagctgtcattggaccagaaggccagagcagatgcgtgtggggacctctgcccatggcatggtgctgtcctcatggcttgttgtcactgcatcacttctctttttgctgtctttgatttcattttctcaatgtgcaaatggaaagtgctgggactttagagctccttctccacccccaagctccacacagccatctaggag

SEQ ID NO: 125335 - DNA, 1097 bp, Homo sapiens
tcagctgggtgcactgcccagccctccccatcctccccatgcgatttctttccttgtctgtagaaggggacatactggaaactgaacggggtaacaaagaccttcattccaagccctggttgtctttcctgaccagggcctccagccttcccccgcactttgcttcaggattccgagcatcacgtaggcttttagaggcctttggtgcggattgagaatggaacgttttggacgtggccctcccaatatggttttgtttgctgctctattctgggcacgttccccaatgcctggcttgaagtaggcgctgagcaaatgaatcccagtgccctggggtggctgtgtttgtcaggatggcattcccagtccgagaggcacaatgtgtctcattcacagcatttctccttgccccttgtgtgtttggacagatatttccaggcctgattctctcagatataaaaccggccaaaaggatgaagttcaagactgtctgctacctgctggtgcagctcatgcactgccggaaaatgttcaaggccgagatccccttctccaatgtcatgacctgcgaggacgatgacaaggtaggagcagccagggagcctgccatgctggagctgccagggactgatctctgtcctgccctcccaatatggcccccgtgccatttggctagatcagaattccctgttcacatgtggataatcttgtaaatgctgctcagagctgagctactttttatttcctgcaaaagtcattatagtgtacttttttactccttggcattctttgtatttgtccataatccatgtatttattcctgtttatccataaattcaagctaaaattccccacctgctgtctaaatggcctctgagggtattcattctggacagatgtgctaggccctccctccttaggtggatttcacactaaggctggccctacccacctgtcatccttgcccccagcgtccaagcctgtgcctcatctgtctgtgcctgtgcggcttcctggctccctctctatgcaggagctcgctgcctgcagatggccttcctctgttactctcggttagcagcccagccaggacgtcc

SEQ ID NO: 125336 - DNA, 1050 bp, Homo sapiens
cctcatgtgacatatggaagctgtggaggagaggctcactctctgttcccatcagccctggccagagtgagagactggtgaagccactccgtttgccaccgtttctctctcttagaaggagggggttggactcctgctcttgtaactctggggaatctctttctgcatgtgttggggttttatgagtttaggaacctgctcttactgggatgctgttctccccactgcaaacgtgtttaatcacctaatccttgctgccatgccatcactcaggggccataaaaccgccattacaggtgtgggaaccccaacactggctgctgagatgactcacctgccatctcaccaccagcagggcagagtcatgattattaaatgtcagattcccaaacccgaccccaccctgcagcggatctggctggagggagagtacaggtgcttttcttcaataagtggagaatttgatgatactcctttatttccatgatggctccagcggagggcattaagaacagcctcggaaaaactcagaaaccgctcatctttttctaccaacgttgtctacaccaccccgggcactcgcgtcaacaggtacatcagccgcctcttagaagcccgccagacagagctggagatggcagacctgaacttctttaccctgaagtacaaacatgtcgaacgggagcaaaaggtaagcaactctggttttcggcttccctggtgctgcttgcgaaggcgctgcctggctggaggaagccctcagccctgatggattgacttctctcttacacagtaccaccagcttcaggacgagtatttcaccagcgccgttgtcctcaccctcatcctggctgccttatttggccttgtctaccttctaatattcccacagtgagtatttctatcaacgaggtgaggaactcaccaagaagtcccggtttctggggttcgtggttgtgtttctggggttcgtggttgtgtttctgttgtatgctcaagcttcgtctcccacagttattgtcccaatgtgcccaacatggctgacattag

SEQ ID NO: 125337 - DNA, 1141 bp, Homo sapiens
agccagagtgggaagtcaggcctctctgggaaggtcacaaggcctggggttgttcacaccacaggcacaatacagagctgtccactcttgaactggaccgtctggggagaattgagaagctgcctctcactgcatggatagtggtggctgctggctttcaagcgtggttttttgctaagagccagaggcaggtcttctggagttctcaggggggccctgtgaccccctctccacaaccatggccagcatcggcttcttgctgcacctgtgcattctccacccctccgccaatggcttccagctcctaaaacacctggacattccccatcctgcaccggcactgtgtttgttcagagaaaacgaagggtgtcatttcttcttttccctgtggcatcgtggatcctttacatttagcaacaacagtgtgaggctccacttctgttgaatatgagcggctgtcacacccatgagcaagtttccttgatggaagatgctgtttctccggcagaaccaaccctccaggacgaagtttcagaattggctgatggtcgtgagtgcaggtgtccctgttgtaatttgcagggaaattgactgcaggtgatagtgttgacgtctgacgtctgacaacctcctatgtgcatgtctaaatagtcacaatgaagatgaaaataaggatgatggggacggggtccaggagggccactgggaaggcactatccagaaatagtggacagaggtctggcatgtggaaaccttggatctcggtcacagggaggaaggcagctagaaatgggagggaagcttctgggtaggcaccatagtaggggaatgtctaaagacccactgctctgagatgtggtcagagaggtttctgtggactgcagatgaggcctgagccctgcctatgctcaaagccagcagggttgggggtccgcctcctcactgctcctcaacagctgtaaccctttcctgagggccccgacttttcagaataggagcagagagaagcccagacttccttccctggagtgtagacctgtgtgtgggacctgctccaggctgatccctgtccgcacaggtgggtgatgtccttggctgctgccgtcagaggcagccccctgcacagggaggggctgatcct

SEQ ID NO: 125338 - DNA, 1030 bp, Homo sapiens
tatacagaaggattttttcccttagaaatacatacatacaaaaaaaatttgtcactttccctgtagttgtttattatgctgtagaatttgaggctaaatagtcttttctctctactgtgggtttatcttctagaaatgataaaggattttctatttcttaaaaacaagatttaaagactaaatttgttgatgaaaagactagccaatataaatctaaatggacagagggaaaaaattcaaccggaatgtaatacacatgtgaactaaatgttttctgttgctgacgtcttgtaggcttctgaaatttaatgagacttttacaaggtttaccttttttcctaaagtttaatttctaaactgacttaaatgttttttgaccctttggttatatttaagaagttgacttctctaatttccttgtcacgtttatttttaaatatctttctctttaaaagttgggatactataataaatattcagcaagtattttgcatttaaagataaaatcttcttatttggattttaatactttatattaaatgcctttaagatttattaaaattttaggttaactgaactctgcttttttgtcactggattaataagcaggcttgtatctgacataatagcttaataaggcagtgacaatttaaatttgtcatgagtataaattgaaaaatcataacaatttagaaatcggagattgaatatttcatggcatttatatttagtgttttatataatgattaatgaaaagaagcaaaacttaaattttttttcaaagatggataggttcaggccagatgcagtggcttactcctgtaatcccagcactttggggaccaaggcaggaggaccattgcttgaggccacagactaggcaacatagtgagatcctgtctctacaaaaatttaaaaattagttggggctgggcgcagtggcttacgcctgtaatcctaacactttgggaggctgaggcaggtggatcacctgaagtcaggagttcaagaccagcctggccaacatggt

SEQ ID NO: 125339 - DNA, 1508 bp, Homo sapiens
ctgcttcagccacagttaccatgaataaatgatctgtctttataaaggagagggaggtgaattcaagatattgagatgttagatttgactgggttgtcctttgactagaagatcaccagataaagaaaatgtaaactacctaaaccagataagatgatattgttaaaaattttttttggcccagcactttgggaggctgaaatgggaagattgcttgaacccaggagtttgaagctgcagtaagctatgatctaccatgcactccagcctgggcaacagagtgagaccctgactaaaaaaaaaattttttttcctttggttctcatgatttcacactgatgaatctgattgttttctctgagtcattttgcctctctcatgttattagggtaacctgataatagacatgttatcttagttatgtggtatgtaacagtgatcttctaaatgatgtgcatccatcactgatgctgaggatgatcagaaactattacaactcttatttattgatgtttacttttaatctacagataaatgataatacatattaatacttaatattcagattgccaataatatatatttggtgggtaaatatcttttggatctgcaaaattttcactgatagtttgtatcaggatcaaagcagtttcaagaacattaatctaaaagataagactttggcatctcatttctctaaaagataagtcatgcatgtccacatctcaggcaatttttttcagttttataagttttattcttgataataaaattcttttaacagaaaactcttgattgctatagacctctgctgtgtattcagtagtcactagccacatgtggctatttaagttaattcaaattaaataaaattaaatatcagttccttatttgcactagtcagattttaaggagtaagtagccacatgggcaagtggctaccatattggacagtgtggatacacaacaattccatcatctcagaaagtgttattggatagtgtggctacagacttttcttgctcagcaatcttagtctccgcatgttagtctcttcatgcattaggtagcatctataaaacatgccaaaaggaaataggctatctgtaaaagtgtcccaaactttttgtcttgtaaattagcttatcagcatacttggagcctcttgccttaataaggacttgatataaatatgtatcaggagaaagcctatcttatgaaggaattattccctttttatttgaatccgtgtttgctttatcttgggctcctgaaaactgatactttgcatttaatagcagcatatgcccaggatgaatgataatacatcttctgatacagagcttgaggttacagaatatcttaaattgttccaggaactgttgttatcatttaagtccaataatcagtaaggtttcaccctaccagaatacacttttttttattaactgtctggacttttgctgattacattgtccagaatgtggagtatcgcatttgagaagagg

SEQ ID NO: 125340 - DNA, 1079 bp, Homo sapiens
gtcttcatgccctagtctgcagcccaggcattaagaagaaaccaaggaaatttaagaaattactcaaggttcttagaaaagaagtataaatacgtttatttacatgttcttagagtatttacattcttagtatctcttttatctcagtatttccttgaaaaagaaagcaagctaagattaaaagaaattgaaaccaaatcctcgcaggtagggacctcctctgtgaggctctgtgctggaccctgggaatgtgtgcttcccaaggtatgaaaccccttggggaactttacagcaggacctcagtgagctgtttggcaggtgaggaaactaagacccagagaggagagggactttcctaaggccctggtgagtgacctgccagtagccacttccaggggagagcagagcatctgcagccaaatcattgcagccccaggtagctttctagaatagactgtggaccagatgggccacctgagctccctgctagggttacacattatagccctgtttgttgtagtagagaaatttcatgactctcaattgtggacttaagccgatgcctccagaccttggcatggtccacaggccctgggagcatgggctctgaatgtagcctttgatccccatagcggtcttacagcccctccaagttcattctgaagaaggaatggagtgagaatcctggctgcagatccagtcttgaatttagtcatatacttaaaattccaattcaactgttaacattccagcatccattttaagcatcagactttcttcatttagcactttttattataaaagggagatctgctggagggggatttctcctaccccacccccacccagggaaggaaaagctctttggcacttagaagtctgagccgtgagtgggactttggcattgtctgcatccatgtgctgctgtgttcacccggggtgaaaaggactcacttaggcaggcaccagcaagatgcacagggtctgtgtagaccttgagttttagagatgtaacggggacctagaaaacaagccaccaacatgcttgcatgattctgagcccctgaggcaaaacgctt

SEQ ID NO: 125341 - DNA, 1041 bp, Homo sapiens
aatgaataaaaacatgtattatggagtaaataatgaataaaaaatgggataaattaaatgtgaaatgggagaaaaactggcatttgtgtttcctgccgagaggaaaaagccagcaagagaagctccagggaaaggtggagcatctgagtccctgaggcagttggaccactgtccctagtgctggatgccctgctgaaaatgcagcattaacccctttccattccacagtttctttcacctagcatgggtgaggcccggatcagtgtttctcagaatttctttgagtttccaatttctgtttccaggatgggaggcattcacaccccatttggtaggtaaaagagaaggagaaactgttttcctccagcaccagcatcaggaagcagctgaggttattgattgtggctttcaatgatgccataagtcccattgctaatcatcccctctggcactgtgagaagctgaattattggtattggtttccctacaatccttgtatattagattttttgaaaatggccttttgacctttctcccacagacttcccaatagttatatacaacttaactgactgtattaaatatatctttactaaaaatatctagagaggcttctgtttctctaaatgagcactcactaatacagtatttggttttgagataaatttggagataataagaacttcattaatgggaattcaggactggttagctaaccaagttggtgttgaaggcagaattaattttatccagtggaaaactagacactggcagttgcaaccatatgatcacattagttataaccttaagttgcctggaataaagcagtaatggaaaccttagaagaaagtgaccattgtagtagaaaaattgctatgaaggtgttgaagataaaaggagtctggagtgagcaaacattattactactcaggagagtattaaaaaaaaagaaacagttttgagggtttaaatttccagaacaaggcatggtcaaaaagctagagaatttctacatctgtccctaaaacatcaaatacctct

SEQ ID NO: 125342 - DNA, 1047 bp, Homo sapiens
tgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgac

SEQ ID NO: 125343 - DNA, 1101 bp, Homo sapiens
ccattccttctcttggcaaccaggatttgaggacacatgcttccctcatggttgtttctcaagggcctctgggctccttacctataacagtagttgggtttcatattaatgtgactgttgtccatacccaccctgagaccagagaaggtgccttgggctccacctgggacacgagggtttaatactgctgcagggcgaatagaaagctccctctggctggtgggaaggcaaagccacaccaggcgggtctgctttgctctagtaactcgcttattctctgccttgacatgggagtaagtgcatccttggagcactcactgttcatgttttcagaattaggggcaaaggccatctgccttacatgcacccagcataggccacatgcgcaagttgttcataaacccagtctgcacatcagcaactgcctgtgtgttaacaggacacacctgtcccaatagttgcaactaacatgtgtctcccttggtgtcttccagcctgcaatgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagtgagtgcctagagggaggcaggagccgtccagcaggggcggggctgtcacgttcctcttgttcttccctagtgtgagtagtcatccaggtaaatcattagccgtctttgaggtcatgagtcacccagggtctgtctaggtatttttctgtcattaaatacgtcctgggaaccacataggaactcttagcatttgtttgcaaggctatttttcttagaaatcagtaaaataaaataaaaaaagacgtttggcgttttaaaattacacacatacacacataattgcaaatgcaaaaaatcttttaactcagttccttaaaaacactctgatactatgatcagagtccaatgatcttggaacctattgttttaacagagggtcatttcctttcaggtgagcgtatgaccttgatatgtactatttccgttggccaatttc

SEQ ID NO: 125344 - DNA, 1008 bp, Homo sapiens
gaattaataaatgaattgaatgaatttagttgatcataacagtgcatcctaatagcacttgtttttagatattaaaactttctcttctatcttgacttatcatttttaagtgcacttccatcttttaaaattacgtatgaaatgtatcaataactccaaatgttttttaagggtgggtcttcttagagtcaagacttcattcagaacttggagtttgtatctgatcatctgagttgggcatttatatatgaagcttaaattatgactgccttgagcttctttcctttaaaaatctcatttctgaaacacattgagagctgcgaatgtctgctgtccattacattaaccgcgattccaagccacggaaccaggacagcagatctgtcaccagaggagtgaggctgtcacagtgaccacccctcagctagtgtcgtcttcacctggaggattggctgcaggtgtttagaatcagtgcagaacaaccattgtagcaagacggtggaattattgcaatctctgatgacctccagcaatttagtgagttttctttcctaaactgaacttcatctgttgtcctaattcacttagagtcctagactcctggatgtgcaatgttctttgagatgatcatgtccaatttccccgttataaagattcaggaagctgaaactcagaaatattagcagacaactcacaaagatgggaataaacttgtaatgctctccagtttaatccctttttttaaatattaaggccattatgcctttgttccaatctctaaaacaatttctatttgtgttttaagcctcggttcttaattgtttcttgttgaagcagaggaatataatataatcctgaaaagaaagacttacttcttttcagtagccttctaatagatttcccagaaatgttgcagttgcattttttagcatatggtaggtatacttttttttttttatagagtcttatatgttctttaagttttaaaaatggaaaataaaagaaaag

SEQ ID NO: 125345 - DNA, 1992 bp, Homo sapiens
tgagttcatccaaattaaggagagaagaggagattctacttcactgacagctcccagatagctttacatcatggattttgatgaaagatttctatagagcaaagattctgtagtttaaaaatataaaaccctcagacaaagaaggcttcagggtcattgacatttaatttttacgtttctacggaatgggcaaaatgttgatgttgttgaacttagatgatggatgcactgttctttttacttttatgtttgttaaacaatatccataatgaaattaaataacacccacagcatgtcagggcgatgtgaccgtatgtcccactttcctaagcagtcacaacttcacataaaaatggtctaacttaatatataggtaaatgtgatttacttttcaaagtgtcattgttcatatgactaattcggtgattagaaaaatattttgttaggccttgtcatctctacttttattcagaatgtgatcatggtttctatgggccaaattattgtcccaaagagaaactcttgactctgcaaaaccattgcatgtcaccatctgggaattctgtcatcaaattgtctaactttgtcatgaggattcttggtcaggagcaggactcatttctgtattttcttgccccttcctacagatccattggaggaaatagcagaaagttctccccagacggcagccaattcagcagctgagctgttgaagcagggggcaggtcagtaaatgcagctccatttctacatctggtgactggggagaaaaaggactcactgacacaacttccttttgcacttcagtattcaggtttcctttcttttctgtgagccttgaaggaggtttccttttatagaagcttgcacagagctgggtggggtgcagttgttgggacatcagcaaggccttcatgggccggtctaactcaagcaagactaaattcagtggaataaatgtcaagccctggatttagtttgggggaaaatatagtaagacaggatgtgggtgatctgtctcggcaactgtaaatgtaaaaatgttccagagacatgactcaacaagtcacttgacatgagtcaatgatttgacccacactgccagcaaccccagtgagacatacaacacccaagaaccagctcgccagacagagcaggtcacttaaaaaaattattcatagagtttcttttttagagcagtgacagattcacagcaaaatggagaagaaggtacagagatacaccatatacacgcatagcctccccgctgtcaacatcccccagcaaagtgatgcacatgttatggttgatgaacctgcattaacacagcctcgtcacctgagtccctagtttagggacttgatatttaggttcaccttgatgtcatgcattctacaggtttggacaaatgcataatgacaggtaatcaccgttacagtatcatagtgaatagttttattgccctaaaaatcctctgtgccttttctgttcgttctccctcccccaccaaccccaagcaaccactcatatttttattgtctccatattttcaacttttccagtattgtcatatagttgaaaccatacagttcatagccttttgaggttggctcctttcacttagtcatatgcatttaagtttcctccatgtgtttttatggcttgatagctcatttttttttagcagcaaatatttccttgtctgggtgtatcagtttagtaacccattcacctactaaaggacattgtgggtgctttcaggttttggcagtaatgaataatgctgctctaaacacccatgtgcaggtttttgagtggatataagttttcaactcctgtgcgtagataccaaggagcgcattcctggattgtatggtaagagtgtgtttggttttataaggtacaggcaaactgtcttccaatgtggctgtcccattttgcattcccactagcaatgaatgtgagttcttgttgccccacatcctctccaga

SEQ ID NO: 125346 - DNA, 1041 bp, Homo sapiens
gagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccaggtaggtgtgtttccagctggttggaagggcccctctgtccattcactggggaagggaagggttcagacctgcagctgagctggcatatctctagtgctgggctgggcacctggagaggaaatccagagccgttggggtacttttccattttcctcgtccaaaaccaagcactggctcaggcttttcattcactcttcttggcttctgtgtttggccaccttggattccttccagttgtagaaagtgcagacatttgcagtggttctactttccatgtcacttgggaacatggctttttgtaaataacaaattccttgtcaaattaaattaattcatccaaaacgtcattatgaaatatttcaagtgtataagaagcagtgtggtctatgggttgaacaacaccaaccttaccctctctttcctcactaccttcctatgtattcttaaaatgtattgcaaaggctcaatccaagcatcctgttgttctgttttgtgttataaaacagtcactgcctcctccaactcagtcatttcaaaggcagggttccctttccttagaacatcgctcgcttgcttgcccttggcatgggatttggacttctgggatcacagcagatgagaggttgcaagaagaaaagtgcccatcatggtcactgtttttaaattttgctttacagatagtccaggtgataaacttgtgatcgtgaaatttgttcaaga

SEQ ID NO: 125347 - DNA, 1045 bp, Homo sapiens
ggaactggtctgacagagggaactacacagccagagtgccccagagttggtgctaattgaatgataaacaaagccactttcatgggaattgctgggcttgctgttttctgggacaagcactgtgataacaggaacaaagtggattttattttccttcagcctcttctcatttggtgaaattcccaggcgccatgggagtgcattgagggcttctgagtcatggcatggggtcttctagagccttgaggcacggggactctgtaaacagggatgtgaagcaccagggattgcccccgtggctttgtgggaaccactaagagcaatgtcagtcatagaaacaggtactgcatgctgtgctgggtatgtgctcctctcttatatgactctttgaaagctcaaccaaccaaccataaggtgggcatattaaacttgattaataaacttttttttattccaaagttctgtgctgcttcttggcatgagaccctaggaactgatcaaccaactgtccacctactcctctgaaccagacccctgagcagtatttccacgtcatgctctgaacctctccctctaacctctaagcctttgctagttcattcattaattcacaatgtgaatgacatggagctcctacaggtgccagcccagtgctggggacacagcagtgaatggcaggagtggcccctgcccaataagcaaagaacccatgaggtggttttgtcagaatgcatgccacccatccttccaggatggcattcatcaaatgccacttgctccaggaagccttcagatgaagctccctccagatgaagcaagtctccctgtgggtcctcctgcagctcaagagctgcacctcacatgttcctccatgcagtagtaatttgcacatggtctcatctggctgacacaagcaggacacgcaggcactccctgtttcgcttttgtttctctcttccgttctccggctggtgtaggccatgttagtggaaaactggtgcccagcaaagacattttattttttatttttattttttaattttat

SEQ ID NO: 125348 - DNA, 1114 bp, Homo sapiens
gctcactgcaacctccacctcccgggttcaagtgatttctggctaacttttgtattttgaatagagacggtgtttcacaatgttggccaggctggtctcaaactcctgatctcaagtgatctgcctgccttggcctcccaaagtgaagataaggactttaaaaaaaaaaaacaaaaacaaacaaacaaaaaaataaaactaatcactactgaggaaactccaatacaaagtcttgcttttctaaattagaatttaaaaattcctagctaaataaaccctagaaatcatctaatctgatcccaattgaagtgagtctgtaaatgaagatcctgaaggccccaggggttgacaatgtgcccaacaccccatggtttatggcagaagagctcaggctagaacttggagatctgagctgtttctctgcagcagccccaattccccgcctagaaatgtaatggaagaaggatacgagagatttgatgttccatttttttagaactctctcaaataatggaaaaagatacttcctatttaactgcataataatcccgggatgtgactaggagggaggaaagaatggagagagagagagagagagagagagagagagagagagagagagagagagagaaatagttagttaggtggatagtctcacttacttctgaaagtttattgtgaatatgactgtgtatttatgggccaaagattgagactgtatttttaggtagttaacaaaactcaagtttcttcacttggataggagactataatattgacctcagctaaatttattttatttttcattaaaggtgatataaaacattcaaaggcgatttgtagttactaattgatgtatgagtgaataatttttatgccttatcaggaacacgggaaattgggaacacaggaaaatgctgattttgtttttaatgtcacatgtcctgattttttgctaagtaagttatggttcctgaggatgaactttgatgtttggatccctcatgaatgtttaatatgtctgacaactccttacacatttaggttgcaggttttggccaggctctaaggcttccgaagagcgagccagtggccctgcctgagccccgtgggt

SEQ ID NO: 125349 - DNA, 1106 bp, Homo sapiens
gagtctcactctgtcacccaggctggagtgcagtggcgcgatcttggctcactgcaacctccgcctcccgggttcaagcgattctcctgcttcatcctcctgagtagctgggattacaggcatgaactaccacgcccggctaatttttgtatttttagtagagacggggtttcaccatgttggtcaggctggtcttgaattcctgacctcgtgatccgcctgcgtcagtctcccaaagtgctgggattacaggcgtgagccactgcacctggcctttgctttttttttttttttttttttttgcccgttctacttcactctcatgtgctttcccattggtttgtggttttgctgttgcatcagcttccttctataggtcaaggctatgtaatgtacccagaccctggtcctggggctgagggaccagttctgagggatgcttgatgcttttacagttctttagcctttaatctttttgtagaatgccaatgagactcctccttccaggacagctgggagggtcgggaagtcctcagtgaatgttcatcatcaggaaaaccttggtggatgatgggcaggagggaagcttcagcagtgggtccccctccctgaactgctggttagagagaggcttgagtgctgtagacaaggaggtcttttatattgtgttgtgcattctaagtggatggtctttgggggaagaaaacaatgtagagtaaaatcaggacaatttggtctatttgagcgaaggtctttctgaactcccaagtgtttgttccctccttcccctcagagcacaatggttatttcttaaatttatttcctatgagacaggagtaattatgggcagagggacagatgagagcttcaagcattgtccagttctgtcccgggacagccctcttggagagagaaccacctgtggcagagactgtggattgctgtaaattatcttattaattggaacatcacttgttatattggagcaattatagcatgttcaaagctttgctggaaggccctccaaatgccgacacaccctgctggcatttcagtagtgctggtggcctctgtattcgtgagttttggactcagtggaatggagc

SEQ ID NO: 125350 - DNA, 1068 bp, Homo sapiens
gaccatgcatcaacatagttctaactgctgcgcactttgaccttctctcctctacccttctgtttccacttccctgtctttaaaaaaaataacatccaaggcaatcaagctgcctagttgatgtaggatcaggacaggaagcctggtgggtgtgatgcatggaaggtggtcttactgctgtcagacacaggtctgggatggctcgaagtcctgtggtctgatgagaataccatgcccattttgtttacattaggctcacctgagacaggtggcctctccctcctatcaggagggactgtaaacagaatgagtttacagtaagagtcaagggaccagaaggtccccgtcacacagcacactctgccttcttgctccgtcccattgctcactgtgattttaccaggagataacctaagaacgcaggactaagaaatcactggaatgtcaacttctcgttccaccacgagatagcagagtggcctgtggccttccttgagcagtgttctctgtggacatatgattcttgattagcctcaggtagaatggatagctgggtggagaaggcaggtgggtaccgggtcacccaagtaaattaaagttaaacagggttttacaaacgtggagtggaagatagaggaatgagggctcagctggcaggaggacgagggtcaccagtgggatgcctggctttcttgagtgaccaagtacagatagaaaagcttctagaatgctatggaactcatttactgctctgtggaggtaagaaggaaatgggaccaaagataaggcttgcttctggaagatgtgggtcttgggaacccctctttgtgcatctgttgatgggagtaatggatacacaaaaccacacggtccatcatgcttccaagctgactcctccaagtctggtttcccttgatagttttcccagtggtcccatcacttctgctgcctactagatttatcatcacgagaaaagtcccagtttcctttgtagctcatgctgcacttgactggaggaaatcaagtcaaggatatcttggtgacaattgaagggatacaggaattata

SEQ ID NO: 125351 - DNA, 1452 bp, Homo sapiens
gggggtttgattttggaggggcaggtttgggggcatggtgggcaggtcctgccgcttgtgccttgggtgatggctggcctgaggctgaaactaagcctggttgggtttcagcagggaggttgcaagaaattaaagttgggggaggaaaaagtgaaaagaaatgaaaaggaagcaaaccgcagcagtgagcaaggcggggccagggccgtctggaggcactgactgggcaggccgcccgcgacagccagcagcagctcaacaatcccgggattctttcccgggcctgagctctctcggccgccctctgaatgggcctctttggaggtggccgccccgccccctgcacgactccctcgggacaggccggaacacagagccctgcctgggtgggtgggggacgccaccgctgggacagggactcgggactctgctcaccacgtagggctgctggggacacagcccaaggagttccctctgtctggcccacatcctcccaggcccttccatggactgaccagggtcctgggtgccaggtaagctgtacattgggactcattgcttcttcctgctcagtccctacacgcctggtgtcttctgtgctcctggcgcctctggcccggatccagttgcccttgctgaaacttgatctcctgggctccagtggaggggggtggggaggggtatgaggtgggatgcagaggtcactgggccaggaatcctgggcaggacttgggaggagggctgattgttccaagagtccccttgtcacttgatgacagttctcaagtcgccaaggctttgggacaaaacgccccagcccttgagcctggagggctagtccttccagaagaaagtcatgctttgtctttgctgagattcactcagggctaacaaaagcctggtttacagatgtgcagcttttctggaacaggactgcttcctagcacagtgcattcctttactgaaactgataaagcgagcctgccccattccagggctgtcaccgcccccaccccagttccagggcccttgagggatcccgggcagcgggcagcaggaccttcagaggaccagaaggctgcacttctgagcacccagcacagttgtttctactaaatgccgaaagcaagcgttaggatcaggcgctgggttctaaaatgagatttactgttgtctcttctgtggttgaagcaagcaaagagagtatttctaaacgagttcatgtcattgaaaaaaacaaaaacaaaaacccatgcattcactgaaagaacctgctcagattatgttaacagagcttctggacctaggggctttgtttcttcactgtcccttccctcccaaatgtctgaactggggctggggctctgtgggaccctgggagagtcagccaggcactgggggtagcacgggcagggctggcgcctgggcccagggtgggcctcctgggcatct

SEQ ID NO: 125352 - DNA, 1055 bp, Homo sapiens
cattctttttgacacacttgggagggtctgggattgtgagacttgcagaagggtcagatgtcttgagtcactgagagggctgaagaaggaatatgtagtctgcttcttgacatttgttactggcccgggcctgccccatcagagcctttgagggcattaccaaggtgccccccagattagtgtacctcctcaacagataggcattggccaggctgtcctacttaggccaggaaccaccttgttgtctgtttaaattctatcacattttagtgacacacatatgtagacatgttatatggtacatatgtgtgttatgtgtgcaggtatttatggctctgcctagattgaggcatttgccactttctgagcacttcttacaggccatgcacttatatatgcacacatgtagagaaagagcaaatgaacaagtttacaaaaaatcctgaaagccaggcaagtgagaattccatcatttggaatgaaagtaaacttttctgatgcttcagggccaaccaagtgtgcgatgggcgtcagaggtcaggtctccatgtgtcacctggcagagggatggtgtgagcagctcactggaatttgatttttccagaggagcatgagattgggttactgtgaagtcccagtgtcgctgaggttgtggagggtttgtgttttgtgtttgtttttaattccttctccgcaatgcccaagtgagcactccacttgagtctcaagaaccccagagtagagctcgccctggggtgctggccagcacgtaattctcaggaacaaacaagtacattcgaataaagctgaggatctcagtctgcagtgcctggtccctcggaggcattctagtatccctcttagttttgttttattggggcagagcctgttgctgaaaacagaacctgtgggtcaccctgactatccttcccaggccttcgagaactgccttgcatgtagtagagagactcacagtttgcaggagtggcaccgtctttgaggcagctttcacataaagcatctgaagttcctttgctaagtcatgtgcccagtcc

SEQ ID NO: 125353 - DNA, 1237 bp, Homo sapiens
aacaaatgaataataaagacatgagaaaaggtttcctttaaaaagtcgtggttctcgccaggcgcagtggctcatgcctgtaatcccagcaccttaggaggccaaggcaggcggatcatgaggtcaagagatagagaccatcctggccaacatggtgaaaccctgtctctactaaaaatgcaagaattagctgggcatggtggcgcatgcctgtagttccagctactcgggaggctgaggcaggatttaaatactgtttgaacccaggaggcggaggttgcatgagccgagatcgcaccactgtactgcagcctgacaacagagtgagactctgtcaaaaaaaaaaaaaaaaaaaagagtcgtggttctgatacatctcagcttccaaactatttcataattttttaaaaatataaacacataacataaaagcatctatttgaaggtgaacattgcaccagcattcagtagatttacggagtcatgagaccatcgcccctaggtagttccagagcatccttatcctataacagctttacaagtggtattcagagggggtttggggactttaggcttcagtgaaaaagattagcagttaatgttagtttacttcaagaggatgcctttatatattttgcaacttctattttgtgttcagttcttctggagagtagggtgtaggcattttaggggcctggcttccaagcatgcagcctcttctctgctgtcgattggaggttttgtgaagggctgggaggattgcctccatccaagtgccagtgcatgagactgatcaggagtggtagcatgtgaagtggtcctcattggctcacaagaggggacacaggggtttggttggtgctgtgcggacttcctggatttggtaggtttcaaagggtcatgatgtttgccacagggaggaagaaaagggcagtaccagtggcactggtccttaccctctgtagctctatgatcttgaacagtttgcataacctctggaagcatcatttaaatctaagcaaaataagaatgtgtgtgccatgcatggtattgggggcagtcttaaaaatgaagatttcagcctatgaatatgctagtgtaacaaaaatttgtcttaaaatttagttttttaattcagaatgcactttcttattgaaatagtttcagagccccagggactgatagagagacacagcgtgagaagaggacaagaggaagacagagacagagagattat

SEQ ID NO: 125354 - DNA, 1054 bp, Homo sapiens
ccatctttcagtgaaatgctactctgcactctacacttacagggactatgtatttatagtttaaatctaaactgtaggggacagtgttgttgggtttgcatattcagactatgtcatcaatagaaacattcctcttttaatagccggcagcaggtttttcctaactgccaaatgataagaatccctgggaagaggttttagaaaattagatcccagcccgacccccattttcaccaacacaaaaagaacagaatttggtcaagagtggggaccccagggatctgtgtcaggaataaccgcctgtggtgtttctggcaaggaaagattgggatggtgaatatttattgttgatgcttgaaataataggttttttccctctccagaatttctcattgctaagattcaaattatcatagtcgggccatgctctgcccaaggtcaccgcaggtgtgtggtcctcagggcactctggtcctgacaggacaccaggggtggcatgtgggggcctccttcccagctgggtcatcgtcagtcccacccagcattccatccgggcactgtcctttcccagcactgagagtgagtctgggtgcttggtcctatctccaagtggcctgttctggaaggagcatgctggcctggggaagctgcacatttccaaggctgtggccttgttcatccctgagagtctgagaatgccctgggtttcccatcagctgccttcagcaaccacagcatcttcccagagcagtggtgaccaggatgcagcatacagcacctttgagaagcagcaggcaagatttaaggaaggggcgcctcactccgccttgaggaagcgccctgcagcctgcttgtctcccttttaacaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagaggtatgtgccacagcc

SEQ ID NO: 125355 - DNA, 1050 bp, Homo sapiens
tgcatccccttctcacgaggcccctgggtgcccccagtcaaggactggctttcctgctctttcctcagagcacgtgaggattccctgtcaggaccgtcccccaccctgttgtggtggctttggataaggtacgtcataggatgcacctggggctgaggccccaccatccccagctcctcctgtggggccggaatgactgagcgtcctcctgcctcgcaggctcggtgtccttttgcaccctgtggtgaatcccagatcccgctgggcgtggcggagtctcaggtgaccctgcgcaacttgctggctgggcagccctcagcacgtttccttatctgtccttgacgccggctccacccgtgaataacagtgagactgctaaatgaggaaacatgctggtctttgggagtggcagtgtaggggactttggggcatgtgtcccattttatactcaaggtcacgtggttcccgaggctctgggtgggtagcacccagtgtctggagggaaggaggcttgggcgaagacagctaaatgcctggtgtggggactgcccaaagagatgggcagcgtccagtcatgtgacctttggagaccatgttaccatgtcatgttttggtggacaatgagcgtgtcaccgcgacaagaggggcacaagactgtgtaaagaaaaagccactgcctgtccctccctccacagagaccccagctgcatggagtgggtgaagctgcacatcacctgcagatcaccggggtctgtgttcactgggggtttcaaggggcctgagatttctgcactgagtactcatgacctttgtaaggagaggatgcaggatttttttttttttttcctggctgggaactggcagggaagtaagggcagctcttccccagcacctgggcctcaggctgggagcagggtgggcacaggtgtgagagatcagggtgtgtgtgccatgggtgcagccagatgcaggtgcccccctgccccaccccagggctttgggagctgccctttgcccgtgaacatccctgtgtgggagcttgggttttgt

SEQ ID NO: 125356 - DNA, 1051 bp, Homo sapiens
ctggcatttctcatgttggagggcttcgttgtgtggacgtatcatttcccttttaaatatgcctttttagaagaaatgccaccacctagccatggacttcagtgtttcccagtggaaagaattttcaattttgcaatctaaaaaatgggattccccccttccgccttctgttgcagttttgccggcgcctacccgttctcttagaatcagggttagacatgaagacagcacgactgagggagggtgggcctgggaggggaaggctcttccctgggttggtcttgatatgtccgtcagaaccctggctaatgatttcctaacacattacgctgtaaaaaactgcaagttgtgcggctctttaaggctatgccctccacgtggaaggggctggtcaatcagtcctgtttcagttttgggagaagactcctaaaaccatttctgggagcatttcagctgggaggagtgttggggcatccttgtcatgccaccctgcctccttttacacactgtctcgaaaagattagtgtgtgtgtgtgaatgagctgaagtctggaggcctcaagctcaccgtgaagcagtctttgcctgttatttgttttcactcctaggaatgcaagggagcttccagaacctatcaggcacacctgtgtgatgtcgcgctttattcctagaagatcacatcaagataaatcagtagcttatggggactttaccttctagtgcccagatagaaaatgaaagaaggcatgttttaaaataggtaatgttctagcatgtcatgagttttcacctgttcttattttttaagttaattaattaatttatcatttgagataggatctcactctgtcacccaggctgcagtgtagttggtgtgatcacagctcactgcatccttgacctcctgggctcaattgatcctctcacctcagcctccagagtagttaggacgacaggcatgtgccaccatgcctggatcatttttttttttttttgtatttttctgtagagactgggtttcatcatgttgcccaggctggtctggaactcc

SEQ ID NO: 125357 - DNA, 1917 bp, Homo sapiens
ctgtcattccagcttgcctgagtaactccctctttgtatgtcatgtgctgggagttggaaggagcctggagagtcccccatgagtagattattggactttacaatacagccgtatagcaaccacaacaccacagcagggtagcagtccctgaacaataggtccaggtcgatgcattaaacaaatatatttgggaaattctgagtttactaaaaaggctctaatgggaaaaaactatctgcagtatcatacctgacttacttcaccaaaccttcttaaaagaagttacttggaaacattaaaatcagaagtcttttctcctggataacaatctcatgtaggtttggaggaggctggaggcatctgagtgtatgtggagaagaggactccacatacttaggttaacatatagtagtctcttggcttaggttaacatatagtagtctcttgaggttaatatgtcttccaattgattgaattcaatccttagtgattccctgttcttgctgcaaagaaacagttataaggcctggaattttcgaaagccacatcatattatccaccctcagtttggctgtttttaaattacttggtaaactcattactttatttttttatttatttttttgagacagagtctcactctgtcgcccaagctggagtgcaatggcgtgatctcagcttactgcaagctccacctcccgggttcgcaccattctcctgcctcaacccagtagctgggactacaggcgcccgccatcacgcccggctaatttttttgtatttttagtagagatggagtttcaccatgttagccaagaaggtctcgatctcctgaccttgtgatccgcccccctcggcttcccaaagtgctgggattacaggcatgagccgttgctcccagccaaactcgttactttgagaacactttttttttttttttgagatggagtcttgctctgtcgcccaggctggagtgcagtggcacaatcttggctcactgcaacctccgcctcctgggttcaaatgattctcttggctcagcctcccgagtagctgggactacaggcgtgcacctccatgcctggttaatttttgtatttttagtagagatggggtttcaccatattggccaaggtggtcttgaactcccgacctcacgatctgcccaccttggcctcccaaagtgctgggattacaggcatgagccaccgcgcccagcccaataacacattttgattttgattttagatactctttaatgcgttttattataaaagttatttaattatcattttgaagtctaaggactttcatatctcaacaacagaccagtaaaattcagtgcatatttgggtattgacaatacaaatttaaagtatttattaatctattcatatttgacaggcatctggggccattggtccatttttttcatagcttcagaactaaaaagatgtcagaagattaggtataagcaaaactggttaccagtctccccagagctttttaaaattgggaagtgaccttcttgtaggaaccctgccacacatgagcaactgtccatgagcagtgatgaatggacactgaagggttagccgcagcattggaaacagggcagagtgagccatgcccttcctgggagctccgcttcctcttccaggacgtgcctcttgtgctaggtaagcaccaagctgggagatggagcaagccttgagacttgcacttcatttagtgtcaaaagcctgcacagtgtagaggtggtctctgaacagcctgcatggcaggcttttggatctcagtccaagactttctgacctgatagaaatcccattaaaagatgcttactgggccgaggcaggcagatcacctgaggtcaggagttcaagaccagcctggccaacatggcaaaaccctgt

SEQ ID NO: 125358 - DNA, 2018 bp, Homo sapiens
tcaaaaggtgaagaatcccagagttcaaaatgacaatttgttttgcatggaaaggtagaagtgattctagcacctgaagatgtttatttgaatgccttttcattggcatcctccagagtatatatagaactttgtgatgttagaggaatctttgtccttgtttattgtaagtcatattttgaatccatttatttgtttagacagatgcacacgcccattcagagggtgtgaggctcactttcatccctgactgaaagcctctctccggttttctcccccgcagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggtgagctgggtctccatgggaggtgctccacgggaggtgctccacgggaggctaatgtgtgatgagaaatcagcctagtaggttagcttttggcgaaatccacaagggagggacatttcccttgcagtttcaactcttgtgaattttggcctaggatccaaatgctgtcatgctggtgtggtcccttggtaggagatttggaggatgggaagaaccaggcagaagacttgctgttaacgtcagtgcaggggcagggacagcatgctctctgctggaaagggccggtcatgcctccattgcagaatgggcttaacagtgaaaccattcttccttcgtgaatgttggtggatttacaaagaaagcatacttacttctgtccctgcggtataggtcagggctttgtggaagaatgccaggtacttcagtggggctgaaggttggggatgaagaagactactgagccctcagacagctttgg

SEQ ID NO: 125359 - DNA, 1741 bp, Homo sapiens
tctattattattttaagatttctactactaataaaataggattattcataccctccccccaggagagggactatcctgtgccttaccatttggtacagggccttctaatcaggtactgttcttagcatacggggcagggagctagctgaaggattccacctcagactgattaataagcactttttgacagcattttaatttagattagaagaattgttttacaactcattattgggcttttttttaagtcattgtgccaatttattttaactcagatttagggagaagagtgtgggaagtcatatagacttagcagcgtgaaatctgtgaccgtaatgggtaggctcatgctctgggctgagtggccctgcagtgtgtgtcctggctgcccgccaggcgtgggagggactgggctgatggccatacaacaccttccatcgtggggaggaggagtagtttctgtcattctcacggagcagaagccgtttatcagcacctccttctcacacgctgaaaacagcaggaaggatttaccaggttctttcatttgttaaattttcctggtaacaggaaatctaaacagaaaccaaattaaattgatgtttactcagggcctataaagacactcacccgtgtgctatgccatttaattctcaggtcaacctttacatagaaccatctacccacaccctcattttatagcggggaagctgaaggtcaaggtgaatgcaccagttggtagaaccctaagggtggactcaggatggagctgggatttgaaccagtgtccatctgatgccagagcttcttcaagggaccactctacttcacagtcacctagtgatggcattaacaaatgcattgcattttccatttttgaaattgtagaggtgatatttgcacatgccttatagtttagtccagtctttccagtctttccctttgtttaatttgcacagagctgggcgaaataggttttttagtctctgcctagtctgaagcctggtcactcactgatccctggtcagagcaatgtgagttcaatgccacctctttgtgggcagggccactgacagagcctccaggtgtgtgccctcctggtgctctctgggcaggtgggcagtgggccagcaggagcacacaggtttcagggccagtgcacctgggttctaggcccacctccacctcctagcagctgcctgaccttgggcaagttatttattctctttgatcctcagttccttatagataaacaaggaataacaacataggtcatactgtgagaattagagaaaatgcacgatgctcctgccctgtcaataaaaggtactcagaaaacagtagctgtcactgagactgttaccttgaattaatcccatggcatatgttctgtcatcactttccctgccttgaagccttggtttattttcagcattttatgtagcatttctactcccagacccttcctcccctaggcttgactttaggatgggagtcagggccactgcagacgggcccatacccctgtgtccactctccccactccccacttctctgcgtgctttcccttgggcactgttgaaacaagaagaaagcctggcgtgggcgcgttttcagcaccacaccccaggaccccttgggactctgtcccaacacgttgtcccagtgttttcaaaaaggccagcagctgctgaccatggtggtgcatcaacctggagcccggggctgtgaggcacatgct

SEQ ID NO: 125360 - DNA, 1051 bp, Homo sapiens
aggttctcctcctgcatccgcagctgaagagctatggcatccctgcaagttacttcctcccactctaagattaggttctgaatttgcagaatgagggttgattcagacttccccatgctccctttgagatggaagcaaaatgttaaaatatgttatttaatgatataaaaagatggaaggagcagacgagtggcaggaccccaccttttagaactctgtccttaccccaccacctcctcacagcagtgtcagccctaatagcacatcaggtgccagagacagagtggagacttaaagccctgcagcctccctcatctggtgggggctcctcaccctgcctgctcctaggagctcatcagggcaccaggaaccccacccacaacccatgtccaggaaccacaaatgggagtttagttggctatgtcatttctgtggtctttctacatcacttttccaaaccagaaccatattatcagtagcattctctcatcagttaaggagggtattctttaatgatggatcagcgcctttgggggctgcaaacagcagggtgcgggctcctgtttggtttctcattggcgagactggcagtcagccatgcagtgaccctgcttccacacctctgttaggtgtcttttctagtcatgattctctttttattgctcttatcctgcagcttttgcattgagtcttagaaagcatagcaatggcagaaagtgtttagatgaggctctttcctatgtgcccagtgtagaggtagcagtttcataggtgagaagatagacgatacagaggtcagaagacagatatttacccagccctgccacttggagctgtgtgggtttgagcaacgaaacgccagcctcacaggtggcaggaggataaaggagactggaaatggcagatagcatggtgccatttgcttgcagctgctgtttgccagggctctgtctcattaatctttgtgcccctggttccaagcacactgtggccagataatgttcaaatgttccctggatctctggcccatgcttcctgcttcatgggcaaa

SEQ ID NO: 125361 - DNA, 1073 bp, Homo sapiens
atatgctgtgtgcagtgaacattcacgctgtactcttagccacatcccgcacaaaagacagagagacagctcccaggagatggagcatgtgtggcaaagattttccgcctggttactttgaagaaagcaaaaggaggctgaaactgtgctttgtaagctgcatgggttggtgctggctcctggacgtcagttcagaacactcaggagtgaaggcagaaacctggtgagggactcccaggaggagcttctttctccacctttcagcctctggagttcaaatttcactcaacctgagtgcaccaaaccccaccctcttatttacattgccctggcctttttggcggaatcaaagtccctacatagccaaggagatcttttaccttctacactagtgggaggccaggtgcctgggagggaggtggcacgcccccgccctcctctggcatgccactgtcctgctgtgaaagcctgtgtcaaggaaaactgggctcagaggtgcagactgagagagccgctgggctgttttgaaggaaggtaagcagagagcatttgtgtgtgtgtgtgtgtgcgcgcgcgtgcatatgtgtatgtgtgtctgtgcctgtgtggtgagtgtgtgtgtgcatgtgtgtggcttctgtaatgctacaaagacctgaaactgagctgtgtgcctgctgagatttaccaacttgccaagacttccagaggaaaagagctggtactagccaggaggagagggcgttatggagtggaataatcagcagaacggatgctttaaccgggcaagaaggaatgtcgctcaggacttgtccaggaatgcctttattggtttgcaagctggaggagtcttaacttactgacttctttttggggaagagtcagtgatggtctgacatgctgtttgcaagctctctggccgcctctgtggccagccggcgtgggtggcctcagataaggccaacaggacctcctcttttcctctgggcttgggcccctgtgttttcagttaggagtgcccaaaagggaactgagctgcccagtcagaggcctgagataggcgcctgctgaat

SEQ ID NO: 125362 - DNA, 1891 bp, Homo sapiens
agaaagttatctaaagtccaaagagtcaaggccagggcctcaataaaatgttgatggtttcccaggagaagccacagaaatgccggtgatgagagtgtttgaacctggaccaagggaggcatggacgtttgggggatgggctgggaagtgaggggcaatggcagcccgcagggctggagaacgctgtagccaggggtaccagtttccagagagaaatgagttttgggtgaaagtgttctgaagtggagtgcaggaggcacaggctgccccttcccggcctctaggcacacagctgcccctccagagaccccctgggacgggcctgtctgcccatgtgggtggggaggggcctgacattggagcagggatcacacaggctcagtgtggtggacaggtagggatgtcagctcaggaggatgagtccttggaaagaaagttgggagaggagcaaacggtggagacagtggggggagaatgggtggtcacgggctggagggacctgcatttgttgaaagttggtggtgtcatgttttcaaatcagaactttctaccagaagctatctgaatttagatgtcactttcatgtgtctctccttatgaggaggaacttcacaggaggccctgcgtgtcactttctgacctgcagtccaggtaatggcctcctcagaagccacaccctgatctgtctaggtggacagctttcttttggcctggaaccctgcactagagggtgcagcatgtgatcacagtgtcggtttcattccggtgaccagtgcacagaagagagtgtcttctctctccttgaatgttgtgtgccccaggctcccttgcagaaatcccctgtctacctggggtcagagcctgcctctgtccccagacgctttgtataaaacctgagtgcatgtgcgagcctcgggctggttgccgttgctttctaaatatgcccttgttaccatgtggtttctagcctgagaatgttcttactttttatttgttgagatcagattcatagcacataaatttaccattctaatcattttaaagtatacgatgcattgatttttagtacgttcacaaggttgtggaactgtcgccattatctaattccagaacatcttcatcaccccaaaagaagccctgtactcattagtggtcactcccagttcctcctttcctcagcccctggcaaccacgaagctactttccttctctctgtttcccattccggacatctcactcactggagtcgtgcaatgagtggccttctgtgattcgcttctttcactcagcctgtgttccagctgcattcctgttacgctccatcctttcatggctgtggtgtgccactgtgtggacacaccacactctgcctattcatttgttagctggtgtgcatttgggctcgtaacactttttgtctagtatgaataacgttgcctgtgaacattcttgtctgtgttttggccctaggatattcttatacctctaatctttcccactactttttgaaatttccacatcttttctcatccttctaattggtttcccattctggaattttcttctgcctttagggagtcccaaataggagtggcactaaacatactgccaacctcctgtcccgcttgctattttcagagatattcgggaaactcaacaagtcttttcttcattagctgcacagtggtcccttgaacgataattgaactgtgtgagtccacttatatgcagatttttttcagccaacacacagattgaaaatacggtgtatttaggatgagaaatctgtgtatatggagagtccacttttcctatactcaggttcctcgaggtcgactgcaggatttgagtatgtacagatttagtatactcacagggggtggtgggggac

SEQ ID NO: 125363 - DNA, 1618 bp, Homo sapiens
ttggctcattggcacaatcatttagggtgcttgagctgcaccctggggacctcatgaaccccagcttgagttcagatcacatcagggtgattctgaacacttgtctaaatgccaacaccctctctgtctccctctctcccttcctccttctttgtatctctgtctctaaattacagcatgcacataatcatttaggatagtacacacagtaatgaccggctgctgctttttggaaaacaaaaagctttaagttgcaacatggagcattgagatcaaagaaaagctatcacaatcagttgttaaagtctagaaaaaagagaccatggaattctatttttcggatgtgttccaaaacagggcacattcacgtggtctgaaagggtttaggtgtggcctctctgaggactagcgatagtggtgttcagagctgcggttccacaggagcagcacagggaacacattgaagcctccagtggagccccgcacccagcagcagcagtgtggtgcctctgcctgcaccccagctgtctgcaggcgcctgtgccccagggctgaagttccactccaaagcgtgaactcccagccagagtccagaggggaggccctgctgtgccggcctccgcggagtgtgttccttgccgggaacgtgtgtcccccgctgcagctactttgttttgttttgtctctctaacccaggtgaaatgctaccacaagaaataccgctcggccacccgtgacgtcattttccgcctgcagtttcacactggggctgtgcagggctacgggctggtgtttgggaaggaggatctggacaatgccagcaaaggtgaggcgcggagctggcggccctgtgcttgtgggcagctgcggttgaacctccttggttgattctttcactatcccctttaccctctttccaaaattcagcctactgacaaaattgttcccaaagtaggagaaaatgatcattgatccctgggggaaaaaaattatggataaccaatgaaactgcctatactttctgtatcatggggtgtctttattgcagatttgggagtggtgctgtactggttggaataaaggacaaagtcagtccatacttttccggttaattgtctccacaaatgtgttaaaatacattgtttttttcagatgaccgttttcctgactatgggaaggttgaattagtcttctctgccacgcctgagaagattcaaggtgggtagcttggtggaatactgggtggtccttgctgacactggtgaaaggtgcatgatggctacgctggggctgtagtactagtctcctgcctttgtgcatatttggagatttctgtgattaattttatttaaatgtaggatattggatagtggaacaagaaggcccacttgtgtcagtaagccccagaagtggcgtgacttgctcacaaccactcagccaggagagccttgggcatgactggccattcttgtaggagtaaggtggtattgcattgtggttttaatttgcatttctctgggggttagtgatgtttagcattttttcatgtgtttgttggccatttgtatatcttttgaaaaatgtctgttcatatcatttgcccactttttgatgggat

SEQ ID NO: 125364 - DNA, 1022 bp, Homo sapiens
aaagaggtttaatatgaaacagggattgtgtatgatgaggccgttaggatctcaagccagcaaacaaagttagcattaaaatacacagagaaacccctgaagggagggccacgtgatttcaggcagcagttgttctctgccagtgggatagaccgctctttctttcactgtggagccttaggagtatttgaaagcttgtgctgtgaaaaataggaatcttacaggagaatcatatggggcctggagaggaacctgtttgggacaggccgattcccatctcctgccactctgtacctcctgggcaccgtggcctgccttctcctcccttctggtatgtggagggagctgggattgctgcgggaggagcagtgtgtttgtgtgtagctgctatgaggagcagtggggggacctgggggagcatcctggattcctgaagagggagggcaggacctggcctggaaggaggccctgcgctgggcggggcggtactgacgggaggggcacggtgagctgcggttggggatattccactgtgccccttatgtggcccgtactggagcccacagctccctctgttttcacccaggacactccctgcctgccaggactgagcccacagctgcctcctgaggagtttcctgactcctgtgggcaaatgttggcgcccatggcagcacaggctgcgtgagctatcagctgacatcgtgttgttgtttttatttttttaaatctctggttcccttaaatatttataaaatttgagagcaagactggcttgaattggggcatctcttttccttttcccttccctaaccacttttcactccccatttgcaaggcactagtggaggcagacaggcacatttgaaggcagacagggaaaggtgggtgctatcatctctatcaatgggggtgcatgtgtggatttacccttggccagaaggacctccctctggggatctctacaatatgccccaggttgaagcatttgatgggtggtcagtgtagtgagtgtggggcat

SEQ ID NO: 125365 - DNA, 1041 bp, Homo sapiens
gtgtccccactctcccagtggtgatgacttgaaatcatgattctgtgttaaaacagtaaccctcacccccaaaaaaagtaccctgtaggaagaaggaaaagtagcttttaccttaacactggggtcccccacgcctgggccgtggaccttatcggtctgtggcctgttaggaaccgggccagcgagcgagcatgaccacctgagcctcccgtcagatcagcggcgccatgagattcttataagagtgcgaaccctattgtgaactgtgtatgcgagcgatctaggttgcacactccttaggagaatgatgatctgaggtggaacagtttcatcctgaaaccatcctccaccagtccatggaaaaatcatcttctgtgaaaccagtccctggtgccaaaaagattggtgaccactgccttaaggcatttagttaactttctgaataaaactattttaattaaagggacggaacaaatcttcattcttgattctctttcattctagagcccctcgagatatacaacctggaaattaatgtcctaactcggccactcacttctgagaacccctgtgttctgactataatttgcattcttcacatgatcacaggcctcccagagtgtgggtgcagaaatagaatatttatgtatcattaatagccaaagtgtgaaatacagctggtgcaattacagcttgattaatgatcaaaacaatgatttctccagataattttgattcttatgtgtgttggttcttggaggagattagccattacatttttgccttttatctttcttgaatacaaacaattcatacatttaaaataattttaggaaaattttttatctgaaataaggtaagcttttaaggcatatgtatgactttcagcatgcatagaatcatagaatgtaaagatttcatggccttggaagacccacttctataaggcagtagggtgactcgagaaatagcttttcattgtattataaataccctatacaaagtttttgaggattttcattaatttccctgtaaccccta

SEQ ID NO: 125366 - DNA, 1288 bp, Homo sapiens
tagtgggtcagctgtgcagttggccttgaggtcacaagccatggaagaagcccagtaagaggcatgaatgtgacccagtctcccctgacgcatctcatgaacccatctcctcctcctcctttaaaatgaccccacaggaaagcacacagcatgtagctgagggtgagggccctgagccctccttcctgtcccacttagatgagcacagcacacgactggggatcacggccctgtctccacatccccagttccccaaaggtgcacagagtatatggccgagggtcagcagggccctatccctcctcccttgtcccatgcaggagcaaatggcacatggctgagggtcagggccctgtcctctccttcccagtcctatgcaggcacacacagcacatggctgggattcaggacccttgcccttcctcgccagtcgcatgcaggtgcttgctcagaggtttctattgtctctgaagtacatctgtgccttcaggtccccctggtcattatggccagagtgaccttgccaagctgctagttggttttgaagcagcttggcttcacttcaggagcctttggcaccctttggataaaggtcaaactgtgttgctctgcaggcttctaggaccgggtccggccttttcctgcagcaaccctgtggctccatgcactgctttcccagacctcaaaggccgcaggtgcagtctcctggtctcctcgtcgctttctgtctttctgattgccaaattcctgttcgttctgtaccggtcatgcctctacagacagttgtgcctttctttcagtgtgccggccctttctgaagctctaccaagccatgcagcctgtgtacacctccgggatctagtgagtgctgctgctgctgctgctgctgttgtgggacctggacggctcagggaactgcagctgaccctcagctgcctgtcccgcaggaagagtgtgggagggttcaggtcagagaatgccaagaagccaaagaagagtccagtggggaaaatcctctcgtggcccgtgctccagcatcacgccttggccctccctcctgccctgcacaagtgtctttgggctgtcacactagttggctccattaaaggacgtgggggctggaattttgaggggagagtgggccatttgctttttggagtatggtggccccttggttttcaaggggtattgattccaggaccccctttgattaccaaatccgaggatgttcaagtgtgttttataaaacggcattgtcttgaactcctgacctcaagtgatctacccg

SEQ ID NO: 125367 - DNA, 1324 bp, Homo sapiens
gcaggaagtcataaaacaaacatcgacttcacctagatgcctggtccaggtgcacatggggcactgagaacacccccagggaacaggtccgtcttagccgcgtggtcactgcagcacatggccaggcagtgtgggactcagggtgccactgacaaactggacgagctgaggaagctgatttcccagtgaccagggctgccccgtgctggaaggagggcggaactgctccagaggaggtgactcaggcctctcaatccgggcatttgtggttcctcacttttactcaaaaccagggagccaaaggacccatgaaatccacaatgcgtaaaatttgcatgattaaacatatacaattcatgcattcctctgcctacgtacaactgagggtgagaagtcttgttgccagggtagaaagtaccctgcaggagaggcgtgtgggagctgcctggaggtccactgaagtctggtcatcagcctcacagggtccccacgtctccaggctgagcatctgtcctctgcgactcttgtgaggttttgccctgttctgagagagcagaagagaagtttgctgccaggaagatggaaatactgacatgccctgtttctcactacgaattgtaactgaactgaagcaaactcgcttttctaacattttcctagtgggtggactataagtagggctttccttttttgttaatgtttaacagaaatcttctcttgtttagtttgtttgtatacaaatttaactgcttgaataagggactgggtgtgaattgccagcgtaagtgagagacttttgtcttaacacaaggtccatgatggccgtttctggcttagggtaggatggttgtaggtgctggcaacacagtcacctgccacttcctgcctcagtctgccatggcagtagagagatgcacagattgttaaatattgcggagtttttgattgtttgggtttttcttgcaaagagtacagtactttggtggagacagatatggaaacacagattccatgcaaggtgttgaggctacagtggaggttatgtgggtgaagtggccatggtgagggacctcagggcaggggccacgccaggcagggcaccaacaggcaggacaggccagggaagcgtcagagagcttggtaagcctccggctcatcctgtggtcactgctgccacgtcatgcctcatgaggaccccagcagtcagatgctcctagtgtagaagcttccctcttgaccaccaaatgctcatggaagttgtgtgcagtcagtgttggaagcatgaggccgactcctagaactcagaaaggctgatggcccacat

SEQ ID NO: 125368 - DNA, 2449 bp, Homo sapiens
aaccccagtgccctacagccttctcaagcccagtcctgggagtgacatactggcggggcacaggctggcccacttgtgtcccgagggtgcctcttgggacttcatgggggtgtctgttgactctcctgccctgggttgctccctgcatccatgtggtcctgaaacttgagtctgcctgcttgtcttgcacagagcccacttaaaatggtcttctttatttaggacgtagggtggccaagggacagttttggacaccagccctaccacctgcctgctgagaagcctcagttggttcttctgcaagctgggtattcagcactcttaagaataatatctttagataaggagctgttatttcagatgagaattctgaccctgcactatggctcccactttgagcacagcatattcctgcgggggaaatgaagtctaacaagggacaggtggattgggtgtgcacaggtgcagcaaagggtgaagccccttgtgggagctggtcgctttgaacagccatgagacacatcccccgtcaagtacccacgtggtgtgggctccactgagttaactctctttctctctctctccccttcagcgccgaccaggcccttgacaggtttgcaatgaagaagttttatgatgacaaagtttcagctttaatgcagccttcccaaaaacggtatgtatagatccccaaagccagagtgaagaggtgaatgaaattttacatataaaaatgtgaaaacagaagaggcatctcctctgtcccgacacctaaatgaatagtattcttgggtcatgccaaagactgtgaaggtggtggggagacttgtccctcccagaggttaaggacttagccatcctgtgtgtctgtggtgagagacagccccctatgctgctggcttgcactgacaggtaaagggaggacttgctccagttggcattttcctctcttgcagtgagtgagttttgatttccattattatgttggaacttggttctattggctagaccaggggtcagtgaactatctctgcaacggactagagagtggatattttaggctttgcaggctacaggatctttatcgcaactgttctaacatgaaagcagccctgggcaatatggaaatcagggaatgtggctgtattgcaataaaactttacttacacaaacacattagcagttgcacttggccaattcttgtagctcatcagttccctgaggccacggagtatttttctgtcatgctgcccatctctcccttctctgctcctgggcgtggcccctggaatgagctcagtaagtgatggggaatagtcatggtggggtgcagaactttctccttttgctgcccaccccagcaggctgaggtcaagaacctgagcagggctggctgagaggcagtgagaaggacccacagctggctccccatccaggtgcacttacttcctccacagatggtgacacttagagccaaccaggtagctccatggcatatttcaaagcccacagcagggaatttgtaggagaattgccaaggtgattgccaaatggtgttccgttttggagacaggtagttgcacacccgaccttgtgtatgcaagttttgatgccttgtatctattttctccagtgcaactgagggctatgtcagcagacatgggggtagacgggcagaaagggatttcaagcatcaccagaggcaccttttccttttgtcttgctatttccaatggcatggctctgtttctcttgaaaccgggtgtgttggaggaacatgggctagggtgtaggactgtggtcagcaacagggcccacatgcaatgcaagttgtgtgcagaaaacctagcattttctaaaatattttagttaaacagtcacttgggttttttttttgtttttttttggaaccattaaatgttatttctttgttgaacagtttccaaaatcgtgacattcatatgacctcctgcatggaaaatgaggtgtaaatagggagtaacccatgcagaatgcttggcacacaggaagtccagctgtcgtcttttcttttttttgttcttatttcttacggcaccagcagcttgtttataacattaaaagaatatggaaaaagggggaagatatctcttcattttttttttcttttcttttttctttttttgaaacagagtgttgctctgtcacccaggctgtagtgcagtggtgcaatcttggctcacagcagcctcaacctcctgggctcaagcaatccttccacctcagcctcttgagtagctgagactataggcgcacatcaccatgctcagctaattttaaaatttttgtggagacagtgtctcactgtgttgcccaggctggtcttgaacccctgagcttgaataatccttctgctgtggcttcccaaaatgctgggattgcacgtgtgagccaccatgccctgctcttc

SEQ ID NO: 125369 - DNA, 2014 bp, Homo sapiens
tataggccgggtgcagtggctcatgcctgtaatcccagcactttgggaggccgaggcggggggatcacctgacatcgggagttcgagatcagcctgactaacatggagcaagcccgtctctattaaaaatacaaaaaattagccgggcatggtgatgcatgcctgtaattccagctacttgggaggctgaggcaggataatcgcttgaactcgggaggtggaggttgccgtgagccaagatcgttccattgcactccagcctgggcaacaagagcgaaactctgtctcaaaaaaaaaaaaaagaaaagaaaagaaaagaaaagaaatacttgctttatacatccataaatagtgccacaaaagtgattgataatggggtgaatgtcaccaccatgtgtgcctgttttggctgaggtgttgtttctttgtaggtgaattgctgtcaaatatagttttatgcaagaggtatactagtagccataccattaataattgcacgtgccaggattcagctgcaaagagtgtatcaagtgcccgcattgagtatctataaggcatgctcttgactttcactgacagagagaaggatgctcctgggtgactttcatgtatgactgggcttatcagaattgtgacttgaatttgatcagtagtttcttctcaagaagttagggagctacatattagaggccctgcctttttggctttatatgattccagatcaggggttggcaaatatttttaaaaacagccagattaggccgggtgcggtggctcacgcctgtagtcccatagtcccagcactttgggaggccgaggctggtggatcacaaggtcaggagatcgagaccatcctggctaacatggtgaaaccccatctctactaaaaatacaaaaaattagctgggtatggtggcgggcgcctgtagtcccagctacttgggaggctgaggcaggagaatggcgtgaacccgggaggcggagcttacagtgagccgagattgtgccactgcactccagcctgggggacagagcgtgagactccgtctccaaaaaaaaaagagccagattgtattttacacttttcagtccccgtggtcttgctgcaaatactcaaacctacccctgcagtgagagtgaaagcagccctggatgtaggtaaacagatgggagtggccatgttctagtcaaactttgtgtttggacactgaaatctgaacttcaacacattttcacatggcatggaatcttatcttttcaaaattttttcttaatagttagaaaatgtaaaactaactcttagctcacaagttgtgggaaagtaggtaatgggcagaagtagctcctgggctgtggtttgcaatctgctgttgtaggttgtaagagtatgttctagaaggtggcactctgtggccctgggtgaaggtggcctgtccaatagtttctgcttctcctgctggtgttgctggtctgtgggctgggctgttggtgtctgtggttatggtttgagtgagtccttttccagaacttctgcctgggacagtggttcctttatgtgtaatgagggtgggctgcggcggtgtatgtggagctcaggtgccggcagtgctgccagtaagctggaatctatgtcccatcatgctgagctgtgtttgcagccctgatcattgtcagcccgtgagcaggcaggcgttcacttctgtctgacctggataattaagtcatgctaattgctgcagctcctggcacagttttttccagcctaattgggtaaaatgacaggcagctgctgtgttggtcagccctcctgggcttctacagctgctccagttagcacccactcttactgtttgcacccagcgtgcgggttccctgttgcagagactccagttgcactgggtactgactttcccagacaggaaggctgtgggtaatgctggccttaccaccaaagcaggctctctattgttttgtccactagtgagtcttttcctgttctaattacatctctgct

SEQ ID NO: 125370 - DNA, 1006 bp, Homo sapiens
ggcctcaccactcaatactgccacattggagattaaatttcaacatgagttttggagggggctaatatttaaaccatagcgaagttttctctttttttcggtgatggaattcatcagttaagtgatcaggtcctgggcttttctttgtgggagagtttatattactgattcaatctccttacttgttattgttttgttcggattttctgtttcttcatgattcagtcttagtaggttgtatgtgtccaggaatttatgagtttgttccaggttatccaatttattgctatgtacttgttcatagttttttatgtttctttgtgtcttaaatggcatcagttatgatgactgctctttcatttctgattttgagttttctctttttatcttatctaggtaaagatttgtcaattttgttagtcttcagaaaacccaacccttagttttgttgatcttttctattgtttttctagtctctcctttatttgtttctgctctgacctttgttttttccttcctttgctaatttggggtttagtttgttctttgttccttcaggtacaacattaggttttgtgttttgttttgttttttgagacggagtctcactctgtcaccaggctggagtgcagtggcgtgatctcggctcactgcaacctccaactcccaggttcaagtgattctcctgcctcagcctccctagtagctgggattacaggcacgtgccaccacacccagctaatttttgtatttttaatagagatggggtttcaccatgttggccaggaaggtcttgatctcctgacctcgtgatccacccacctcggcctcccaaagcgctgggattacaggcatgagccaccgcgccctgcctgacattaggtttttttatttgagagttttttgtcttttaacataggcatttattgccataaaccttcctcttacaactgcttttgctgcatcccataagttttggtgtgttgtgtttcaatttttgtttctc

SEQ ID NO: 125371 - DNA, 1167 bp, Homo sapiens
ctgcatcatgtgtatagatttgttaagccaccacaaacaagagacaaaacatttccatcagcatggggctctcttctgctagtatctctttatggtcatactaatccactcctttcatgataattttcattttttaaaaaatttttaaaattttttcaaattttactttaagttctgggatacaggtgcagaacgtgcaggtttgttacatagatacacatatgccatggtgatttgctgcacctatcaacctgtcatctaggttttaggcccctcatgcattaagtatttgtcctaatgctctcattccccttgcccctcacccttcatgatcattttcaacagcaaagtttgggataattttaagactgagtcaacataagttgtggtacatatatgtatgtatattctatatgttgaaatattttgcagccattagagtaacaaagcagaaacatgataagttgcctattttaatactagttaacaatagtagagtatagaatttatgtataatagtatctcaattatgctaaatgtatacagaaaagagactaagggattcatgaaaacattgcagtggttatctttgagtggtggcaggggtagtgacttttcctacttcctggcaactttctgaaatttccaacagtcttacactatttctacgactttcatcataagatagagctccttgtcctcgtcctactgacaaaaggaaatcaaaggaaaagcaacacccccgtgtggccactgtgggccactgtggacttgtgtgtgcctcaggacgctcagagctgcagttctgcaccgagtcactgtgtctttagcacatggtggtgattttctttgtccaagcaccaaacttaattagagttttgaaggtgcttcctccttaagtgctgcctttccaggagattgtctctgaggtgttgtccgcacggtgtgggagatggctggctgcactctccaaactgggattttaacccgagtggggagattttggcagcagcttgggcctaggactcctgtttgtgatctcactggactgcagccccgtccacacaacctgcaccatcagcaactcaaagacctttctagaattgtcaccccagctgcagaagagcagatgagcccctggaagaagaggcatcacatgggcagtat

SEQ ID NO: 125372 - DNA, 1050 bp, Homo sapiens
tgctcacaccatctccgcttcctcctggccccctcccggtgccccctcgtgccgaccttgacacctcagagcagggttgaggctcccactccaggagtcccgcctggaaccctgttcctgctcccagtgtaaccacaaagagtccttcccgccttcgtgcttttgcatttgagcccatgcgtcactgctctgagttgctttctctctgtgcgttccctgaccgcagcttgcggtaccccgtcatgccctgctaggaaaattcaatcttgtgcccctccccacactgcccgctgttatgggaacacagcacagaggctgcacacactgtaaattcccgtagctggccgcccaggtgctgatgtgaacacccaggggatgagtgtccgtcgtcttcacctttttcctagaggatgaatgtctgctgcctccttaccctgtttctgatctgcccactgctctctcgcaggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtgagcggtgggcggctctgggagcctttgggcaggctctgcagcaggcactgtgtagggatgggcactcacagaacactggtttacacatgagggagaagctcaagggcctgggctcacacagctgtccgtggcgccttcgtcctctgtctctctgctgccacgcctggggaggagacttatgtgtctctgtaggtagctttcagggacacacgactgctgaccgcagggatggctgttgccttgtcctgcactcatcagtgaggctggctccccagtgccttgggacatgtccccagccagccacccttgcgctcccatgctgcatccctcgtatcaagagacaaacttgtgactctcctcctgagccagaaattaggaagacaaattaggtgggcacccaagaaaccag

SEQ ID NO: 125373 - DNA, 1943 bp, Homo sapiens
gggttggattctcctgagggctttctcattggcttgtaggtggccgttttctccctgtgtcctcacatggctgcccctctatgtgtgtctgtgtcctaatctcctcttctttttttttttttttttttttttttgggacagagtcttgctctgtcgcccgggctggagtgcagtggtgcgatctcggctcactgcaagctccgcctctcaggttcacgccattctcctgcctcagcctcccgagtagctgggactacaggagcccgccaccatgcatggctaattttttgtatttttagtagagacgaggtttcaccgtgttagccaggataatctcctctttttataaagacaccactcatactggattagggccaccctaatggtgtcattttaacttaatcacttctttaaagatcctgtttccaaactgtcaccctctgaggtcctgggcactaggacttcaacatatggatgtttgtgggaatgcatttcatccattaacagatggtaccaggcattttgtcagtctccagtggggaggaggacggtgctacctttgccagatatggtgggtaataaatcataaacttgaagttatggtcttgattatggaacagatgagtcctctcttccactgccctgcccctccttcattaatcaatcagtttataaatatttatgtcctggggacctctgatgcaccagacactgggccctgtgtggggatatggaggcctgccgtggttctcttgtgggggaatttacattctaggacactccagtggcatagtccacttggggcctgagactgacctgggaggggatgaaggtgcttgcagagaggtttggaggtgccgttttctcctctgctgtgttctctgggacactggtttcataactatccagacacttcaagtctctttacctttgacaagatagtttcttttttggaaaggggataaaatatgcttaaatagaaaaagatggaatgggtttcatgttttgtatgtttcctcttctctgggatgatgcatgtggtcctggaagtcacagcactttctagaggaagtcctagtgatgtggaccccaaagcacatggcatctctgggtgtttatcccgaggcagccactaaggatgttaacattttaaactatagaatgtttctcatagcatcattcataagagtgggaaatttgagaccaaaaaacatgctgttaaagagggattatgttccatctggataattgggtactatgccactgttaaaaattgcagtgcagaagaaaatatagtgatatggacataaagcaccatttggcttttaaataagtatgggcggaagaaagtcgcccgtacttatttaggggtccatcctatctggctaaagttggttatcttggggtatgggagggagagagaggctgattctgtctgcttctttttgtatatgtctactttctgaattttctataaccaagtaacttttatcataagaatgaaagtaggtggtacttgttatttaaaaagctggttctcagagctagcctctcaagggcagtgaggccctgctcttcagccacaggggtctacacaggctcctcagatggcctgggacctacatgcctggggtctgactcccgagctgcaagcctgcacctgcgggaagggatggggggactgcttgttcctcatgcagaaggcttcgtctgtggttggcttgtgctcacaggaggtggcttgagcagccccgtttttcacagctcatcccagcgcagactgattttatttcatcttgttttatattacattttattttattatcattttcagatccaatttgtacaggacatctaatctctctgggatagaaatgagggagaaaaaaggttggggcatccaggaggcacagctgttctaaatgtgagccactgactcatga

SEQ ID NO: 125374 - DNA, 1014 bp, Homo sapiens
tcaaaaacttcagtgtttgcagcagtaacaaatccttttttgctcacatttcattgatttctgcagtattttattaagctctgcaattacaataactggtacaactggcatttgcagggttgggagcagacgcagtggtcatttggtcagcttttgaattgacagaagaaacacagtgcgggactgcagagcccagcctgctggcttcaggcatgcagtgggcatgcagtgcccggctcctcagtagtaacaatgatgttcctggacaggggtggtgaggaaggccctgggccccttcggtcttcatctagttcctacttctgcactgctagagtcttggctgactgagcccctcagtgggagcggggacagccaattctctagtgctccattgtggagcccagccagctggctcaggccatgcattccatattgtctcatggaacgaacagggagacagcagatccatggttggtgggaagcctgtagaggtggttttggagtgacctcatttatgtggtccttggagggcaagatgcagtttcattctaaccagtaagcagaaaagactcacacatgaatgtggctttgctcagcctggttcagcttccaatgtactcatttcttgacatacaacacttaatgcggggctcactgtcttatgtttacacctgcctgtgtcccctcatctcactgtaagcttcccaaaggcgggaatatgctctttcccgttttttttcaactccagcattgtcagtgagactggacacattctaacagctggaaaataaattttgaagttaattgctcaataaacttattttctcatggcgggatctatagatctgtaatgttaaggtatatgatgcacataaaacctctctggtttagagcacatcctccttcagctttattggaagttactaggtggaggaagagctgaaagtagttggatatcttgtgtcttgatgctcctgctgttcctcctccttcaatattttggcatgcccatca

SEQ ID NO: 125375 - DNA, 1032 bp, Homo sapiens
ggccaggctggtctcgaactcctgacctcaggtaattctgcctgcctcctaaagtgctgggattacaagtgtgagccactgtgcccggcctaatttttgtatttttagtagagatggggtttcactgtgttgtccaggctggtcttgaactcctgatctcaagtgatctgcctgcctcaggctctcaaagtgctgatttttttttttaaatgtctgcagttggagagaagttggcatgtgacaaggagacgttacagattccaggtcagaggaggcattcgtttgtgcattatttatattacctgagtgtattttacctgcaaaagggatactcatgtagaaaaccacacacaacaacatctccaacctacatccacttgggggacagccagcgtgctgtgggagggagctggcttggtccaggagccagggtctaggctcaggcccctcctgttatacatggccttgttttctaaccttctgttttcttatcttcaaatatgggggttgcttggctatgaatctgtggtctcctgtggctcaatagtcctattttagagaagcaggtaccatggcggtttcctcaggtcactgaaggcatcttgagctttttgggcagaaacttcactcatactgtgtgttgctggggacccaagtctgggtgtcagtctgccagcatcaggacaactgttggcttcaaaatctgaaacttcatgggctcctggtcctcatagctgctgtgataattgtctcattctcctggtgcatttataacaggtttctttaaaatgtgcactttcccgagagtatcaggaaacaatttttgttaaaaaattaaaaagaaaaaagtccctgccggaaaccttgtcatatttggagactcaatcgtagagaaagaataaggagaaacatgtttaattggatgagtattttctactttagtgggaagtttttctctacttaactaacacttcgtttcccagcgtgatgaccactagcactccccatcccgtcctctctggccctcaggcc

SEQ ID NO: 125376 - DNA, 1004 bp, Homo sapiens
gagcttctggtgatgaactgtcattcgaactgggcgggattgtgaggcttctgtcaccccagggctcttccaggaaaggctggcagggcccgcgggtgccctggagctgcctgcaggagtcaggcactaagtcagtgggagccaaggttggaaaggaagacccccttccattccatcctgaatgactccatgggtgagtgggacccaggacggctgcccttcagagctcagcccagttcccagagacgagacggtgagatggttaccaggatggtccctgccccttggccccggcctctgtttccagctgctccccttagcatctgcacaattgcctagtgaggccatcatgaccctgtgggcacagtcttctgggactgatgcctgtggttgtggcacccccaccctcaccccttctccccacaggctgaactttgatccacacttttcctttgatttcaccgtctcctctcacgcctaaaataacatacaggcctttggctatttccaaagggtttctgggaactgcgccccagtgaggaggcttcccagcagccttggccttcccttcaggcagactcctcatccacagtcaggagcccacaggtctcagttcactgacctgctgagaaagacgaaaaaccttcaacacattaaaaaaaaacaaaaaacaaaacacacccgtcaatgtgagcctcacacaagcaggcgctctccctttgtagctggaatttgaaagtggtgggttggatactgttcctgaagctattgtcccacctctgcaggtggagggaattgtgaacggtcaacagcagggaacatattaaccctggtgtcagcttacatccacccgggagcacaaagccttggctaatgattaaaaacccactccggctaggaggcctgggctgcaggtgtgtggctcacagacactggattcccatcagccctgaccattacctgcgtctgtggttcagggttgctgcatttctctgcgctgggga

SEQ ID NO: 125377 - DNA, 1083 bp, Homo sapiens
gtgtgaggtgtgtcttgtgtgtgttgtgaggtgtgtgtgttgtgctgtgtgtgttgtgctgaagtgtgttgtgtgtgtacatgcctgtgttgtgtgtgtgtacatgtctgtgttgtgtgtattgtgtgaggtgttgtgtgtgtgttgcagtgtgtgttgtatgtgtagtgtgtgttgtttgtgttgtgttttgtgtatgtgttgcttattttgtgtatgtgttgtgttgtgtgtgaagtgttttgtgtgtgttgtgaggtgttttgtgtgtgttgtgtgggttatgtgaggtgtgtgtgctgtgtgtgtttatgtgtgtgtgttgtgtgtgaagtgttttgtgtatgtgatgtgtattgtttgtgaggtgttttgtgtgtgttgtgtgtgaggtgttttttgtgtgctgttttgtgtgttgtgtgaggtgttgtgtgtgaggtttttttatgtgtgttgtgtgtgtgtgtgtgtgtgtgtgtgtgttgagacttgctcagtatgttttacttgaactcagaaagccagacagaggaagtgaccagagcaacaagaccaaccaacacaaggacaggacagatgtgactgtcaggaagtcttgcaggtcacgtgctgccatccctgcctctgccccagtgaccgtgatggagtctcatgaagctatttgattctttcagaaagaatgctgaccaaatggatgatgaggagcttcagataaatgaaatcactttaatggtctccattttattttactgaaaaattaagcaaatttccaacaaaacacccacactttccacctgtaaattactgggtgtggggcttagtgagctgagcatccagtgatctgggacagtggatccaggtgacctatgtgggtctgttctgccggccccagcctgcagtggtttctgcatgcatgttgtcacagaaggcttcccacaagtctctgggtatgcatttcttgtcctcacggcccataagtccaggtatttgactggacagtggttatttcctgcttatagattgtttccacccctcagtaaacttcagaaacacagacacgggtctatacaccacagcaga

SEQ ID NO: 125378 - DNA, 1588 bp, Homo sapiens
cccacatcacccagacactaaggggcttctgctctctggggtgtcagtgcccctgcaggcccctctgtgacctgcccttagacctggctgctcttctgctctgtcctgtgctggcggcccctcccacacctggagtttacctggcacttgtacccacccccaggccctcctctgctctgcagctaacctgaggggcatgacccctttggagaggttctagaatagcttcatcccagcatgttttatcgaggtgagctgccgggtctgtcaaaattcctggagttgtgctggctgagggcatgattgttttgaaacccctgggcctaattccctggtagggcagaaagaaggcagtgatgagccttgccagccatacttaccgacatcccaggacaggactgtaagggtgtctgtcatcttaatgacatactgtgtgagggttctttgtctgcaggcatagggtgcctttgtggctccccggggcatttaagacacaatggagaaggaaccttttccgtgattgtggcgcattgaacccgtggctatttacctgtgatgttcgttttcatattcctggtagcagaatcttctgtttactgcagcagcttacaaaagtgggatgtgaggttagattaattcatggactcaaaatcggcacatagtattgttgagaaaggagctgggaggcaaacctccctttgtgaatgtcaacttggcatatgttacatggacacagggttggagcttcctgggagccagtgtgaaaaggaaaccacaatgattggcatgtgcctttctggaaggtgggaagaaacaagaatcagcagagaaaatgtgcgacgtgggaaattatggagggtgtagactaaggcatcaggggcatgcaccacgtctccatgagtcgagcagaatgatgattttggagggatgtcagaggcaagctattgcagcatagcctcattgggacctctggcttttagaactataaagggacaattggtgtctttctgcttacattaccgttctatgggctgtggtcttctgggtcatagagagaatgcttcaccattgttcaggtaactactgtccctaaggctgggagaggtggccgggctccttacaggggagtcacagcctgtggtccagctgctctgtaagtctacgtgtatgtgtacacgcagtgctcacatgcgcacacaggcacagaatgtagtggtaggtgtgagcatggactagagttgggttgagtcccatccggggtatgacactggtgagctgtgtggccctgaatggagttctttcacttttctgggctccactttcctcttctgtaaaatgaggacgccaccagctcttcttggggtcactgccaggatcgaatgaaataacatgcttagatcctcagtgctagtgtgacacagggaagacacgtgatgtgtggggaagagcctggttggttgtcctgtgaaggtgagttggcagtgcggttcttctggtgcccacagcctttgctgtgtgccattcattgttgatctggttctcctgatggagagaaccagtctgatgagttccagagcgtgtcccctgc

SEQ ID NO: 125379 - DNA, 1022 bp, Homo sapiens
tttatatgtgagtgtatatatgttatgtaattgtttatatgaaggtttgtatgcatatattatgtatataaatgttacacatgtgaatatatgtatcttgtatgtaattattaatgtgtgtaggtttttaatgtagttgttatatatctgagggtatatatatgtggataatgtaattgttacctgtgtgtgaacatatggatgtgtgtgtttattatgtatgtcagtttatgtgtatgtgaatgtgtgtgtgtgtgtgtgtgtgtgtatttccctgagatgaacatgcatgagtccactctgtactaagctctctgtggccttttcaacttgccttgaccagctggcccccaggtgtggtccctggacctacagcctcagcattgcctggggacctatagaaatgcacattctcaggccccagcccagacgtactgaattgctggggccctgcgatcggtgctttaacaaaccctctggcaaggctgatcagctcaagtgtgggaatcctggctgtgggctggaactggggcagagatcagcccgtgggcgtgcagtcaggggtggccttggcaaatgcctgcctttctgggctgctctccccgtgtggtggtgtggggtcatgagagggcctttgatgccaagacacccagttccctcacatctttattttgcatggagctttctcccctaaacagggcagtgctgtcttcctcctggcatggaggagtaaatggaaggatggacgtggcagcccagcccagcctgagcactcttctgcctccctgctgggtggccttgtagaagcagacccccccatttagcggagcttgggcaggagggtttccgcctgcaccgtgtggcttctcagggcagaaagcacagaatcttttttttctttcctgatcctgtctgggctgagtcttctggcactgtgatccttggcattttggatgggcatggaattgctttcagataatactgacatccccgatgtcacctgggttgtcactgtgccctgt

SEQ ID NO: 125380 - DNA, 1097 bp, Homo sapiens
ctctcctgactgtgtttgagccaccttgcctccgttactttctttatctttcccagggagctctcggtcttcagagactatggtggagtcaaagtctcctctccccgtctcttgtgcggaatggaataaccaggttgacattgccacattcagactcttcagttctacttgtagaaatagttctagaaaagatggccccttgtgtagagaatgcatgcccctgggtgaggatgggaggagtggggtcttgaagaccaccaggcagagccttccacctccttctctgggccccgctcccaagctccccaagcacggaccgactcagaggtttccatccttgaggtctaccagttctttgtgaaagtgggggctaaattttgtatctatgagtgatttgcatttttctggaaggggaggccccatggtttccatgacattagcaaaaatgacagggactttccaaaagtgaacaaaaccctggactctcttaactctaaatcttgtcagtcttgatctgctacagctttgtagccagagtgaggttagagacagtttcattcagtctttgggagcctggcttgattattatgctaattttttcctggagaatccatttgcttatctgtttcttctctctttgaaaggtggtgattccctgcggtgtgcaagtccgactggaacaggtaagccctttgcatttctttggctcccttgttccatccaagaaaggactaagtcctttcttgaagctgctccctctttggggatcttttggcttcctctaggatccatgccctccctttgacctgtagcttgcattcacaaggctctatctgaggtcctttgaccatgctgcactggccatttgcatggttttttagagaagaggatccgctgcgcctttgcgggagctgcctttctatcagtaatagttaccttcggggcgaatctccctgggccgagtttccttggctataaagtgaagacagcacaagtctgttgtcttagtgataaaaacctggacagtgagggtgcctgggtcgccaggtggctgtggacagtgtagtgcagtggtttgtagactgacatccagctct

SEQ ID NO: 125381 - DNA, 1610 bp, Homo sapiens
gagagtgaatttaaaaaatgtattatagactgtatttttaagagagttttagatttatacaaaaatcagacactcaggccaggtatggtggctcacgcctgtaatcccagtactttgggaggccgaggtgggtggatcatgaggtcaggagatcgagactatcctggctcacacagtgaaaccccatctctactaaaaatacaaaaaattagccaggcgtggtggcgggcgcctgtagtcccagctactcgagaggctgaggcaggagaatggcgtgaacccgggaggcggagcttgcagtgagccaagatcgtgccactgcactctagcctgggtgacagagtgagactccgtctcaaaaaaaaaaaaaaaattggacacactcttcttcctcttcatatataaacattttccattcctgtggtacatttgttacacttgattagccaatattgatacagtcttagtaaccagagccctcggtttacattaggattctctcctggtgttgtacattctgtgggtttagacaaatgcagaatgacgtgcgtccatccttatagtgtcaagcagaatagcttcatggccctaaagagtctctgtgctctgcctgttcctctctccctcctaatccctggctttcactgaccttttcactgtcccatagttttgccttttccagaatgtcacagagttgaaatcatacagtatgtggccttttcagagtggcttctttcacttagtaatatgcatttaagtttcctctttgtgttttcctgccttcatagctcattttttttttcatcatgcttgacatgccattgcaggaatgctgatagtgagtttgaaaggcaggggccctgattcttcgcacatttcttgcctgcatgtcacatgtggagtgaggcaacaagatgcatgtgtgcactgagtagataccatgcttgaggggagataagtcacaccgctctgttaaccatggggtctccttgtccggctgtttccgccatcctgtaaggttttgtctgtgactccttctgtttccaaagctgtttttgttttgttttgctttacatttatttgtttacttattctctcatccattcatcaaactttaaaggggccctgagagaggacccctgccccagacatccgtctgagtcagagccatggtggagtaatgatgtgtcccagacacaggaacggccatgtgtcacatactccctgaggactggactgcgtaagataagcaagaggctataaatagttatcctggtaaaagccaagattacgccgccgcccactccaaaccacaagtacaattagtcagatctctgagattctctacgattctccttcggttgcacattttcagaaaactctttgagaaggcaggtgccagggatctggagggggcagtgccaggagaaagctaaggagtgaggtcactcaccaggaactgaatcctgtttgctggcgcctggctcctgagcggccccccagagcagcgcaatgcctgcctggctcccttagcccctgccctgtgccactcttctgagctcctcacgcgccatctcttaattctcaccatgaccctgcccggaaggcac

SEQ ID NO: 125382 - DNA, 1254 bp, Homo sapiens
gggcagaatgacctggagaacaagcaggaagaaacgattagaggagccaagcctccaggctttccctgtagctgccgggtgtgtaaaagcatgcttgacacttgagggtgctcgcttcagttcttttttttttttcttttgagacggagtcttgctctgtcgcccaggctggagtgcagtggcacgatcccagctcactgcaacctcccaggttcaagcaattctcctgtctcagcctcctgagtagctgggattacaggcacgtgccgccacgccctgctaagttttgtatttttagtagagacggggttttgccatgttgaccaggttggtctcgagctcctgacctcaggtgatccgcccatctgggcctcccaaagtgctgggattataggtttgagctactgcgcccggcctctcttcagtccttacttcatgtttctgtgaggttctaggaagctgattcacgtgacccaccatgactggaatttttgatgatttggaaaagatagaattgaaatttacatttattctctttatacagaatatgcatgtttatacagaatatgtagtgcatcagctatacccacacggctttagagaaactgatggaaaaatgtcactttctatatggctgtttacaaagtgaaatttaataagaaacaacaataaaagctgagtttggagttttattgtgttcatcaaaaggaaaacaatgtcggtcaagcacgaggagaactgagttgtcctttatttctcccaggacttggatctcccagaagtaagcagagagggattggttcaggtttgaagagttgatctcactccttactgaggaagatctgcacccgaggccctgtgtctgttagcactgggggtaatggtggccgggccagtgcaccttggatgaaagcactttctaaggcagaatgtacttgttagctgaagtgctttcattcaccttgggggatggaactgcagggctaagctttgttgtgtgtgcacacacacaaacacacagagacacatacaggtatacactcacacacggagacacacacagacacgctctcacatcaatacacacacatgaggcataggcatacatagaaacacacacagacacacttacaaaactcagtttcacacatgcacgttcatacattctcacaagcacacacgctcacaccccctacacttttacactcccatgcacataactactgactcacccactcatatgcaaactcacaa

SEQ ID NO: 125383 - DNA, 1028 bp, Homo sapiens
acccatgtgaccttgggcttcagtttcttcctctataaaacaggaattaacccctactaagaggactgcggagaactgaattcaacagctccccaagcacagggcctggtggcttctgcaggagtgctcttttccccttttaataccttaatctgcatcattgtattaggaatcactgtagatgtctacagtgtcagttgctggaaactactctttctgcagttgtggtactgacgctagtagatttatttcatgaaatgttgcctaccgctagcataaatcactatgcattttatttattaactgttaaatgacaagaaagtatatatattttctaaattttcttctgagaatggggtctgctcttttaagcaaacaaattccatttagtgggcttaattagtgcctcagacttagcctgaggcccacctgaaagtggttccatatggctaatggcagagccgtgggcttaatattttctgacactggaatccaagtgcctcttgctcgatgctgccttggttctggccagctctgtgacctttcccctgactggctgcccttctttctactccccccagcctcctgcatttgcacaggctcaccctgccttggctcaccccacagaggacttccgtagtcctggcccacatcgctgcagccagggtatctgggcctagggcagagctgggtgctgcaggtgtccctgcctgcttggtcttggacttctgatgtgatttcccacaagcccctgacgagcaggtacagatgcatccccagccctccgcctctctcacctgtgcctggcgttctgtactgcgtgtgcgtggactctcccactcagactctgtttgcgttggccaccatcgcttttactcccgcttctcttgaaacacgttctggccggtggtgtgcagatgagggtttataccctgctgggggtgcagcgggctgattggcagcctctgctgattcccctggtgaaaatacctcacctccccccgcctgcttccaagctaccagcctga

SEQ ID NO: 125384 - DNA, 3029 bp, Homo sapiens
gcttcatttctctctccctgtcctgcaaggcctgcctgcagcatgcccgtggtgctcgtggggaggtttatgcctcatgatcacagctgcagcctctgggcagaagggcctgtgaaatccgcattggttccagctctgcattgcattgttagggcctccgaagggacacaggactcgctccgttcacacaatggcccctctggaaggattctcctataggaatttagacatgaatttattctgacagtcagttctcaggttggccggaagtggaagcacttccgaaatccagatgcacgactttctcacaaatttaaaggctcccatccggtctttcatggacactttaaattctgattcttaaggggcatcttccagtttctcttcttttttcagggatcagctataatttctgggcacacacgaatgcattctgctgctgaaattcactattcttctttagggatccagttcggctggacgtacataccccttgaaaaaccaatctgctcatgaccccttgaaaaaccaatctgctcatgaccgtgctcccaagacattcctacctgagccacctgagctgttgctaacagacaacagttgtaactctgctcttgcacaccatgtcctcactgccttctgtccacactgccgtgtgtcatatgtaaaaatctctctcgtgccagagagaggccacctatgggatcttcaagccagagactctgaaggattgagagggtttgaagatgtaagaattcttgctagagagactgcttgacacacattctttctctttttttttttcccagcctgcaagtattcctgccacaagaaatgtgaagccaaggtaagcattccgttgctttcccatgggactttttatagctgacttggccttcattgaatgatatgtgtgggggggcctctttggactgcagccacggaaagaaaactctttaggaaagccagggctggggtacggtgtatacttttcatctcaaggataaaccaaagagctttgaaatccacggttttgattatggaaaataattcttaagaatttgatttcagataagaattcaatagttgtcccctggccacatcaacagctccttctcagtggcacatggtccctggtttctcactgccttgtcatactgcctctcggtggagagagggcaggagcagggaggtccagggcattcccctggcctggagacttttctgcctcattttggagatagttgtgcatagacggattggggttttcagctgccacggaaacctgggaaccctggagtaaggtttagtgatgttcactgaggtttgtgagtctctagagaggttcaattgcccgatggcctctatgaccaaaggaggcctggctatgtcctgttgggcttagggttttggtgagtggggaagtgaggtggcctggaagtgccgtgtgggaagtgacagacaccccaaggaagaagcacatggttttctacgttgtcttggtgctcgcaccttcagatctcctggggatggtggctgtacttacggaatccccaagtatgatttgggtctgcagtcggggtgtcagcagtgttttgccccatctactgtttggccctgcctatgggggctctgtaggtgccctgacaggttgtccccatggctgtaggtccagggaagaggagttttagagtcttgggattttgctactgttacagacctcatgggtcagctgttttgatcatttccagccctgccttcggctccgagtggaaggctatgctggaagctgacttcatgttaccatgaactcactgcatgtgggtctgttttccatgtgaggactagggcggctggtttccccgaccctcccgatctcaggcatacacaaacacacacatgagtaaatacacacatgtgcatgcacataaatacacatgcatgcacataaatacacatgcacacaaacacatttgtgctcacacgcatacatgcatatgtgtgcacagaaatacacacacacacacacacacacaaagttggaagaactagactagtatagctctatttcttttctcccaagagactttttaaagtcttcattatggagaatgccgagcacgtgcaggagcagagaggatggcacagggccttgctgcccccttcctgaaccccagaccagcagcccctgtgacctggccacacctccttgctggctgcctccttcagatgtcatgtggggtgcacttctcgggcctcctgggggctgtgtggagcgcttctcctcttgctttccaccctgctctggagagggcttccccttttccagaggagtgggcatttcttgttcacacactcctaggcgtagctgatttctgaccgtggtttatttgaggttttttgtccacagataggctcctttcctggggtgctgtgcaccttcagtggtgtgggagcagtgcttctgaatgcagtggtgagtgggaagattgtacctttgggggagcatttcagacttggagagcttccccctcccctaggaggactgggatgtgttgtccctcacccctgttgtatggtgcctttgtccgcattgcttgcaccttgggtcggctgcggagtaggaggagggggtgggctgcttgtcctgactctgttgtgggcccagccacctctgagccacagccgcagagatgagcctgctgttgttccttccatttcttaaatgaagcctgtcgccggctgcttaagggattgaattctttggttcaaagtgtattccaaaatccttaactatcactgaatatggaatttctaacggcagcaattggcagtttgctgagggatggataagctcttattcctatcagatcacagtgtggggaaatatatccgtgttcattttttttataatacagctttgaaccacaggggagaaagcccctggcaataacaaagcaccttctcattccaaaaatataatgccgtcgttgttggggatatgagggccataactccccagctgctcc

SEQ ID NO: 125385 - DNA, 1015 bp, Homo sapiens
atgaacggggttgccctcgcgctgcgggtctcgggcacccactgctagggtcctagaagaccctaaagggctcttgtcagtgtggtttgtattcatcacgatttaccctattagaaatgggaaactgatgagtatttaaaatatttaagtcagttaaaagcaatggtaatgaaccaattacatgttaaaatgaacataagcttaataaaaaataactatgtttcaaaacaacaaaatgagaggaggtgcatttttttttgtgattctgttatgcagccttaatcaagaggctggttacccttgcatgcagtcttctgcaatgtttggtttgaagcgtcaaagacaatctagccccataaacatatctacttggaaaaggaggcattttaataggcttttccggccattgtagctatttcattttgattctacaccagaactcaagtgacagttgcttaaagttcagtttcactgtggaatctgaaattgtgtcagtagagtttttcctacgctgttttattaaaatccactggcctgtcttgcacaccaagtgcatcttttacccggtgtggaacaccacgcactggacatttggaaattattggtccactgacaatttcgcagaacttctaaatgttgacatatttgttatacaatctcaggaaaatccccacatttgttaataatattgttgattttaacagaaatgtcctaggagttgttaggccctggtgatgggtacaagtcttttttttttttttttttttaaagacagtcttactctgtcacccagggcacgatctcggctcactgcaacctctgcctcctgggttcaggagattcttgtgcctcagcctcccaagtagctgggattacagacatgcatcatcatgcccagctaatttcttgtatttttagtagagatggggtttcactatgttggccaggctagtctcaaactcctgacctcaagtgatctgcccgcctcagcctcccaaagtgttgagattacagg

SEQ ID NO: 125386 - DNA, 1086 bp, Homo sapiens
ttgacggtcaaggtatttcatgccgaggtaagtctgtgtttatgattctctcactgattaatccagagcaaaacaaacaagaaacaaaacgaaaactttttttcaggagtttccgaaagttaaatcatggaattccccttcttagtttatatgtcccccaaccccctacccccttacttagcaggggccaaccgtatttacatagataagtgctcatgaggacatttttacagaaagagcagagtttcccgatgggagaggaggcagcaatttgtaaattaatcatttattctcaggtctgctctgaagtgtcagtaactcaggttgtttagtttgactttcagatctgttactcaagtttgcgaatgaaatgtttctatctttagatttcgggttcattttggtatggcccctttcagatcctgtcactaaactaagccaccagcttgggtaccagatatttagacgtcaagtaatgaatggaacttgccaattcttttgtgactgcacattaataaatctagtaagagaggtgtgactgtaatgaatgtgggagtggtggggggcaggggctgcttggcggaccagtggggtacaccacacagagggagtcactaggaggaccaggtccttggagagtgcgggggctgctctttggcatcatttcatctgcggggttggggatttcctctagaaaatgtgcagagtctcagcctgtgggcttctgtgctgttaggacctccccctcagtgcctccttccctgcagacccccagcagatggtccctgatggccactttagagtagggtgcctgtgatggaacgatgcacgcagtcaaaccttaatgggttgaggatgtgaccaggggcctctaaggggctcttgggattcttttacagttcaaaggcctgagtgtgggtgagaagactggggtgcccctcctctgattcggccccttggagaagtcagtgctgaagaatgtgttggatgagtggtgggtaccggccaccctggtcgctaagtagaagccagagaccagggagccacctgtgtaattcatctagatctgcatccaaggcagagaac

SEQ ID NO: 125387 - DNA, 1040 bp, Homo sapiens
tctgacttctgacgggcaggagtggccgtggaggctgcggcgcgcggctgggacctgggccggcggccacggagagcccttggcccctcccgtgttggccatttcctgggacttgtgtccgcaggggactcgggaggcatcctccccccagatagccgctggggaggggtcagcggccaccctcgcccggccgagcccggctccccgcgggcggcaggggcagccatgaggctgcgcgccctgacccctgggccaccgggagggttcgcgcgcggaacccggtcgcgccggcgccggcgccaggtgagtgcggcccggagctggtgtgcatggccaggggcgcgaggcacgggcgccttcagggctgcacgcacgtgggctgcgccgggtgtgcactggtgcccgtggacgctgtgctggtgtgtacccgcttgtgctcatgtgtatgcgtgtgcccttgtcagtgcgcgtatgtcagtgtgtgtgcaccccgtctgcacgtccacgcgtgtgtgcttgtgagcgcgcgtctgtgtgtgcaggcatgtgtacgctggtccgtgcctgagtcctcgtgggtgcgtgtgtacccttgtgtgtgcacgcgcaggacaaggagcgagagggccagtggagctttgcctagtgggggcgtcttctggtaagcgtggaagagggttcaggcttagctctttctaactcaactgcctcttgaaaaggcttcttgggttcatttccctgcaatggaattgggatactggccattgcgcagacctgctatccctcgcgtgtttcttgcaaaggtaaagggcattttagctctgcaatgaagtgggggatgcgctgggatgtaggaatccttacaggttccctggggaccgcatgggttccagcggtgctctgtggtccacaggacggcctttcacggtgtttgaattaaacagagcggtgctggttggctccccgctaggttcagcctccctttccctaagttattgctgaattaaacagagcggtgctggttggctccccgctaggtt

SEQ ID NO: 125388 - DNA, 1029 bp, Homo sapiens
ggagaaaaataatgaaaaaaaaagaaatgaattaggtgtgccagaagaatgtgatgggcgtggggaggtttatgcagataaatatggtgggtaagaatgccgccccttttcaatgtctgtttaaatgtttccattttccttgtaaaagcactccaacacaagaagtgcatttgcagagaggccaaggatcgctcccggtggacacacggttttgtagcctccctctccaccccacccctgccccgctccagctgtgccttagcagacgtcattccctgttatttcagtctctgcaagtgcaagaatttagggtgataacagccatacttccattccatgaatttgcacacttcttactctctacttatctaacacacatgtgcacagtgtgaaccttggtctgctgacttaactttgcctgtgtggggtgttgtttctctcctgtctgtggacacttactgagttgagattcacaggtgtggaaagagcagggtctgcagtgcgaatgttttcgtagttctcattgtagactgtccaatgacttttcaaagtgctccccaaggcatgaattattccactgggggtctccttgcctgtagttttgaaccctgacccagccaaaggctcccctgctcctggtggctatgctggaactctagctccttccctttggcctgaggtggccacacccagggctccagccacatgacgttttgtgccctcacccacctcctccgtggtctccccatttgcttaaggaaacacctggagtgagacagaaccatccagtccatggctgtgccccactgggcctccaccttcaggacgtgcccagggtctagccacctgcttttgctcagttcccgagtccagcggcaggaagtggacaccaggccagccttctgcccgggagctcaggtgctagagcttgtctgccctctgtgcagcagggagcccaccttgcccatttgagaaagaagcaggggcactccgaggagatgcttcctgaaggaaccgggtgttttagga

SEQ ID NO: 125389 - DNA, 1024 bp, Homo sapiens
agatcgtgttcacaaatactgcatcggggactgagtgcacgtaagacactagccaaattttggagagatgtttgggttcatataatacataggcttcgtgcctgaagcacatcaattctcagatgagcaactgctcagatccctgcctggaggaggagtgggtgtggtgatggcagccacgctgtgaatactgtgggctttgttcacagccacagtgaggaggagatagtgtgtcccggtacaagttatcgctctatcagcagatccatctgtccttcctcaaagaggctgcggcccacttcagggccattgtgtcaaacagttggcatttggccttggccctgggtaaaacacatggcagggtatcacgtgggtgccactcacgactcccccacatctgccggggtttccataacgcactgttctgtttgcagctgcacgaatgcgatatggcacagcagccgctcatagacctcaggcttgttgccatgcatagaagatgcacaccgcagagtggaggccgcaggcagggaagtaactggcatgaattattgactgtgtgtgaggccctgtgcggggagattcacttgttccttcctttattcattcattcactcactcattcctttcatgcagctcatgttcagtgagtgcctgctgtgtctcagatacatttaaccctcactaactctgtagaaactgaggctcagaaggtgaatgcagggcgaggtagcttgcccaccatctcagcttggacatggcagggcaaggggcttccgatcacgcctctcagacccagagtctgcttgtctccattctgcctgctctggagcccccagttcttccagctgcatctcgaaggtgaaggaagacgatcccgtggcctgctcaggactatgtgcctgctgctgtggcctggctcgcctctccctaccctctcctgcaggccccagggtcctctggagtccaaggcttagtgttttgaatcactggcctttcctttgagaaaaatggggctccctgt

SEQ ID NO: 125390 - DNA, 1042 bp, Homo sapiens
caattaaaagggtctgattttgtttctggagaatggttttaatttggataaatggttcagtctgggaaccacatgccagagcctatgatctatgagtgcaattactcagggtttcctcggctgcttttctgagggaacggtccagaactgggctcgctctggtttggctctgttaaaacgtcgatgcaggccctgggcagttggagtgaggcggttcttgtgatcagtccttgaagtgcagccataatgccctccccataatgccttccccaactgatggtggttaatttttaccctctaagaatgtgttcacaattccaaatcaggaatgtcaacagcaggctgtcgttttcccctccttggaacatgttgaaccagaattactggcatcttttccaacgtgggcatttgcagaattggtgggatttgggggctcaaggaggaggcagactcatcctaatgtttctcctctggattacttgaggtccctggccgggcaggcctgcaggcccagagacggggtggtgggttgctctatctggagtcaactggtgtttctttccaagaggatgctgggctgggggaggtgagggactaaatcctgggcgactttgcagaaggacccgtcgcgatggaggggcagcgtgggcagaggccctgggcagggccacctgctgtgttctggagtagcaaaggggatttgcagaaggcaaagaagaatacaaagacacaaggtagggtgtttcaccctttcggagaactgtggcaaagccctggacaactttccatggcgcttgtagatttgagaccaatgccccagcgacctagcgggctggtgggaggcagcgtggagggcggcagggtgtccccagggtgggaggtggagagagtctgcacagaaatttccaagagcacagcccataagggaagaataggcttgctcgtgaggtgggtgaaggcattgccctgctggcttgtatcagggcgttggctcctgggtcctcaacaaagggcatattagcataatgaatagttaagttac

SEQ ID NO: 125391 - DNA, 2367 bp, Homo sapiens
gagtccaggctggagtccagtcgggccatctcagctcactgcaatctctgcctcctgggttcaagcaattcagcctcagcctcccaagtagctgggattacaggcgcataccaccatgcccagctaatttttgtatttttagtagagatggggtttcaccttgttggctaggctggtctcgaactcctgacctcaggtgatccacctgcctcggcctcccaaagcgtggggttacaggcgtgagccactgtgcccggccgatttttttttttttttagaaggcagtagtctactactcttttgtctcctgggcaaaatgaatgaaagattatactgaaggattctatgtctgtgatctagaaaattccctctggcagagggaggtgctcccagagctagggaagtgctcctcagagccacccctcaggggagagacctctctgtccctgtctccaccccagcgctgggcaggaagccctgggagccctctgcaaacagcccgccagctctcagcctaataacgcggctaacaagacccccttccttttactactcaagtacccaaggtggcttgggcactttctgtccctagtctgatcgttgctgaaccgtgcatgtatgccatcctgatggtctcccttttctggaagagagcgctgagacttagcgagctcaagtaacttgtgtgtgttgtgaggatactgagccttggatctgaatcccggtccgtcagcaatgcttggagttcttgccaagatgaggggtttgtgcagtccccacccacagcccagcccctggagtggccaggccaaggctcaggagctgcggcgtgcctgctgtctacctcagccagtgcgccagccccagctgcttcctcggaccccaaggctgggcctttctttactcttccttcctccctcagctctaattatggttcatgttagattgtctgcccttcctcttcctcttctcttttggggaaagataatagcacttaatacgccctttgcaggcctggctttgtttctaagatatcagaagaatctttaggaatctttcttccagctgcccaagcgagcggcaacctgtcggcacccaggaaggatgaatacgggtgccctgctgacgattacaagtgccactcctagccaggccatgcccctggggacaccggggacacctccaggtggactaaagtgtgtcacctcctttcattgtgtcttggcagccacagtgtgacgtggcacctcttgtgtgtagagtttatgaaactgctcctgaaaagtagagaccaattcgttgatgctttgaatacactggaatacactcgtggcgatactgaaagaaagaaagtcctcgggaagtgtctggccaaggccgttcactgccgtctgcagttgcttttctttttacaggagagcccgggctctgctccaggccctgggattatttctcgctggaggattcaggaatctgcgctctccccatcaccctggaacacagctgcagtgtgtaacatttcactcacttggagccacacaataaaaggcacaggcccacatctggctgtgcagggcaggcgggcaggagagtgggccctggggcacactgggccattagcaggggcatctgcgtcctggcctgtgcacattcctccctggagcgccgggctggctctgcaaacaaaggggcctggtcctggcattcttctccaccttgtaatccatcacctttcttagaggtgtccctgggcgcctacccctttcatcactggccatttgggaggtagatcaaaggtacgcacaggaggcagtgacataggccaggctctggcatcccacaaacctggggcagaactgtcctttgtcctgagaggtcctggggttattgtgactgtgtttgtcatttgtcacctgcagcctggggttgtcgttcctccacaggtttgctcctccactggttccggagctcaggggtgggagccacgtggggttttgtttcctccttttgggctccaggcccagtgtactttggtcctgctgaatttccatggccccaggggcctgaaaagcaccttgtggtccttctggagaaccacttcctcattcttggaggtgctaatctgatccactgggagggagctgtgtgctaagtggttgacacaggggaggccagcgtgatagagatgagtttttctccaaagatcaaggacaggtgtttccagtttgtctcctctggaaagacctgcagagccgggtggacagggctggaggaaagggggcctgtgtccatgtcttgggtaggtgctaagggagacaggagggctctacgtgggtgaagaatgcatttctctcttgtcctgcacgc

SEQ ID NO: 125392 - DNA, 1476 bp, Homo sapiens
attttagattttcttgaggctttggtctgtgcatattaattttttaaattgctttcatgctttcccttttgaatgaggtttacttgttctggtgattctggttcttctctctttggggcctgtgaggttatatttgcaaatcaatcaacaagtattaagaaaggcttttctgtgctgaggccttgagggccagggagggggtggggagtcgctgcagctggagggtggaggggcaaggccattacacagagatggaggtgcactgggtcctggtgggggtgtggtagcacagggggtggggggtgtgtacacagggaattgacaggaggaactggcagcaagcccgactcctgaccttaggaatagtaatggtgaccccgaagacaaagtaacaggcataccgattgagtgtttgcctgtgctaaatgctttgcatgcattcatttcatttcacccaaattacattccttggagggagttgggattatgattaccccattttacagacgagtaaactgaggcaaaggaaggctaagtaacttggccgagatgaaatgaaacatggtggtagtgcagcctgggattctgggacaggactctagggtcccagacccctgttcctggctgctgctgcgcgtctgtcgactgaattctaatgcatgtccagacagcgattcctcagctgaggctgccatagctatcagcagctcagctgaattatgtctttaaaaaactaccaagatagaaaaactagtagccccagggcactacttattcctgaatgcaaattgatttttttttttttaacaaagtgtctctttggcacctaatgttttgaaagtgagctgtttgcaaatgtgactctggaaataaagggcaggagagggggtgtcaaagtatgctcttccactgcaggaggtgttgctgaaggggatagcagagacctgaggaggaggcagtatggcaagaacagtgagtggaagggctgacctaccatttggcagtcgcagcttatatctgcttaggactctacacaaggacccattttacagatgagtaaaataccaagtaaattcttaaagtctgggaacagttagggatctgaatgagcccagttctctgactctatgtgccccattcctttcttaagatcagcctgttgtaaaccacccctgttcaggggaagcctcttgttccctccctgtgtccctgtgtatgaacttgagagggggaggaactttccaccttcctgagggcagaaagcattgtttagatccctgccacttactaggaagccagagacatttgctgagtgcctcagcagcacgcttagaattgaggcttcgaggcttcctcacagcggcccccatagatttcccagggaggggcctcctgtcttgcgggttgatctggtgggtttgccccatgcagcaggagctatcatgggaagggtgggtctgggcgtctgaagctctc

SEQ ID NO: 125393 - DNA, 1052 bp, Homo sapiens
ccatcgccctgccggaccgcgcctcaggctcccccaggtactggggccggggaaggaggaaacgcggccacgcgccgcggtcctctttgtttcgggcccggcgcgggctttcgcgctccgggcgcaggaacgaggcttggggagcacagagatctggagctggggcgcggggactgagttcggggagcgcggagacagagttcggggagcgcggggtacgggagctcagggcgcggggatggggtcacgggagaacccaggttagggagcgcggggacccggttgggggcgcacgggcaaggggtttggtgcgcgcgggtacggggtttgcggcgcgtggggggcgggggctcggcaggagtcccaggacaggggctggggcgcgggccagcttcgccggagtccggggacgggggcgctgactggctgggtttggggactggctggggcgcaggaccactcgagtgggacccgtggcgcccgggcgccctggactgagggcagagaccggagcagctatgtcgcagtcgctgtcgggaccgagcggactttgctccctaggactccgtctcgagactccaggtggagagcgcagctaggggcttcaatgggcaggctcaagacccttctcctactttttctaggcaagctctccagtgcgtctctttccctttccctttggtgggtgggaggcagggggtctttacgcgcttcctttttttccctgaaggacgggacctcggggtggggggatattctggggtggggggtgctgtcccaggctgggggccagctgtgtggcatgtgcctcctggcacgcgggagctgtcgctgacaagcaggaggagggagggtcccggacggcccaggggtctctgtgtcggtgctgtgcagcggcctgacatgtgagtcccgggtcctttgcttggagtgatttgagtgtctgtggcgggaagagattcaggcgttcctcaggcattctccagacagtgtcagcagatgacccgaactccagcgtggttgaaaaactcaaagcgccatcagggtgtggg

SEQ ID NO: 125394 - DNA, 1094 bp, Homo sapiens
gttgctgaagcgctcatcacacttcttgaggtgctccatccttccttgaggaggcacactgccatgggttgaatggtgttccccaaaagatatgctgacatttgaaaacaaacttatgggtaataaaggttagagccttatatgtatacaaggtgtactaaccacacagtttaatatgtagcaaaaatgtacactcgatatttttgaactggttattttttttttttttttttgctgtattccaactgaccaggacaatgttaagaatacatcttaaatgggtgctcactgataaaggaatggttaataatgaagccatacatttatgtctggatttaaacattttaaggactcatttaccaagtccttgtctgttgccttgaagaacataaactgctgtttccagtattcacatcagcaggatcttattcataatacaaaacgtcttattgcattgaaatgtactgtaacatgggaaaatttaagccttttgtatgttttctttcattgtgaaataaaatttaattctgaaagaaaaaaatacgttgaaatcccaactcccccctaactgtgaatgtaaccttgtttggaaataggaccttcacaggtgtgatcaagttaagatgaggtcacttgggtgcaccctgattcaataagactggtgtccttataagaagagggaaagctggacacagacgcagagggcagaggccacgggaagacggaggcagcgcttggagtgatgcgcatgagccaaggagaaccgggagcctcagaaactcgaagagtcaggaggaaccctcccctggagccttcaaagacaacacagccctgctgacccttgattcagatctctggcttccagaactggaactgtgagggagtagagttaggcggtttaagctacctggtttgtggaactgtgcaatggcagctctgggagagtaggacagatgttgagcgcaccgactcccagacctccctggccagatgactgggcttgcctggtctgcacctcagcctcctggctcttcccctgcctggaaccctgtatatggtctcatcatggctggcctagctcatcatgcttctgc

SEQ ID NO: 125395 - DNA, 1039 bp, Homo sapiens
ggcctccgttctccaggtccctcctgcctgagggtcccctgggctgctgcagggaagagggtggggcaaggagagaggacagagggctattgatgaggtctcttagatacagagggccatctgtcctgccccttgaagcccaggcactgtgtgtccttgcaaagtctagcatagggtgttcccagcatgggacctgcagctgggagcctcagtagacttctgtgcctttctccctgccctgccctaccccagtgtgtgctgttttacaggactgaagcccacacagccctgtcccgactcagggccagcatgtggattgaccgcagcaccagggctgtgtctgtgcacttcactctctataaccctccaacccaactcttcaccagcgtgtccctgagagtggagatcctccctacggggagtctcgtcccctcatccctggtggagtcattcagcatcttccgcagcgactcagccctgcagtaccacctcatgcttccccaggtgagctgacctgcctcttgggcctcctggaggtgcacaggaagatggggcttcacctgggctgggcttctccaccagacaggactagttccctacccattcacctgcccctccggtcacactctttgtcacatccccttcttgcagcaagcatcacactaagggttggggcatgagacgaagaagacccccagtggggaaaccaatcttcacatgtgtggcaagggcaaatatagagctgtcttgaggtaccaaattcatcacgggggaattgggcctgatgtttagatccccccagggatttagctcaggctgctgtaacagaatagcctacactgggtgctttaaaaagagacatttatggccaggcgcggtggcttatgcctgtaatctcagcactttgggaggccgaggtgggcggatcacaaggtcaggagttcaacaccggcctggccaacatggtgaaaacccatctctactgaaaaaatacaaaaattagccgggcatggtggcatgcacctgtaatcccaactac

SEQ ID NO: 125396 - DNA, 1008 bp, Homo sapiens
tgggctgcaagtgtccatagaccacatcttgagaagtgtcaacctccaaaattaagtccccaatccttggcactgagtttcaggttgaaaatgttgttataaagatacatagggcacacctgggcgtcgatctttctatgtggttcctatgacggtgcctgtggcccttagcatctggccatcacctgcactctgagcctgatctgcaggtcccctcaccacagccctgcacccctgttacatgaaggaattcctgggtcccccaaataggtcttatgtcttttaaaaagtcccctctgtcagaattcttcaccttttttctaggcctgttaaatttctatatatcatgtaggaactggtcaaactataaccccaagccttgacagtccattgccgagtttgtatttcactccctgggctccctgtggctcggagcctggcccctttgtcagcacttgtcacagttttagtcatccagaagatgctgtctgtgtgtgaagaagcatctctgtaacccacatgtccaagatgaccctcttctgacatgttccctcacagtcatggtttccactgaaatcacagatggcaaaggctccaaggtccagccgtgcactgtggtggtgactgtgctgccccgctaccatggaaatgactgtctgggcgaggacctgtgagtaacacaatgccacacagacatcctagccattatttgtatttcttccagagttggctctcccccaagttgttaacaagcgtcaaaaacatgtcaggaactcatcttcttaagatggagcaaataaaaaagtccgggtgctatcactgcaatcctgctaactcatatttgcatggcattcttgcaggtgcttcagagcctataaagctactttcttctccttcttttttttttttttttttttttgagacagagtctccgcctgtcacccaggctggagagtgcagtggcacaatctcggctcacttgcaacctccacctcccgggttcaagtg

SEQ ID NO: 125397 - DNA, 1050 bp, Homo sapiens
taggaagccccacccttgtcctccagaggtcccagaccatggccttcccttgaggcaccccgacccctccctcctgctcctcctgctgtgtgatgcccagcagtgtggaagctgaggggcagctggggcccttcaccctgagggggctgtgacagtctgatttgtgactgtggggaggttccaggacaaggagaggacacagacactggtggggaatctcagtgttgttcgaggagccctttgggcttggtgaatggagagccctgcagggcccagggctctgggcagctgggagtgctgcttacctgtcacttaccctcttcctggctgtaaagaatgtccttggtacaatgaaggctcagctgtgtgtgtatgtattgtgatatcattcacagtgtgttcatttatactatttttgctcccttggactggatcataggacttccattatgaatttagttaccagataggaaacacctccaaacacactttgtaccatgggagagacacccagtattattttgtgttgccagctggtgagcacttggacaattacaaaggtaagctatggtgccagttggagtcactagctgtgccaacctacagttctaaaccttttttcctggttttcaaaaactaaactgtgtctagaaaataaaatcaccttgatcagtttaatgcttttcagtttaggtttattatctaccttttagtgcagaaagaacattagtaatatcaataaattaaatcagttttttatatcttaaattttaactgaaatacactgtaaatgataaaatgccagagaatgttttttcatatataaattaaatatttaaaatcaggacatttcttacttactaatgaaatatgtcatatctggtgaatcttgcatttattatagatgaaaccaaatcaaggtatccccctaaggaacaaaatgtggggtaaatgaatgtgagttagcatgttagtaacataacctcaaaacaaaatgaatcccacagtgtttacaactttctgctctgaccctgttcctgaggttgtggt

SEQ ID NO: 125398 - DNA, 1143 bp, Homo sapiens
ccgagatattatgaaaaaccataaaagtgcactctggaaagtgctgggtcagcaaagagactagagggcttgacagaaggcagccatggaatgcaggcccaagggaggtgggcgccgggctgtgggcatgggatgtgtgaactgcccatgacccacaaccctgcacagggaagaggcggggccgaggcagtggagacatctttctttgtgagcatctgaggctgtgtgggaatcacaaaggtggacggccacggggaaagtttgggaggggatgggtttgcagctggtagaagcaagccctgaggcaaggcagcgaagagggatcacgtggtggcaactgctctagtgtggagagctgggccagagcccaggcttggaaacagagggaccttgaccaggcccagctctgccctcaccgctgtgtgactcggaaaagctacacagcctctctgaactctgtagggtggcagtgtccttgcctcactggatctcacagtgttagagcagatcacgtgagtgtcgagcttggcacagtgttggccactccatatgtgccatcatatgtgctgtgacattgctattgaagtcccttaataaagatccaaagtagggtgatttaaacatgcctaacatgaattaatgtgaccaaagaaccctcacattattttcctaagatctcaagccaatttatatatttcagattcgtccacatctcctgggtcagctttaaagacaccttcgtcaactggaatgacgaactctctcttcaagctatgtgtgaggactgcagtgaaataccgaatctgtcttattcctgggatctctttttagtcaatgcaacagaaaagaataggatagaaggtaaaaaggattaatagctttattttgttttctgagggaaaaactcagggttattgtgagattgctaaaatgttgcaaaatacatttggtatgacccagtgtgtctgatctgcctggtgaacggtccgtcgtgcttccccagcccctcttgcctctacagtccgtgtgaacacttgtgaggcaccagcagaagaggtgacacactcaagggctgcttctgacctcagtgtgatatggaaggctgcgcccaacacctgtgtaggcagttttattgagctaaag

SEQ ID NO: 125399 - DNA, 1058 bp, Homo sapiens
cttttcttttcttttcttttcctttcctttcctttctttttttggattatgctaagaactgtagcattttcaggagaatgaaacatttgaatatatgtaacaccaaaatgaaaggacatgatcggttatctgttgaacacctattctgggttagaaaaaatagggttggtttttatttctttcattcctttgaggcctgtgattcagagcaaattttccttttcagggcagaggtgctcaaatgacacatgggaattaaaatccgtgactaagctgcatttgctaaactgctttctgtggcatctgaccccaagaggtcagcccgcagagggtgctggtggagatcagcatgcagagaccaagtgcccggggcaatccggaaagggtcccggcccccacacaggcaatacccctgcccacctttagaccagcgagcacccacgctgttgggcaggtctgcgtgctgggggaacgcgttctctgggtgtgagatttggacccaaatagcaaagggactaaagcaaaaggcacagcaggaaaaagcacagaccctaggcaggaggactctggctcccgtcctgactctgctgttaggacatgggacagagtggttttcttgagttttttatctgtaaaacattgttatttttattttcttatctgtaaaacacagaaaataagattgataatttcattttttcttttctttttttttttttttttttttgagactctgttgcccaggctggagtgcagtggcatgatcttggctcactataacctctgcctcctggctttaagcgattctcctgcctcagcctcccaagtagcagggattacaggtgtgcaccaccatgcgtagctaatttttttagtagaaatggggttttgccatattggccaggctagctggtctttaactcctggcctcaattgatccacctgccttggcctcccagagttctgggattatggacctgaaggaccctgcccggtcattttttctttattttacgtgttttctaaaagtataaagaaaaaaatgaaatcatctcaaa

SEQ ID NO: 125400 - DNA, 1025 bp, Homo sapiens
ctgtgtgattggaagctgagacttgagtatcctagactatttccaactccccaaccaatttgcagcacaaggagctagggagaaatgtagaaagggtggcacccaccctcacggggagcttttcgcaaaaacacaggaagtagtgacttgtgggagataccatctttcgtgtctattaaatcagtgatgagagaaactctaccttttactgttactaatgtagctagagcagtgactcccaaatttttgctgacctcagattcacctgggggcttgctggccccaccccagtttctgacccagtgggtcaggggtgggtcaagaatttgcatgtctcacaagcgcccaggtgatgctgatgctgctggccctgggaccccactctgagaaccagtggaagtgaagcctttcatcaggtttctcagacttggcttctagctggctggacccaggccaggctgcttggcttctgccctcccaccccagtggtccactgtcatgaaatctgaagcctctccctctctcccacagctcccacggccttccgcctggcattcctcgcacccccagcttcacggcatcgcagtctggttctgagatcctctatccccctactcagcatcctcctgtggccatcctagctcgaaattctgataacttcatgaaccctgttcttaattgctccctggaagtggaagctcgggcacctccaaatctgggattccgtgttcatatggcttctggagaggctctctgtctgatgatggatttcggggacagttctggggttgaaatgaggctacacaacatgtctgaggcaatggcggtgactgcctaccaccagtactcaaaaggtaaggtgcatggtgtccttatcaggagcctgggaaggaggtcctgagctaggggacccaagaggcagtgttgggaaaagaaaagaaactgcattccgtttctctggactcagccaaccttcctggctccaagaatagtagctcagtggcacactgcggacgtaggtgggt

SEQ ID NO: 125401 - DNA, 1117 bp, Homo sapiens
accacgcctggcctatgtttaataatgttgaaataggatggaatattttgttaaattaacattttaaaattagaagacaccgttttaatttttaaacccttcctcctctcattgtaacgaaattaattccagctgcagtgagaaaacttaaaaatcatgatacaaaatgaaacaatatctgaaagtagttttataaaactgaaattgctgttaaagagaatgtgttagtgacttaaccatttgctctatgtgatgtttattatcaaatacatataattttgaagattttaatgaatggcttaagattttatctttgtgtagaatgtggctaaagaaaccttagttgagattcaagaagttggtgtctgtttctgattcttatcacaacttgctacttagtgtctaccaagtcctccacctctttgctcctcaaagagctgtgaaaaatgatggcaggagccggtacaacaccacagacttagagaagggcacagtgctgctttattgaatgatctaccaaggtaaaattttgccgggtcaagaaatagcaatttaatccatttaaaggaatgaatataatttgaaacattaacttatttcaagactaacatctcaaagtgttgagaccttttttaaaagagctttctggattttgagcatactttcactggctgtgatttataagaatttgtggtttgtggagtactgtcctaaatgccagggtaaaataaggcagtcccatgccttacctgccctgggctcagggcctcacatccttttggtacgcacatcttttctcttctcccttgttctgctctcccgcagcatatacctcctagccccaggcaattacttgtctaatatctatctctatatatttgcctattctggcttttagctttttttttttttttcctgagggagacagggtctggctttgtcccccatgctggagtgcagtggtacagtcatggctcactgcagtctcaaactcctgggcttaagcagtcctcctgcctcaccctcccaagtagctggaactacaggtgtgtgccactgcgcccagctaatttttatattgttttgtagatatgaggttttgtacgttgcccaggac

SEQ ID NO: 125402 - DNA, 1113 bp, Homo sapiens
ggttgcgtcaacatagcaggcttgcttctttctgcctcacggctttacatgtgctgtttccccagcctgaaaccctgtccccttgttcttgtcttcccatggctgctgcttctcctgcttttggtggtatctgaaatgtcacctcctcagtctaaggaaactcccccacactcaccctggtctctgtggagtgctttctcacggctataatgagcatttcatacagtttcatttgtttgcatttttattgatctgtttgttccactggaacactaaggacctttttgtcttatcaccacacttcccagttcctggaagtacccagagtctgttccataaatattggcaccatcaatattggtcgaatggcttttgagtgaataaactgacagcattccacttagatttggtatttcaacttttttgtcccgggtcttcgggtttgttttgttgttgcttaatattaacaacataaaaatatttttaaattcttttcttggcagttatctatgtcaagcagtagccgcattgtgacccatgacatccccataaaggtgattcctaggaaattgtggaaggacttacaagaaccggtggtcccagatcctgatgtaggtgatgcctgcagtcctgctgtacaccccacattaaatggcatgacttgaattctctagttttagttgtagtcttgcagtatattttatttttaaaggatacttaacgaaaacattagattatttgccttttgttatttacataaagcatcttaaaaatgttgcatatgatagaaatgtcatgccatcctatatgtagaaaatgtctcgctcagtaacatcacttaaaacacaaatgatacttttggaggacaattagtatttattagtattcttggccttagacaccaatttgggtttcacaggacttgatcttttcctcagccggtcaggagcgatatctggatgtgcacgaaagccaagaagagaagaatttcatggcttagggctaacatggggtaacggtcatgccgatggttaaccctagagctcctgaaagtaaagatgatgccaaagggcccatttcctcttgctcacaatttgtttaagaagaaagtac

SEQ ID NO: 125403 - DNA, 1032 bp, Homo sapiens
ccagtgtgataccaacgttaagtggttatttttccaccgagaagttgatgaacaagaaattctgcaaaataagttggtctctaggatacataatgtgcattttagtaattccttattttaacccctgctttaggaatcagtaacatgatagccaagcttgccaaaacctgcaccctccgcatcagccctgataagcttaacttcatcctttgtgacaagctggctaatggaggagtgagcatgtggtgtgagctggaacaggtgagcaaaagcttctgagaggcctgcacactctgcagattgtcactggaaagatcacatataccctccctcatccctcattttttttcccttaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctggtgagtaggagagtcagggtttctaacacagaagtcttggcctcgaaggaatagacatagttagcctagcctttttaacaataaatactgttgaaagctgtttggtttatttaaatttaaagatctggtccataactatattttgcattagagtcagttcctcctcattttaaaattgtgttgttatcatatgcattcagctagaatgctgctttttccaagccgtgaaacttccagcctctctgtttcttgtagtggtattgtcaccttgtctagaaatcatggtttctctatccattttcacctttgacatgttttctccccactcccaccctgcctcatctgctataataacctttaaatggcccctcgttcttcagtacacgtatgttttatatgctactgccagatgaatttagtgcacagctgtcctccaaacacacaaatacacaaactcatgcgcatacatacaatccagagttgctcttcctactcatag

SEQ ID NO: 125404 - DNA, 1021 bp, Homo sapiens
cgcccccaccttcctctgcccctctggccccgcctcccccgccttcctcctctccaccctcccgcgaaggtcccgggaggctcagcccgcaattgcttctcgcctctgcagagcagctgggcaattgtaaagaaccagcagccagttctgttactcattaaacagcccctactacagaggaaatcttcttacccacgtggtcctaacctggggcggaggaaaccgggctagaagcggctctaggactaacccaaggtcacgccgccaggcaggatccccggtctgtctgtctggcggtggccccgcggctggggccagcggagagaaatgacagcgtggaaccagccctggcccggtggtcgggaatgtggagctggcactgtcactgtgtgtaccctggatctctctggacggcctcggcttcccccctggggagtttctctgggaccttcctgatcctgggagttcccgcttgctggggcaaagccaggagctcgcccgaggaggggaagtgactcattcacttcgagtcgcagctaagtggccgaactgcctcaaaccggcgctgcactctgacccccaggggccggacctgcctgcccccggccggtgcccactctccgtctcaggcgtctttcctggtcctctccctgcttcccgaacgcgcactctggtgagagcacagagcctgggaaagaagacgacctagaggcccgggcagcccagcacctctgttacttgcttcctaaagggaactccagttcctgagaaaacatggggttgggccgggagtggtggctcacgcctgtaatcccagcactttggaaggccgaggcggatggatcacctgaggtcaggagttcgagaccagcctgcccaacatggtgaaaccccgtcactactaaaaatacaaaaaattagctggacgtggtgtcgcgtgcctgtaatcccaggtactaggcaggccgaggcaggagaattgcttgaacccagcgaaggatgcagtgagccgagatcgcgc

SEQ ID NO: 125405 - DNA, 2050 bp, Homo sapiens
ctagagccgcttctagcccggtttcctccgccccaggttaggaccacgtgggtaagaagatttcctctgtagtaggggctgtttaatgagtaacagaactggctgctggttctttacaattgcccagctgctctgcagaggcgagaagcaattgcgggctgagcctcccgggaccttcgcgggagggtggagaggaggaaggcgggggaggcggggccagaggggcagaggaaggtgggggcgggcggggcttgtctgcgggatggcccaggatgcggtcagctgagttcgccggcccagggcaggcggggcccgagcctagcggtaacccccgggcagggcggggccgctcgcagactccatatgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtggtgagtcgcccgcggcccggctcccgccgttctctcttcccaggggtctagcccgtcccctgccttggccacgtgcccatttacctgtaggggcggtgacggaggctctggtgcaccttggctgtgagctgcagaggagcagagagcggcccggcgcggctgcgcggggaggcgggcgcgcggccgggaggttctggggctggtgtgtgcggagcgaggtgggcgtgggggaagcgcgcgggcgggatgtgcttcctcgggtccaccccgtgcctacctctcccacgtcccggcgacggagcgcgcggggctctgggcggggagcccaccgggccgaggcgcagcgagggtgaagccagagccggcagggtcaggtcccgcagggcgcaggcgggcgcttctcgcagcccaaacccgggcggggagtgcgggaacccctagaactatgctgggagccccagataagaggaaggagatggtgacttaagtgacgaagtgatgttttgtccccaccgccttttaaagggagaagggggtaaaatttcatttggaggatgattgttacgcgagctttcagagttcagatggcgtcaagtggccatcgagtcaacatttaacaaaatgttaccgcataaaatattgtcatcgagttatctggcagctccgcagagaaacttcacaggcatatgcgttatatgacataatttgcatggggaagggggtcccttcacgattcttttatatggcaacctgttcttggacctggcagggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacggtcagtttcaaagaaacacagtctgggatccggagtagaaagaggccgtttcccgtgaaggccatagaggcagtttccaggcgcctgggtgacctgtctctgcacttccctctctgcttctccatccctgtttcctttccccactgtcccctgcctggcctttctttggctcattttctgccttcctggggtcttctggttaaaaagaccattggttccattcattggctgtaaccgcgggtctttaaaaaactttgtgacttccttgaatagaaagaatgtcttactctggatttctacaagcgctgctgagccattcccagggcaggcctttgtctctcccgcctttcagtttgtttgcccatctgcattttggcccaagctttccccatttctcagctgctcttacattatttcttttttcagaggctaccctgaccttctagtcctctgcattaaacctcatcaccgcagaccgttttaattcagcacaggtgtatcgagcacaaattatattcttggttccaatactttcagcactggtgggcattcatgttt

SEQ ID NO: 125406 - DNA, 1492 bp, Homo sapiens
gttttgttttttgagacggagtgtcgctctgcaacctctgcctcccaggttcaagcgattgtcctccctcagcctcctgagagtagctgggattacaggcgcctgccaccacacctggctaatttttgtatttttagtagagatggtgtttcactgtattggacaggcttgtcttgaactcatgatctccacccaccttggcctcccaaagtgctgggtttacaggcataaaggggacaggttctctggaggtgtgaggtgcctgtccacttaggcttttggcacattttcagcacctcctctctgaaactagcaatgctataaacacacatacacactctcctctctctctgtttctatttctcacacaattcacacacttacatcaggtgtgtaaggaattccacttcattgcactgactttctacatattagtggggctctgcacgatcttggtttctactgagtggattcactccattctgtgattttttttccttagggtcctgcctcagttggcggaatggcggccacgggagccaatgcagagaaagctgaaagtcacaagtaaggctccatttcattccaggttgggttgggtggggttgggttgtttatagagcatatgttgtgccacacatttttctaaggacttgacatatattaacacatttgatgcttgtgaaagagactgaggcctggagggattaatgactcaggaggttcgtacattagatggttaaagacctccggggtcgggtgctggggcctcagctcttgattcttaggacatgttgtttcagaaaaccagacaagtccctgctcaaatctctgtctagtaggtttttcctctatgtgccaatttcttaaacaaaatcccctgcttatcactcagctctgccttggttctgaattttaaatgccttcttatttctttgcagtttgtcatacttctggtatgcttggcatgacaccacttgtgtttaggcattgctagaaaagcaagaatttcttgtcttcattctgattcctatgtgaactttaatccgctgattattcttattttctcacccccccagttgtctcccacctctgctggggttacctgggcaggccttctgtcctgccgccatggcctctccccagtcttggtggcctctgaccttggcaccacccagggttgtggtgacctctggccccccttgctctggactcctggtcctttgttcctctgtaacttccctgagacctctctgaagtctcacatgtgacagctgcatacccaggtcataattccatatggacaatgctcttctcctcctccattccccagaagtcctggtgtccattttggagtttctggtgcctgtggacattccctgcagtgattttttttttttgagatggagttttgctcttgtcgcccaggctggagtgcagtgagtggcgcaatctcagcttgctgcaacctctgcttcccagtttcaagcaa

SEQ ID NO: 125407 - DNA, 1259 bp, Homo sapiens
tagctagtgtaacaaaaacaaaaacaaattgaaggtatgcagattggaaaggttatctctgggaggtaggattagaggttgtttttccttctatttctgttcatatttcctatggtaaacatagtagttttaaaataaattcaagtttatacatcgaatgaacttgattagaggagcaactggctatactccctactccttgtatgggtagatcaaacatttccatctgtgtactttcgtgtgctcttctgatttcatccctgttgccctccaaacagagccatgggagcaacaggggttaagagggaggagaagggggaagaacagaggggaggcaagtgcggaccttggcaatgttggggttgtcttatctccgggatctggccctgtctttctcccaccatgagcctcgtgtctgacataggccacttctgtgataatgtcggctgtcgggcactgatgttctataagccttccactttcttgttttttaacagtgattgccccgtcagacttttaaatccaaacatagcaaaaatgaaagaagatattctctatcatttcaatctcaccactagcagacacaatttcccagccttgtttggagatgtgaaggtaagaggccaggtgttgacaccttggaatttgccttaagatcaacctccccctatattatacaggtagaccaacccacaaatgcttgagagaccacagctgacaggtttatgaagacataatgtttaccaaatttttgcaagtttttaactttcaagtatgtgaactagcaagtaaaactatcctaagtagtgccaaattgttccctaattcatcttttgcaaatttagtgcagtcatgcattgtttaactctggaaatacggtccgagaaatgcagccttaggtatttcatcattgtgtggacaacatagagcgtaaccacacaaacctaggtggtagagcctactacttgcctgggccatatgcctctaggctacaaacctctatagcatgtgagtgtcctgaatactgtaggcagttgtaacacagtggtaagcatttgtgtatctatacatatctaaacatagaaaagctacagtaaaatcatggtattatataattttctgggaccgctgttgtgtatatgtgattccttgcttaccaaaacatcgttacatggggcatgactatgcatttgaaactatatataaaataaacttcctaatgcttcattgagagaagagaaagatgtaaaaatttccta

SEQ ID NO: 125408 - DNA, 2507 bp, Homo sapiens
gtagcccattttgtggggccctggtaacacagagggacagtgaggagttgctccctctgtttcaaacccaggctgtctccacaggccgccttctacatgacggagggaggccgagggtgcacaggacctggaattacctcctcagagagagcaagggtctggattcctgcgtttgtggagctgactgccttttgatgcttggccgcccaccctgaccactcaccagggggccttgttaaagcagattcctgggccccttagattcagcaggtcctggtgaggccagtgaacttatatttttagcaagttcattggtaatactgatgttgctggtctaggggccccacttgaggacctctgctatagacagtgcactaatgggggtctctcttctctggctgcagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtgtgagtacctgccttcccttgtgctcagtctctaggctctgcaaccccctgtgccccacccctctgcacacacagacagctggtcccctaacacctgcttactgtaaatggctgggagcagggtgagcccacagtagctgggattcagagattattgaactcaggctatcgtccttgaggctcagtctccaggggcgactaagtacacaaatgcatatacaccgctgtctgtctacacagtgtgagggtggcaggtgcagggagttagagtgcttggggtgtagaggaaggacagtagggggcgccctgcctggagcaggatggaaggagagcctcaaagtaccaggcctctaatcccctctaccacctcacagtgagttacttcaaaacacattttgatttagcaaggagcatggtgaacacagaaatctccagattctaccatagaagtcttttcatttttcagttttgattttgtcaggagcaatataaatgaacagctgcagagtaaggaaagggaaccccttttgttgagatgtgcacccctacctctccagtcagctgaggacactagctatgtcaaccaactagaacatatcagggagccaagacatgactaggttactgataatctgcgcaagcctttcctgtgtgtaaggctccgtgaccgattctagcagggatgcctccactgtatggctctgccacaggaacagcccctggaaagtgctgagttcatccggggagaggcatcacagaagttgtgacactagggggggtgctctgaagaggagagcaggagaaggaggtatgcagagaccccaaagagaggaaaaggcacaggcagacaagatcagcaaagcatcctgtgtccagtgggctgaggaaccagctgattacttagtttgtctgaagcagagggtgtagggagaaaagagaaaggagataaaactttaacctgtggtggggtgtgggagaatagggtgggtatttatgcagggcttcaaatgctagaaggagctgtttgttacctggcaatagcagactgctgcttccctgctgagcccctgggtccgcagctgttacctatttgacaaattgtgtcgatcaaatggggttttgtctttgacagctttgcatacactttaaagtttcccaaagtgttactagttcttaaatttatatttaaaaagtttatctttcatcactatgtcaatgggcatgttagattgaattacatcacatgaaacatcagccagaacattgacaaagtcacaaccttggcttaacatgggtgtttctccctggttccagcatggtatgggcattccttctatctcaatcatgttgcatgagctcataaagctgctgtactatgcccggtgctccaacgtcactatcatccgcattggcacttctggtgggataggtaaggtctgcagaggggcctcttgccctgtgaatggatgagggactggggcatgccaaggcagcttctacatggtgtggcattagagacaaagagttcctttcttggctttgttcaagggaagcttgttaacaggaggtgtgaaaagaagcttgttttgttgtttttgtccaacctgttctcccaacccgcaccccagagctaggcagtagaagggcaccacaccatgcatatgggggaaactcatccttttggggttacacaatttgtgccttcttgtctgcttgattctgtcttattctttctaatcccccttcttctccattctctcctttcctttgcttacttttcctcctccctaatcctgcagggattttgaagcaccttaggagaaaagacacaggaaaatcaaaggggggaagagagaggcgcagtacaaaactcagataagtgtccttaaattagcttaaaatgtccctatcctcaacagggacattttttttttgtttaaaaaa

SEQ ID NO: 125409 - DNA, 1136 bp, Homo sapiens
tacagacacccggcacaatgcctggctaatttttgtatttttagtagagatggggtctcaccatgttggccaggctggtcttgaactcctgacctcaggtgatctgctcgtcttggcctcccaaagtgcttgggattacaggcgtgggccactgcacccagccctctactttgttttttgtgcctttctcttccatagtgtccataatgatcatgcattaattactttcatagcttaaaaaaaagttgaatgggaaaaatgggtcactgtgtatttgagaacagtactggatgcttcgtgtttggatgtgtgggtggatctgcttctttcttccatatgctctgctgtgtgctccctggctgccctgctttaattttattttgttttacaccctgcatatcttgatgtctgcttttttcctcaggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaaggtgaggcagcggatacgaggaggcatctttcagccagggaaccctggtccgtcccctgagcctgccttctcgctgtggactggcgtttccacttgccaggctgctgtctcagttacacttcgcccagagtggttataatgacccgtttgagtggtcattataggcaggacctggatgggtcttgcttgtccctgtgtccttctgggcatcagtggcgctgatgtgttgtaggagcttctcacatgcatgtggttctcatgtctccatgtgtgcctcagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaaggtaagcggcacttgatgggcctcggcgtcccctcctcccttcacttctgctctcctggagcccctcgctggggcccc

SEQ ID NO: 125410 - DNA, 1056 bp, Homo sapiens
tgtggatttattctccagaagagtttaagatagaggaaaattcagatcaaaacaacaacaacaacaacaacaaaaacaaaaaaaacccaaaaacacaaaaaatagaagatgtagttgaaacttataaatgacttgaatttccttttagaaaaaaaagttgggaatcagattcttttaaatacaattttgtctgtgcttcttgtgtggccttaggaaggttacacattgatctcttcaattgacacccagaggtgcagaagccaaaagctcaccagggatgagacgtagtgtttacctctctccctgtctctctccctgcctcctttctgtactcactatctctgtctctctccttatctctctttgttactccctgtgtgtctctctctgtctctctctctgtgtgtccctctgtctctctttttctctgtctctccttatctgtctcagtctctcttccttcctctctttctctttacagtgaaaatctaaattccatataggatgtatatggaaaaagactaaaagagaagacaaaataaagacagtggatggtttattgacgtgaaatactgatatgtttttctttttctaatttgctttttattgccatgtgctaacattataaagtgaggaaggcttagcagaacaaagagaaatagccaagaatctctcttcctcctcctaattgaaaactctggacaacttccatgtaaacaaaaaagtgttacttccactagttttgttctcttttaaattaataaaagaagagaacaaatattgattatatcaccagtttttttctcaagtattatggcacatataaatctatgtttatacatcattttttgttttaaataatttttaaaacaaaaatttatgagcaactgttaagctggcagatggcgcttgggtgcttctctaaaagctgttttcattttttcttaggcttataaaataatacgaaaatgtaatttattttcaagacaaatttaaaaaaaggaaaggaaaattttaattaattggaaattgagtatacctaatatttgtctcttt

SEQ ID NO: 125411 - DNA, 1029 bp, Homo sapiens
tgaagatagtttcaagccctgatttctgtcatctatgaaaacagtaagcaagttgcttgtattctcctcctagctggataagagacccccgttttcatggacagcctccttgggtggacagaagtctcctgatcttgtctatgtaaccagcacccactttgcatttttccgcaaagaaaagaggagcttaaccccatttacgggaaatccacgcactgcttgaatcttacgcgccccgtggtgacggtgttgcccactctgttcccttcccaccaaatcctgccagcacctggcagtcatccagtccttgtcttagacttcaccaacctttcccgtcataacatggcttagaagttgtccgaatagtgctagaagctttcagccctggaatgctcagcatctgccatctaacttccatttaaaacgttttgagcatttgctgatacaggttcctctgtcctttccccattattttcagttccttggccttgcccatagtgatctgtggatattgtctgcatactcttttttagaaacctagagcatcgcagtgtccttaattttcctcttcaaactctatatattcctgagctgatcatccctactgctgttcctacagaactgtgtgactaatcttctatatatgtccctacatctagccatctaggtggagatctaggtacctatctccctaaaattgtacttggtatccacattgacctcaggacagtatgtgataggctcttgtgccttttcgactaggagtttgaaaacatccactcttcatatttattgtcacatttgttgaataataaaattgggctcttgtccattatgtctcagtcagtgaaagagcccagggtgggcctgagccagagtgtttgtgtccctagttctcttttggttctgttacagctctcagtgacagtgtcattgaggctaacaaggacagagtactgctttcagccaccatttgtccaatgagtggctgatctccaggcctctggctttgagaacatctgtgatatc

SEQ ID NO: 125412 - DNA, 1068 bp, Homo sapiens
aattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtgg

SEQ ID NO: 125413 - DNA, 3968 bp, Homo sapiens
gattcttccaatggttcctctcactttgcagataagaaaactgaagaaccagctgggcgcggtagctcacgcctgtaatcccagcactttgggaggctgaggcgggtggattacctgaggtcaggagttcaagaccagcctgactaacatggcgaaaccccatctctactaaaaatataaaaattatccaggggtggtggcaggtgcctgtaatcccagctacttgggaagctggggcaggagaagcacttgaacccgcgaggtggaggttgcagtgagctgagagcgccactgccctccagcagcctgggtgacagagcgagacactgtctcaaaaaaaaataataataaaataaaaataaaccatcagtgatagtaaaaagctcacttaagctcattcacctagttttatagatcagacttaaacctcttgtttattttgttttgctttatgtatctatagttccattgtttttaaaatttaaaattaattttaaaccttatgaatgctttccctacagataaaattatgtaactagaacaatttaactcatataaattattatttaatcaagtccttaattttgaagacttcatattgatatgtcttgaatacttgaaatctatagttaactagatatttctcttataacctgtccttataaatctacattataaataaaaagtccagtgtcccttccttcagattagcagaagtttcaaaattacatttaaagtattttctttgttttccttcatactgattttcatttttattgtttgttatagaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagctcatgatcgagaccggacccaagacttcccggagagcaatcgtttgaaactccttcagaatgcccagccacctatggtgactaacactgctaggacttgtcctacattctcagcacctgtaggtgagtcagctactgcaaaattccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggctttatattcccctcccagaagcttcagccaggaaacagatagtaattaatctaatgtccaaagagcagtgttgcctcagtgaagaagaaattgaacagattgtacagcagtctgatgcgttttcaggagcagacatgacacagctttgcagggaggcttctcttggtcctattcgcagtttacaaactgctgacattgctaccataacaccggatcaagttcgacccatagcttacattgattttgaaaatgcttttagaactgtgcgacctagtgtttctccaaaagatttagagctttatgaaaactggaacaaaacttttggttgtggaaagtaagtgggatacttggaatcaaggcatctctgtagtacagtcttctttattttttagcatagaaagttggggatgtgttaattgtatttttaagaatatattctaagttctgtacttcaaataatagcacagattttacatctgattgacatagtgtatgttaatgtaagttttgctttccagtgattacctgatacgtaagcctatttgaacaaagtgagaatgaacttttgtttctaagaagtctttatcttgaagctatataacatgaaaagtgagctcaaattttttttagttgaagattacatataaagttgtgtctgattaatattcatcttttattgaagaaagtgccttctgatggccacataattcttaatgtcagctagtataatggtttacatttggacaaagtattgcttagtgttatttaagtagatttaagatctcaaagctaaagtgccaatttttactttcttcagccaatttgttacctcttttatggtttttaatttttatcaggactaacattttcagaaatagcaaggtgtgatctagtattagattcacagaactgaaaggttaattaagaatgttggttattttcacgggagcgtgtgatatttaacattaatattttatttgacactacagcctgtaatactgctctctttcaaaaacaagttttcagatttttataacagacccattttgttttatgaaacatgttcattacagaaacatgagaaaatagagataagtaaaaagaataaaagtcactattatcctaccactttgcgggacacactattaatatttaagcatagattcttccagatgttttgttttatacagcagtaggattgtgtaatgtattctctcttgtagcctattcttcaaagcgtatcttcactttccatgttaacataaatgtccttttatgattgtctaggattccatggatggatggaatataattgagtcatctggtagagcgcatataggacaggacgctaggttgtttatcttttgtttattgtaaaggaactatgtgggatgcatttggtgatctttttaaaaaatgtataaatttcttgagtaattcctggattaaagaatatgcactttttaaagcttttggcttgca

SEQ ID NO: 125414 - DNA, 1893 bp, Homo sapiens
gagccaggtgagaccaaatgctctgtttggtttataaggttttttttttttttttttttttttctttttggagacagagtctcccactctgttgcccaggctggagtgcagtggtgtaatctcggctcactgcaacctctgcctcccgggttcaagtgattctcctgcttcagccttttgagtagctgggattacaggtgtgcgccaccacgcccagctaatttttgtatttttagagatggggtttcaccatgttggtcaggctggtctcgaacttctgacctcgtgatccacccgcctcagcctctcaaagtgctgggattacaggcgtgagccactgcgcccggctgaggtagcttttaattcacaatcatttcaagcctttccaggaggcttccttgttcaaattaaagacagcactcaggagaaggagcaggctggggtcagtgtcattgtcaaggggctgccagtcagagtgtggcactgccactccacctactatgtccttttgcctcacctgactcttggagctctgaggcgaggaggagctgcagccgtgggaaagcctgcaggtagcagagcaggagaggagacttgagcccttggaagagcacaaagtgatgagacctgggaggtgcacagaggaccgagagggcaagacacgctctggatgtttgtgggaggagcctcagtccatccatgtccaggatgtgtccagtcaaccaaccttagtgttggcatcgtgcttattagactcatctgctgtcaagcagttgttttcattcttgtttttgttgacagttttcttctaggacttttatattctatttttttaacagttctattgagatataattcactttgttcatttaaagttaacatttgggctgggcgtggtggctcacgcctgtaatcccagcattttgggaggccgaggaggccagatcacttgaggtcaggagttcgagaacagcctgaccaacatggtgaaacctcgtctctactacaaatacaaaaattagtcaggagtggtggcacatgcttgtaatcccagctactcgggaggctgaggcaggagaaccacattgaacctgggaggcggaggttgcagtgagctgagattgtgctactgcgctccagcctgggcgacagagcaagactctgtctcaaaaaaaaaggctacgtttgagtatttttagtatatctacagaattgtgcagccatcaccacaatctaattctagaacattttcatccccctaaaagaaaccccacacccagtcatgccactttccccatcctcagggctactaatctgttttctgtctctgtaggtttgtctattctggacatttgtataaatgaaaacatacaacatattgccttttatgactgttttcttcacttagcataatgtcgtcaaggttatggcttttattttatttgcataatttgtagatgccaccaaacccatctgtgtactggtttctgtccattcttctctcatgccatatagtgagtcctctcatgaaggaagtccaaggcatttttcagctgacaaatgtttccttttgtaaaactttgcttgtgcctccagtctgcaaatccagtttctggaggaagcgcgttagtcaaacactgtggctcacttttctgcctccatatctgccatcttggcctcactctctcctggtctaatcctctctaatctgaatttcaggtcctctcatgctgaatgcttcagtgtgtcatgtggctctttactaaagcagaagtgatgttgctatggcatcacggtccctctccctccatcctcattatggccagaacttgcttggtctccatctgtgtgcactcagcctactttgttcattgtaattgtcccacctctgct

SEQ ID NO: 125415 - DNA, 1007 bp, Homo sapiens
taatttaaaatataatatggatacattttatgtcacattagattatgtaaatttgaaaatgcttttcatttgggaatataaacttttaattttaaaattcttgttccattttatgagagtataatctagatatagcaaaacatacaaatcaactctaaatacatatacccacccccatgtacttaccacccagatcaagagtagaacaattccagcactccagaagactcccctacccactacaagttactactcccctgggcaaccctacctggcccctaccactgtggattagttgtgccataaacttttattatcatgtatggggtcttctttataattaaacatttataaagaaaatgttttctttttcttactcttgttctttggcagtttgcagattcattcaactttaatccccacaaatggctattggtgaattttgactgttctgccatgtggtaagtttccctgctcacagatgtcagttgcctgtccgaggtgacagtgaaagaagctggcagggaagatgccagagccaaaggggtgcaatagtcacttagctcactgcttgctgccttttctgaacccttgatggaattattgctaattcttagcctcactggaaacttttatctagggaatatcattgcaacatactggcataagaaatgagaagcctaaaaaggacaattttttatttgatttatccagcattgacagaaaacaaatgcaagtacacacttctaattcagtagcttgtgttttcattcttagattcgtaaccagtcttagtgtaatgctaagtttaagcaatctgagtccaaatgcttaaaagtatttgctaaggccgggcacagtggctcacacctgtaatcccagccctttgggaggccgaggcgggtggatcacctgaggtccggagttcaagaccagcctggccaacatggtaaaaccccgtgtctactaaaaatacaaaaaattagctgggtgtggtagtgcatgcc

SEQ ID NO: 125416 - DNA, 1033 bp, Homo sapiens
ctattccactggggttgcaggacaaatggcactgggatgacttggacttgatgcattaaaaaaaaaaaaaaaaaacaacttcctagcatggaatatgaactatattgaacccagtactctcccttaatcatttttctcatgtcaagtagatgatagtctcattaggaaagcattgttaactttgggaaaaaggggcttccttttcagatattgtctttcacaaggctctgagaattggtgaaggcccattcagtggatgaggacagtgaggcacacactggagaacacctttgtgcagagcacatggccagtgtggccacgcgaaactagcaagcaagtctctccacttccagtcctgagaatgagcaacaagactgataattttatgtatttgtttctattgatgttgtgacaaattttgtggctcaaaataagacaaactgattatcttacagttctgtacatcagaagtctgacctgggtcttactgggctaaaaccaaagttgacaccttggaggctccaggggtgaatctgcttccttgcctcttctgacttctagaggcttccaaaattccttggctcacagccccatttccattttcaaagccagctgtgtcccatctttctgacctttcttttgtaaaccccaaatatctgagatgggtctcagtcaacttagtttattttgccaaagttaaggatgcgtgcctgtgatacagcctcaagagatcctgactacatgtgcccaaggtggttgggcacagcttggttgtatacattttagggggacatgagatgtaagatgtacattggtttggtctggaaaggtgggacaattcaaagcagggagggggctttcaggtcataggtagataagagacaattggttgcattcttttgagtttctgattagcctttccaaaggaggccatcagatgtgcagctatctcagtgggcagaggggtgactttgagttctgtctgtccttcatccaaaaggaaattccttatgagggaggcatgtagcttttt

SEQ ID NO: 125417 - DNA, 1049 bp, Homo sapiens
cacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttctattgctggtgatatctgtttctaattttaaaacactggccaatcatgaggtc

SEQ ID NO: 125418 - DNA, 1549 bp, Homo sapiens
aaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaag

SEQ ID NO: 125419 - DNA, 1036 bp, Homo sapiens
agacttggcaccaccaccaagtgtggagcagttcccatttgtccctgtctgggagggaatgctgctagcaacatgtgaaccaatacgtggccctcatgtctccccatgatagaaaaagagagaaaccaagaacatgcaacaaaaactgttacgtttgctttccaaaaagaggttcattcattgaaaatggattttccagaaggaaaacaaatcaatgacttctgttgaaatgtttattcagagaaaaatgtctttctgtagttacaggaaaaaacaaaaacaaaaacccaaaaccaaaaccaacaatctaataacctgttgatggttgatttacagaactaaaaatttttatcaggcaaaataaggagaaataaaaatgggaggtgatagctacctaaatgaggaggatatgtctgtttccaaagcgaagggcattttgtctccaaagaaccctgaggagagccaaagaggatgcctggggcagccaccagccccaaagggggtggccaaacccacgcaggcgcccatccttgtggacaatactttcctgtctccctgcgcctcccctggaaagatcatgggaaagttgcacatggcagtgtaaacacacagggggacgtgtccctggtggtcagatccaggtggacaggtgagggcttggtgccctggcaaaggggggcccaggaactcgggataaccggtgggctgtgaaactgactgtgtatcctgacagaagtgtgcttttctgaggctggtgactccagagggcgcctaccatccccagaggtgggtcccaagacaaacaaaacatcaactcccttttcgtcactcacagcaggtcagtgaacacaacgtggcaggtgacccctttctcagagatccagagctgtgcagcctccggatgcagctgagtgcccctggcacaaatgctccaggcaccagtgttccagttggccatcgactgcacatctgttcaaagatcttccctccagttttaattttctccatgatttaaagatatgtattttcaaatgac

SEQ ID NO: 125420 - DNA, 1025 bp, Homo sapiens
tctcgaactccccaagctatcctcccatgtcgaccactggaagtgcttggtttacatgtgtgagctgcagtgcctggcctagaagaatgatgaaaagtacttcttgaggaagacggaatgtggatactagggaaacagggcacatatgggaaaataatatgtgatgaataatcaattgtgtatttaaaaatattaggtgcgtctaaagtattgactgtaattactaaaagaatgtgcatataatctatagttcccaacctagcagaaaaagatataagggaatatatatgaaaaacacaacaacaatcaaacaacatcaagtagaaaacggaagaaaaaacaagatgtgaagagaaaaaagatattaaacaaaatacaaaataagatagtaggagtaattccaagtcaattcgtgatagtgttaacaaactcaagttaatagacacacatagctccctctacccaacagacagagactcttgattcttttctaaaacctgtgtaactttttgaaaagttgacggtatatagaaagttgcactgaattttaagcaatctatttcatgcttgttctttgacccagtgtgaataaatcagacgtcaacataaaaagttgaaaacaaatcacataaacatgcatgaggaaactttaaaacacacccactcttattttacttatgagttagagaggaaattgcaatggaaatatcgatcatttagaactgaatgaaagtgaacatagtacaggtggaaagtcatacaatgctgcaaaggtggtaaggctaactttctaagcttcaaaaaaagaaaaattgaaattacagaaatgaaatagaataaggaatgtagaaggaattaattataaaaattaaagtcagaaattgttgaaacagagtaccaataggaacaaaatcaaacaccagtctttggtaaaaacgaccataacagcaaacctgtagcacagacactcaggagggcaaaaggtgcccaagaaaatcatggtaagagcacgttagcaagtttta

SEQ ID NO: 125421 - DNA, 1036 bp, Homo sapiens
ttcttaccatttgggagaaaagtttttttgtactctgaccagggcttgcccagatattttcatgttggcctcagcagcctgtgtgaatacaattgtaagtaaagagcatcccccttgttccttgatacgagacacctggcttgctgacttttctttttcccccatctcaggcttttggtggaagcagctcttgtttttgtttaaggatcagtttgactgaaatctctgcttaaaaacctcttgcttcctttcctcttgcatagacctaaagtgtaatatcaaaacaggcagtgtcactttgggtgagaaaaatggctctggctcatttattatgaaggttatttccatttgagggactagttttgtacaccttgcaactggcagaataggagtgctgatactgcagcttttaccaagttcactaatgttttaggattttttttttcagcctttttcagccttgtggagtttctgcatgttttaggaattctctgagtgacagattttgtagttacccatagctcggttgttaaggacatgttctctgattcagccccaatgggtctcacacccacgcttacgagatgtgattcgctgggcaagctgctgtcctcctttttcctcatctgtaaagatgaggtagcaacagtacccattagagacaggatttaagtgggaatgtgtgtaaactgtctagcaccgtacctggtacccaggaactataatattagtagaaaccctgccatttttacattaatatttaataaaagtataattacatggctgagggagggtagttgtgaaatctgtaactacactgtatctgacggcttgtgtgtgttcagagttctagagcaggcatatgtgcagttggtagagagggtatcaggcattggaagggaactgatgagctgggtgatgcctccgctttcaaaatgcaggtgacacaggtagtcactcttcactcggctgcaatagcttaatagacttgcggtttgaaacattttacttctttaagtgcatcctgtgtgaaatg

SEQ ID NO: 125422 - DNA, 1048 bp, Homo sapiens
tctgatttgggtttttttttttgtaaaaattaaaatttcagtaatgttcaaaatttatttctttactggtgtgcataaaaattactgtgtgattaaaaatcattgtatttcattgtttaaaattttgtatgtttttttgactatacatttaagagatttgtcttttattatatttcttggatttcaattttgtcatgctttgctttccgatttttgactgtatatttccctctttctggttcaagatggatgggttggtgttcatttattttgtctttataaaatatgcatttcatggcatgagtttttcttcttttatttctcttgcttcattttatttgtcttgacacatgggggtgtgcattgtcctaattgtctaggactgtattgtatctttatttcctccttgaaccacttatttaggccagagcttgtttttaattttcaagtgccttcgttttttttttttttttttttttttaaacacatgttcctaatttctggttttctttatttggatgtagcatggagccccttggcacattggcctacggtccctgtctcagtgctggacatttggggtcctgtctgcagctgcatgcaggctgggaggaggcagcatgtaacaggtttttccttggggccgtgttctgcaactccagagatctttgcatttttgtaaaatgcactactcttctttgtggtttagtatttttaaaaaataataattttgcaaatgtttataaatatttgcaaatgcctgtttttcataaatatcaattaatgccttctcattactcattccaattttatttctttgtcctacataatagaccaacatctgcaacaactagttttcctcgttttctccttgagactctcatagtgtttgtttttaatgtaaactttttattgaagtgtaaactttttattaaacttgcttctaattttagctctttgtattttgatactttgctgtttggaggataatactgtttttattcattatcaattatgcttttatcaatgctttttagtatttggatta

SEQ ID NO: 125423 - DNA, 1013 bp, Homo sapiens
atagatgcagagaccttgaggagcataagtgaggtacaaaggtgaaattctcagcccgttgctgtccatgcattgctgtcccacccatgtccttagcaggggctctctgggtctcctgaggacagggtcggtggcttctgcccaagccccacccttacacacagaccccctgcttcctcccctggcatctgggtaccccacactgcagactgtgtggtgggccagccctgatggagagacccgcccaggaaagcaaagggctagcaaggcacgcggtgagttggtggcaagactgtggcttcagttggtgcctctccactcaacttggaaaacaccgagctatgtgtgtttccccagacacaccatgtggactcttccatgctttgcactagaactcctattcatcctccaaagcccagccacgtcccatgggagaccaggcatcctcatgccgctgccctgtggaaggtggcacctcaggttgctgtggcacctcaggttgctgtggccactgcacactagaatccacgggcttctgtgacttggcactctggggccaggtctcactcacgtggggcctttaggcctaggaacacagtgctagcactatatgtgttttatgaagggaactgagcaggctgcaacatgacctgaggcagattctgatggagcagagggcagacggttccagaccatggggcctggcacgatgtgagtggaggggaaggcggatgtgcggcaccagaacagggaagggtcagacagaagatggccttgggctgtcagaactcagcagaaggaccaaagtgccagggaccaactgccagggttccaggaggctgagaagggttcaaagaggatgtacaagaagggctccaagtcgagcatccccaccccagtcctgtcccagagcctctgatgggctcaggaagtcaaggctccttcctcccatctgacagcgtcattactaaggaaggcggggactgatttttctattttcctgcactacgccc

SEQ ID NO: 125424 - DNA, 2061 bp, Homo sapiens
agggcccacctcccagttcccttgacctcgggcctctgcatcctgctagtcgtccttccctggcagcttttacgaggaagctggagcgtgagaaggtctgtgaggacagccctgatcacagcctcctttctgcaggtcaaaggaactgggaagggggttccaggagtactattgcaagagtggctgtgcacagagctctctagcaccagaagatctgcatcctgggcttattgacataccaaataactgtgaatctctcttccctgcaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcatcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatcttagctgttgtgtgaatttcatactacagttggtttggatacccctcttccaaaatgggaaggacggattcagttattcaaccaacacacgtttctggctccctcctgcactcctccattccctgggttacatgcagctgacaaacaggcaaaaatccccacacttgtgaaattcatgttatgttactatggaggagacagaccatagatgtgatataagttagcaaaatgttgagtacatttaggcgctgataagtgtaaagaagaaaaaccatcgggaaagtgggacaaaggagacggggatgaagaaaggcccagtgagaaggtgaccgttgagtaaaaccctgaaggaagtgagggagcaaactccggatggacgcatgactggcagcgagaagagtgagtgcaaaggccctgggggcaggacgctgcctgggt

SEQ ID NO: 125425 - DNA, 1099 bp, Homo sapiens
cataacaagacccccatctctacaatacagaaatgagccaggtgtggtggcacgggcctgtagtcccagctccttgggaggtgaaggtaggaggattgtttgagctcaggagttcaaggctgtagtgagctatgatcataccactgagcttgcatcagcctgggtgacaaagcaagatcctttctctttaaaaaataataaaagaaatttttttaaaaaagtaaaatgttaaaagctatgttaaccttgaggaaaatacaataaattcaggggctcccagtgcgtgcagtgttggttgtttctccataggttctcagtagatgtagagtttcctgggtcttcttttgggtgttcagcaacggctccagaacagcattgctgggagcacatcctgcaatggaggggtgtccttggctttcccagcaaggcagtgcatgaatctgtaggtgctcctcctccccttagcagtgcagcctcctcctttcaatgagggtgcccagctatgctgggaaggttttctgggacagtcgcaggcaaattgggtgattggtcacccaacctgtaatacacaaatttcacattggcagtaagctgcccatgatcaaatacaaaagggtaaatttgatgtaggaggaataattaccttaacagtgacgttgccatttttcaaggcaattgaaattacatttgccttcacggtgtgaatccaatgatgtctctgcctctgtatttgtggctgccagagaaacttccagctgtgtttctcctccagctccaaataagagcatttgcagctcggctgcatgtgcacccacttcctcagtggaacacccactcctcctgaaggcagtgttcagatctgcccccaccccacactcagtgcttgcttccactcagccctgcgttcttattaaaggcaaagctgtatgcgtctgactgtctttgtcgatctgttttaaatgcattatttcagaaggcctggaatgtacaagtaccctcctaatccatgtgtatatttaaaacattcatgtctagtgcttcattctacaagcatttccggagaacctactagggtccgggcactgtcggagctgcttgt

SEQ ID NO: 125426 - DNA, 1090 bp, Homo sapiens
tgtcactctactgatcccagggtacatttctgagattctaaagctgtttctcaatgtaggtccataggacatctgtatcttgaatcacatttttcagcctatgaatctgcaattttccattgctatccaagtgactttacattaaggttggagacgattgtctatctcatttgagcctttcatgcattttgaattgcaccgactgggatcctgtgaaggccatgaccacactctgtactcactgctttataaaagtcatctcagtgactggtttctgtatctttttcttttaccctctccatcttgtgcagagtcatgaagggcctggggcccagagatgctgaaagctggcccgaggtccacaaccagcaagcggaggagataataacattgggacttttggcttctgagaatgcgttcctctgccttacagaaaggaaaaaaaaaataagttttgactagcccgaaagaacagaggaagttgtgctgtgagaaagaaagtggggagaaatgcacaggccacggagagagagaggccgggcctggatgaagccgtgggcgttggtgccgtgcgaggcccaggcatgcttggaggaaaggtcaccgtggctgtaaagtgctagccagggcgggagccgggcttgtgtttctcgcacagtctcagccatctgtcagctgcttcaaagggcattcaaaagtccaggttttgattgtttcttggattagtctgagtcgtgtggcctgccttatccaccctggaaagttctaggcaattaatatttatgtggcatttctgaggttttgatgccccgagccgtttacaagatgctcccgggctgaaagctgggccctgagttccttggctgagtcctacgttggaaaccacgttcccctcagtctcattatcactaccatgcccggtgatcccagagccttcctacacttgacgctttatcacagaaccacaacaaatctgaagaaagcctgccctaggagggcaggaattgggtgatcgacctgccctcctggcctctgttcagcattcatcagggagactcaggtgcagggggccaaggtggcctcacctgga

SEQ ID NO: 125427 - DNA, 1479 bp, Homo sapiens
gccaacagagcatgggggcagatgtctcggccgtggagtggacaaacttcctgggcttattgcaaaagaactgtctcaggtccaggggtaagataatcagctgtgtgctgctctctcagaacctttggggacagtgtcactgccttagtctgtttgggctgctataccagaatctgacagactgggtggcttgtaaatgacagaattttattgctcacagttctggatgctcaaagtctaagatcaaggcaccagcagattcagtatcttgtgagggcccacattctggttcatagacagtgccttctctctgcatcctcatatagtagcagaggtgagagagctccctggagccttttttgtataagagcactaatcccattcatgagggctccacctcatgacctagtcacccccaatcctcatctcctcatgccactaccttgggcgttgggatttcacagctgaattttgggagacattcactctatagcagtcatttaatcatctcattgccaggtggcatcctctgcttctgaggagctccagagcttccgagatgccgcactctctgctcagggctcggaaagtcctctgctagaagaccttggtcttctgtccccaccagccattcccccaccaccccctccaccctcccaggctctctctgcaccaaggacggcctccaggttcagcacgggcaccctcagcaacaccgcagacgcaaggcaagccttgatggacgccatccgctccggcacaggggctgcgagactgagaaaggtgatggcgactgtgtgtgcgcatttcaatggggccagagggttggaggtgcagcgtagatccagggacacgcttgcctgtgggcaggagctgcgaggcggtcacatgggagtgggttgagagagagccggcgtcactgtgtctctcacatgtgctgaccagagtggcagatgaaggctccagtccacaggtgagaaagtcagcctcctgcatggtaggtgccagctccagtcctcagctccttggtgatgatgacaggtggaatctaaaccccactgtaacccaagctcagttccaccctaacccacagtttctactggtccatggagaggatggaagatcatccatttggggccccacagagcacacatcacaaactcatggccctcagctggcacggaagccgccagtcttattcattcattcattcattcattcattcattcattcattcactcgtacatgcttgcattccagcctaatgttggacagttacggaatctgaagtcccttgggcagagcatgcactttctggatttccccggcttctccattttggtcttgtgctggtctgcacattactgcccacctggcccctgcaatggaattcctagattaaagggctgcttgggccagatggcttctgagacgtgtttcaattctgacatgattcagtaatggattgaccctccgtcc

SEQ ID NO: 125428 - DNA, 1034 bp, Homo sapiens
ccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaaggtgaggatggcggcttccggggcaggccttccacacctgcccacttcagtgcactggtctcagagtctcagaataaagcggaggagagagagagacgggattaggataacagtgaggcttaccacacaggtttcattttaactagaattcccatcatactgcctccagatatttgtactgaactattaaagggacaaaatggatgggtgtgaggctagtccacactgacttcaggcccctggctgccctgtgggaaaggtaacagccagtgatgtccatccacagggccagaggaatggagaggccaggggcaggcccatccatatggttatccttgaacaatggaacagaggagaaaattcaggcagggccacttctttcccatatgcatttgtagcagcagcgaactgtcattcttcagtaacacaggagtaattgtaggacacgccttgcccattgtctaggcacttaacacaccacaagtattatctcatttgcatgctacaccaatgctaataatgagatatttcttccattttgcagatgaaactgaggcacagtgaggccaaggggcctcgtccaaggtcaggcactagttagtgggggccatggattctcttctgggtctgcaagatgtaaacacacacatcggctctggaacactgggatgaatagcaggagtggtctgccattaagaggcagtttgaaactacgt

SEQ ID NO: 125429 - DNA, 1035 bp, Homo sapiens
atccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagcca

SEQ ID NO: 125430 - DNA, 1049 bp, Homo sapiens
gtgcagtgttgaggtgaggtggaccagcctccagccacgtgcacatgcttggcctccagatggcttcactccttcttgccaggtgccaggtgcaggggactgctgtagcgcaaggcacagatgcaagcaaatcctggatcacgtgaaccgtcttttgtgcggtggaattaaaactttgacttcagtctgcagagtgaatgaaagctgtgtgtggtttggttactgtaacactttggggccccacacacacaccatatatcacatgtccaccacatacaagacatatactccacacatgcacacacgctacacgcatcccacacatacctgtgcacacacatgggggacacacacacccatgaacaatctgcgtctccgtagttctgaggacaacagcagtacagtgagtatgtgactgcttgaatttgagtatgagctgttctatcctcagatattcctggaaaggagtacattaaatcaatagtaagagaaatgagtgctcctttctctttggtcttccctagaactgaaaaagctgtcacagcctcaaatgatgaagaagacctattaattgctggagagttccgtaaaacccttgcagaacttgatgaagacctggaaggtaagaaccacctgatccgctactctgatattatgctgcatgaaagtaggtgccaacagtaacttcctctgagcatactttgatgtatctatgtgaggaaacagccttcagaaggaattccaggtcagtttggtgaaagtctggatgtgaggcgcacacaggtttccggtagactgctttttatctgggctgccaagcagtacctggaaacatccagacaactgcttacagtgtgctctgaataatactaattcagtgcattaaaaaagtatgccacacatgttaaagaataaaaagggtggcgcaaaaaataaacagatttcctcattaagacttctcttaatttgttgatatatggcatatctgtcaatgagaaatactcagccttttgaccacaatgaagccatttataatggagcatctcatg

SEQ ID NO: 125431 - DNA, 1889 bp, Homo sapiens
tcctaattcatccttttccttaagtcatgctggttggtttcttgttagatttctgtctccgccttgtccaaaggtatttgctatttttaaatcatcacagtgtttctatatatgtgtgtgctgatttcttcacataacatgctaacataagcatggatgtgtgtttctacatagacttaatgatcatcatatttactgattttaatgccctttgaaatatatatgtaataatttaggtaactgcctagtgctggacatttctagaattcttacatgaactttgttgtatttatatttttccttctatagggtttccttaaagcagattattaaaaaagagattaatgggccaaagttcttacaaagataacgtgatttttgtttgtgtgttttttgatatgtatttccacattgctttccaattaaaacctgtagcaacaagtgtgggtctgtcagattcatcacatcttcatcagcttggggtgggtttttgttttgttttgttttgttttgctattttgcaaaatggtagaatcagtggagtttttatcttattattttttttaattcttattgatatcattatgttccatgtctcatagtgacgtgatcaagcatactttaaaataaaggcaaatactttgaagtaaaagtatgtctgtaattttgtttggctgggctttaagcatcctaaactaagagcaagcatttaaaaagttttccatctttccaagtatttaaatctcttttccatttcagattgctcttttatatggcaatttccatttttctctgccatatattttattaaaaatttaaatgtatttaaaccatctcattccatgaaagagaaaagcagaactttagtaaagtgcattcaaataattaaagtccatggcaaaagcaatagggaagacagtcatgcacctcttgtggtccttattaatgggtccacatgcacacacatctccaaccagccccctttgtgtagcttgtcagaggacattagctgagactaatctggaagccacttcctggctcccaaatggacatagtcaccaaatcagaaagactcatttatcagaataaaaactttgctacgtgaggattgtgcaaagcttatttcatgcatcattatctgggcctgattagcagtgatggaaattggtcctcaatttttaacaatcagcggaaaacaaaccttcagctttcactgaagatagacaattgccatagacatgtctctgtgttttctgcacaataggaaaatagaggcaagagcccttgcaaagacagtttttaaattgttttggcagcagttgtctcacagatgccattgtccctgtgacgcaaatgaagccagatcccgctctctgagcagacgggttgacatcttcctggatgccccgtgccacaggggccacattattatgtgttgtggccccagatgcagctggtccttcttgggctttgggggcaggcaggcctggttccagatgccagtgtgacctgggcagctctgtagtctctccgtacatagtttcatcactgtacaacagtgacaacaacactacctgcctgaaaaactgtgagggttataataagataatttatgcaaaagagctctgtgcgggggctggcacaaaggcatgcagacaggcctcacactgctaggagcttcctcctgttaagtctgagaggaggcccttgggaagggtcttgcggagtcaagggtggagcagttactcctgctactgttgctgtgaggttttttggccatccttattgtccttatgtcccagttcaagattctagggagtacagctcttcaagtggcattatcaggcccccaagccctgcccctgcaagtggcattatcaggctccctg

SEQ ID NO: 125432 - DNA, 1133 bp, Homo sapiens
tcagtgatggcagcaaaagggaaggcaagagaggagtgatgggaaacagggagctacagcgacgtttcttctcaatatttgtcttgaacaagagtctagccccaaaagctggggagagaactagaagagcgaggtcgcagcagaccagcatcactgcattcagcatatctcctcgtacgtttacactgctctaaactattcctttttttcgttctattctttaccttggagctctttagtgaaatgtatattctttaaactgttgttctttcatttgttttattgtttggaatctcaaatataccatcacctgatgggattttcttttggtttcgtggtgataagttgttagtctcctgtccagttaaaatgttggtgatgttgagtgcaattgtgatgtcacttcactctcagtgcatgattttgtggagtgagcactcccagaggagtcttaattcactttgggcatccagtgactatttaggggaagaatgactttaaaacaaaatacactgggactgcaacaaaacacagtgcttgttttctggactgttataaatagtgcttagatcatatgtcctgaagtgtcttgaagtttaaaatctatttttattaaaaaacaataacaactctaatatacatctgggctagacttgtgtgtttttgtccttcaaatttcatctctttgcatagaggcttctgtgattttagagaatctagaagctcagtaagagaaaaataatgacctcccattacttacacttaatgtattgctatctacaaatagctaggtagttgcgcagaatagccatagtgctacccatcattagtattaaggcttgacagaacttggcttggagagcaagttgccactctatgcatctcaccaaactcctgcagcgaatcacatttagtgcataggagccaggtaacctcaaccacagaaactggcctcacatgtaaaaattaagggagagccaaaagctggggagtagggccgtgaatcttccaggccagatttcaaatatgaaatacacgtcagatgtgtccaaactgatacttatgtctgcttatttatatttccaaaaactctaattgtcttaatgtttttctaaagatctcacattaaacaa

SEQ ID NO: 125433 - DNA, 1023 bp, Homo sapiens
acgtcaatgaaaaatggaaggagatgcatgattgttcaaaattatttggagggatatgccaaaaaattatttctatttatttatttatttatttttgagatggagtcttgctctgtcgcccaggctggagtgcagtggtgtgatctcggctcactgcagcctccgcctctcaggttcaagcaattctctgcctcaacttcccgagtagctgggattacaggtgtgcaccaccacacctcgctattttttgtatttttagtagagacaaggttttgccatgttggccacgctggtctcgaactcctggcctcaagtgatccgcccacgtcagcctcccaacgtgctgggattacaggtgtgagccactgcacctggcccccacaaaattattgaaatgctttatgtcagtttgtatcactagttcagaagcactttaccttgtaatttttccctttcttccaagtgcctagaacatagagaacaaagtcaacacaggttaagatgaagtgcagctttgcttgttggttgtgagtggccgtgggacccacaggcagcagtgtgaggtggcgaggtagcttttctttcattgaaacattttctctgggccatataaatttggtggaactggcttttgagaaatcctctttcttaatgaaccacaaaaaaagcaatatcataggacacaagatctttaatttgcgtttaataaaacaataaaatgaatccattccaaaattacttggaagatacttacatttagtgatggaattatctttgctgactctgtaaaagaaaaactagtaccgaactgagaataattgtgttcaacttgaggaactagtagccctaagttagcattttcttctttatacttgagctgaagaatttaccaaagctcattcagagatatgtaatggcctctgaaccatgggattatataatttaggtggaggacaatagaagggttaatattccttactcaggctctgtggctattcatttagaagagaattaaatcatgaa

SEQ ID NO: 125434 - DNA, 1007 bp, Homo sapiens
acctccacatgtattctttcctggaattcatgtgcctgagaactcacctgtgaccagcatcattccaagtctttttccccaatgccagttttacagatgccctccttctccttcataaaagacagacatacccctcacccatcaggaaactcactggggtgcactttcctgagatgggcaaaccttattcctgatctcaaacaaaagaacaaatggaaatattggtataagatcaagcagataaattaatgagttggtggcgaatctttttgaacatcaggtggtttcccaatttttctttccaaccaaattgacaaaggatctaactgagttgtcagattatagatcattaagcataatttttgtgacagattaatgaagtgatttttgacatatattagaggaaaagttttagaaacctaatggaatgatgtaaccataacaaaagtcccttaatttaccttcgtatgtgacaagctttgcctagtgcttatatctataagaggaaaagtagacctgaatttatgccaaaccctgcctcatgctagcaataagtaatccagtcatttttaaggaattaattgaaaaagcctcactcacttatgaaatgcagttccaaatgatattttaccattttgcttaagaaatgtcaaagtttctaagaacatttatgtaattttggttggctgttttctattagcacaaggataaacaatataaaaaggaatttaatacaacttgcttatggtgagggaaaatgaaaattacattttaacttagatacatattctatacaaagaggcttgatgaataaaaaaaaaaactcaagcataaagtacattcagttaggataagattctgttaggtagtgaaatggaaataagttcaaggaagaagagacatgctctaaaattctgcctgttaaaggaagaactcatttactaatttttacgtggaggggcctgggcatgaaaatactatgatatccagattcctttgtttatatt

SEQ ID NO: 125435 - DNA, 2243 bp, Homo sapiens
cttggcaggtccctgaacctctctttctgaggcattgattaaataaaatttatgtgttttaatagatagacaacctggagacagagtttctattttgacaatgaaaactaagacaccagctttgttcttgccagcagggatggccatccactgccccacacttccctcaaaggtgaggccccagaaatgtgtaaaaaaggactgaaggtttttgcctcaagaaatggtttcaaatatgttgagattcccagataaatggatccaagatttgttccatagaacatggaagaaaatcttttggcttagaaaagtctaaatgcagatatactcagtaggattcatgtaacacgttggttaaagaaccttaatttgactcctgcccaccatgtgggttttttatgaggtttgaatgaacttgccctttttataagctgagcagagtgtttctgcaacacacaccctcagggataggtgacataatttgttggttggggcttcttgtataatttgcaaaataggaataataataatatccacactacagggggcatgtggactaaataaggaggtaggtaaatattatccatttgaacactgcagaatgtcaaaacccaattaccgttatgtggtttgcaaatatcagtgttgagctgtactgtctgatagtaaattagccaatagtgtaatactttagactactcttaaagcccatgacagtggcatagagaaggaatcctgtttaactattggcttaaaaacaacaacaacaaaaagcacattacaataaaatgaaacttcagtttcagggtagctgaactgattctaagcatcatcagccaaagccagcattgtggctacagagaaaaactggccaccctatccagatggaatccttgccccggaatgcaagcgtccgtctctgtccctgtggaacttcacttagtccagtcctggttcatgcaccgcacccatgactgttgttgataggctttctgatccatagtaaggaaacaggaatattcacgtgcggcaaagaaattcactccgtaccatcgctgatacccccatttaaacacaggaaagacagccaagagttggtagacaattttgtttttaatgcatgaaagaaggacaacaaagtggtcagagaaatttactccaaaggaagtagagttaagttaggaaatagaacagaactttaaaataaatacttttagtcattgcctcagaaaatttcagtagatcatcacataaaacaagagcaggctattattgaaaaacaaataagcatcaaaacattcttggaaattaaatacacatctttagaaatgtgcacatttagacacattcaggtaaaaattttaaaaatccacagataaaattttactagcttctagagagggattatatatagctataaacaaatcatgtgaacatatgccttctcatctatgacacaagatgctagaaaacagagaagcggagaagacagtcttaaagaagaaggattttcatctgaatcttcctttggtttagccatatactggtagtcaaggataacaagtaaatggagccagccttcagacgcaagagagcttcgagagtataccctcctaagttagattatactcaagtgtataatccaaataacggaaaataaatctaggaaagggaaagacatatatgtagctgtccaatttaatatgtaatttaatataaaataatggttcctataatagaaataccataatgttacatagatatatgtgcaaaataaaggaaatttagacatttattagacaagactcctcagttctcagaaacagaagtatgtcttgaccagttatgcataattgggttttgtggcgattttttagctcacataactggcacttccaagagactaatctttattatgggcatggttggggccaggagctgaaacattgtcttagaactatgttcctctgcagtccgtggataagttcttccctgtgctggttaaaatggcagccatttatccaaaacttgtacccaatccatttattccagcccgattggaccatcttcctgaacacctctggtggaaaggttctgagaaggactttgattggtccagcatggaacacatactcatctttggatataacattgtcctagggaaatagttaggggcagatagtctcacccagatatgataaattggttacctgcaagaggacagaattcttttaacacaaaca

SEQ ID NO: 125436 - DNA, 1051 bp, Homo sapiens
gcatgtctttttctccagagaaagacaaaacaaggtcacaattccaactggcatgacactgctgtcctgtatacaaccgaaaatgcactcatcccttccagaagagaaggtaaagtccttgagttgatgtttactctctcctgatatcctgtaacttaaaatactatgatgtaaaattatcaacaattagacactgctatggaagtcgcgtatgtcccatgttaagggaataaggggaaagaaaacaaagatatttatatgtatatatacatatatacacacacacacacacaaacatattcttaacaaaatgagaaggaaatactcattgacaattactgttttcatttctaaaactagtcacatcacagctggtatttataatgtcttctacccattctgtattccccttgccttcagcaagcacctcagctggttgtggttctttacctggtggtgtgatgcaaaccatcattcctgaagggtctgggccattagtggtactacctggattgggtcagggtagttttcattgaccttcatcgcagggcttactaagggaagtcctaagggatctcctacatcccatactgttccttacctccattctagagcagtagtctattttcccctggatagtctgggtcagtcacccagccaacaccataaaccccttcttcgcctgttgactcaaaagcctgaggagcccagactgaccatgtggcatcttaacttccagttcggtggaatcattgttgtgccccctggtggaataatttgtttctctggacctaagacccatcggccaatagaacataaaagtcatgaggaaaacgttttgctagtgggtcactagggataatgatggtgccactccctttttaacctcttgattcctggaccctatgggagaaacagcaccatatattggacatcattcagagcatacacagccttctggagaacatcacccgagccctctaaggtactgctacctctctgaccctgtaactgagttttcaaaaggccactctactgttctatcaaacca

SEQ ID NO: 125437 - DNA, 1040 bp, Homo sapiens
gaaagatcattttctcctccagcccctgcagatcagcaagcgcccacgtttccatgcaatgatgaaacacacaagtaaataagccatgatgttgtctgggaatgcttcagccagtgtggctggtcttaaactggtctagtttagttgagacacttggagtggccacttgttggccacttcagagaaaccagcagtgttaattggaagcctctctccaagtctcagcaggccagccgagcgccgggacaccatggctctgacttaagcctttgccctgaagtcatgctgtgactcaggggctgacccagagcttgggattatggaggctttggagaagcagctgcaccttcaagcaagtttccttggatgtatctcctgccacctctcacagacgcaaattaaagagagagagagagagagagagagacatgaactgttgttactgcagcaaacatccacactgtatctgctgtcagggttgcatcctgggaaagctaattttgtagacttaaagtaatgaataattagaccattgctaaatgtatgttttattttctgaacaaattcaaagcattagaaagataatgaagattttcttaaaattaggcctattttaaccctccctactgtttagccctaatggaatatttattccaaaatctctattagtcaggcttctccagagatacagaacaataggatatatttatgagtgtgtgtgtgtgtgtgtgtgtgtgtgtgtgtatctatggtggggagagatttttttttatagggatggccttgtgtaattatagaaaccaagaagtttgaccatttgccatctgtaagctggagaccccggaaagctggtgatgagattctatccaagtctcaaggccccacaacctggagctctgatgctcaagcacaggagaagatgggtgtcccagctcaaacacagagaacacattcacccttccctgcctttttgttctgttcagaccctcagcagataggatgcctgcccacagcggtaagggcacatcttccttactgtc

SEQ ID NO: 125438 - DNA, 1080 bp, Homo sapiens
aattcccttcccttttaaagctaaatatctttcaagtatatgtatagaccacattttctttatccatccattgtcagtggacatttaagttgttcccgcttcatggttattgtgaatgatgctgcacaggtatgcaaatatctgagactctgctttcatttcttggggatatatacctagaagtgggattgctggtgaatccagcatatctttgcctgaaaaaaaaaaaaaagccactcaagctgagttaatgcacagggatatatatgggatcctatactgcacctataggggttgtgtcagctcacttaccccacatcagccacatgcgagttcctgaaccaatcacagtagccaagggagtgccacacacccattggcttaggccagaatgcactgatcaattgtcagggagaacaggattactgtgtttgattggataatcagggttcatctcccagacaaccaggttgctccacaaaggggatggggcagaaagggtgctgagggtcttgcactgtccagagaagtacatagcatggggctagagccaggctgcatggactcagggtttgggtctgttactgggtgatttcaggcaacttgcttaacttctctgtgcctgagtttcttcatattgaaagaaaaagtgcttttgagaattacacatacaaatacatgtagaacatttagaaatgtttcgggggctgctgggttggagtcaacagatcctaattattatgaaaatagccataatttaaaatgcagaagatcgtgcattaaaatcttgatttcttctttttaaaaaaagttagagataaggcaacaccagttttactgcatgaaaggaagtgtgggatgcatactagctgcttcttgcaggcacatgtaggcaccaggtttcctcagggtcttcgtggggccacacctggccctcagcctgcctcctactgctgtctgcagacctctgtagatggatcagtgcaggttccctgattcagtcatactggagaaatgaagtcactcaaaccctcatttttaaaaagtcagaaatataaagattatgttgtcaaatactgc

SEQ ID NO: 125439 - DNA, 1052 bp, Homo sapiens
gccctgccacctttctggcaagctgtgctgattttgcccaaagctggctgtagcccaccctagcccaacactgtatgtgaaccaccattcctgcgtgcattcggcctctgccctgactttgaatttcctccttgcccctacagtttatggagcagctgaagctgtgataagacttctgagcttgcttctgaataccacagccccgggcacagcaaagccaagaaccctgtggatgagtgagggccgcagttctctacacaatcctgaaatcaagtgttcctgtttctcttcctcctccccatttccccagtcactgctcagccttctcttgggtctttcaagcatttgtgaatgcatgtgcacacttagacacacacacgcacacacacacaacccatcttgtgtcttacctacctctgaaatattggcatttgggagacaatccctaatcagctaacacttgtttttttctatcctctgtgtgcttgttagaatactgtgaaggtgttttctatggaccgacttctaaatgttcctcctgaaatcagtgttattcacacagttctaatgtaatgaattctgtctgtctgaaagcttgccatattgtccctggtttctcccagctaatagagaggaaaatgagcctgaatatgaacccgtcaccacagaccgcactgcatcctttccaggcagcagggccctggagactgtgctcaggcctggcagcctctgtgtttcacttaggcttgttttgctcaacccaggcaagacttttaaaattgtttgaataagctgcagcatcagtatgcttttttaaattgtgatttaaaaaaaaatataaaatgtcccattccttccattttcaaatgcatacttcagtagatttaagtatattcacaatgctgtgaaaccgatctccaggacctcatcgtcctgcaaatctgatactctactcactgaacagcaactcccctttgcctgcttgtctttttgcgcctggcttatttcacttagcacaatttcctcgaagtttatccatattgtagcatata

SEQ ID NO: 125440 - DNA, 1002 bp, Homo sapiens
atgtgcacccatggtgcatgcatatctagactcatgtacatgtgcatagatgtatatacagtgcatgtatgcatacccacacaatacatgtgcacattgtgtatcttaaacatctatgcatacatacacaagtgtgtacaaaatatttgtgtatatatacacatgcatacatatatgcctacacatggtgtacatattcatgtttgtatatattcatgcatacatgcacatctatatacatttgtaacttgtgtgcaaatatacataacacgtgcgtgcactcatacatccatgtgtatacactgtgtgtgtgtgcctgcacgtgtgtgaagatatgaggccaaggacagtatgtggctatattagcttgttgctgccagtatgcttccccacccccacgccaccccacacacaatatatctctgagcctggtgcttcggtcactggcaggctttgcaaggattctgaacttgtccactttggcctcccagaagttattgtcaggcctcttgtttggtgcctaatttatgacttggaagagatttaaagattaaagagaatatggccagttagttgtttaaatgaatagtcttccatagttagatagggcagaaatccaaatcaaccatgttagtaaactcaaacctcatctttcgtctctgcccttgcacttatgtctgcctccatctggctatttattagccaggaggcaccttgccatgaaggaggtggcctctgcttgagtgcagactgcacagtgggactacaggaaggtacagcccatggaggggtgggggtcttagtcttcatagattcgctgccagcggggtcggggcaggaagtgatgatggctaaagtggcacccccttcccatgcacttttcctggagtaacccttaaatctataccacagccctatgaggtcactgctgttgttatcatcctcattttacaaataagaaaacagcacgtagatgataagaaacttgtctgcaaccaaaag

SEQ ID NO: 125441 - DNA, 1071 bp, Homo sapiens
aaaatgcaagctagtttatatgataatgtttgccatctcactttaccagtactgttgaccttttcatatgattctaaaatcacttacttgtaaataaatactcctagttctgtagatgaaacaatttggaaaagtcgttactgtttactcactgacattttattttagcacccattataatcagtcacacatcgcatctgtgtttgtgatgcttatcaactgttaattttcacagttttcatgctaatttggatccataaaatgatacagtttgttcacaacttccatagctcatgtaatgtaattcaaaacgtttccacgtgcagactaacatttcccataacaaaacaaacttttctaccatagggataagagtgcatcttccaaaaattacaagagaaagtgagggcctttcaaacaagtattcaagatgtcttgagtcatcataaccaattacagattatccagacccagaaattaatccacatacagagcacttgcttcctctggcttctcggaattttgtgtgtgtgtgtgtgtgtgtgtgtgtgtgtgttttaactgtttcatccttcatacccaaggaatgtggagcaggagaaaaacccaaaatagcttttgcaccttattagtcaccatggtaaaatgacaacaagcaaacttcaaacacttcagtgaagacagaggttcaagtattaaataaaatgaggctcaggagttatctgtatatttttggtttctttgctttatttgtcaccaatagcaacgcataattggtaacccttttgccgaataactccctttgctggaagttttgtgatttaaatttactgttacttctgtgttgattttacccttaaaggctttatgttataacccttctttttccttcttattaagaaaataacaaacttttattacgtgaacgaagctgcataaaataaggctctgagtatatttttcagtaaagggaaaaagaaacccccccaaaagagattagatctattgagattatttagactggacacactgtttcctggttgataaatctgctacagggcttcagggcag

SEQ ID NO: 125442 - DNA, 1620 bp, Homo sapiens
acgtgacctctggccttggattttactacctgtggctccccaggcacatgaaaagaagtaaagatggttccatttgataagtactagtcacaagggttgtacatgtgataaagatgccagaggttgtgaccaccatgtctgtgcagaggtgctgctggctcctctttgagtgtgagatccctctgcagtcacacaacctcacccagttacgaagagctagtcacctcaactgcattgtcccaagacaggcagagtaggtaaaaatagtcatatgttaaaattcaaggtttagataaaaagacaactagttcttgcttgctttgattaacttttattatgcagatgcatttgaactggagaagcttgtcatgtttctctctaaaagatgtttttaaatgttattgctcaaaatggaaaaaaaaaaaaagaatcagtaagtattcctgacatgtaggattgttgcctggctgatcacaatgaaaatgttagctatgactaatgaaggaattatcacaacttacattggtattaataataaacaaatataagccaaagctatatataaccaatttagtgctatgtattggtgaaaaaaacagaaagttacagaaattactcacaatgaaacatagaacaagttagaaagggccttttttttttttgaaataaaggacttttgtctgataagtagcagtcatttgacctcaaatcattaaatggggaaagtctaaacaagaaaaggtaatgtttacctgaatgttggggaaagcattaggatttatggcccagacttaaagattgtagaagattgtatataattacagcaataagcatttgtgtaagaagtagctattatgctgaagaaagatgggcacacaaaatctctaggcaaatccttggaacaggggaaagtgatactgctcatagaattattggttcgagaggcagcaaatatgatgcaataagtatatcaaactcaattaaaaatagaggacagaggtatgtggtgggggaaaacaaatgcaatagggctaagtcagcttacagggggtgaatataatttgaacatggcacccccaatttacttgatcataaagttagccaaagacatgagtggtcgatctttgacaatactctagtgatctccatgagagatggcctgatagatgttggatagaatgaagggccatttgatgaacaagttttgtagatttacatgtgacttggcactgtgctgacattagagccttctaagaatcagataaattaattaggtgaaacattttttcccaaagcacttgcatttcagaaagtttctcatttctgactcagcttagaacccatcccttgttacaggtcatttctcctccttataagccatgtctgtttcttttttccatcatgtcatacaccctatccacaaaagatggtagctcacgttttctaactagagacgtgcaggcaagttgagagcatgaagaatcccttgggaataccaattctgtagcaaatgctaaggtaaaagaaaaactatgcattatttttcaactatagttggcttaaattcttagtttcaccctggagaccatgttgccagtggacaattgagcatgctgtgat

SEQ ID NO: 125443 - DNA, 1099 bp, Homo sapiens
catatggtctgttttcctctggagttctacaagtaacttagactgtttttcaagaggtaagaaataaatgacttgcctaccagctgcttcgtgtctcggcttgtaaggaccttaggtttcataccaaatccaaataattttatgtggcaacctgaaagaccaaccatgagggaagtgatgcttatgatatggttcttacaggaggcagaatcatatctgttggatcaataggccctttccacagctggcatacaaaaagactaaatggaaaggaagaaaacaataacaatatgctttggctgatagaacgcttgctatgcagtgttaaatctccaggggctggaaaatgaatgataatggcagatatttatttcaccgcaagtgtgcgttcacattttgccatttattttccccccgcagtttattgctgtgcgtcattccctactcaggccaagcgcttctgatggacgggcctcttcctgacctcggacctttcccagtgtctcttctgccctggctctgattttcctgttgttcttcctcctttcaggataaaagggctcattgtatacccagaatttacttcctttggggtttacatataaatgcattaataacagagatttgtttgattgaggtttatatttttttgaaggaggtaaattatatgcaaattttaggttgataatattcacctgtctgaaattcactgatacttggaaatgttcctgtgaagaactctgctttattttaattcattattaattcatgtttttcttattggatattcagttccagaatttattgccaatttttcttaaaactagattgtatccataaattgaccagtatagtcaatttggatagaactgaaactttctgtctacctggtaaaactaagtgcctaaaaacatgaactataaatgtagttactaggaactcacaacttatatatactatccattcaatgatacataggacccaatgtctttgtgtttttgaggttttcctgttactgtgtactttgccattttacatagttcactaaaaagaaagaagtgggagaagaagggtgttctattcattattctatattatg

SEQ ID NO: 125444 - DNA, 1011 bp, Homo sapiens
cggtgaacagccatgtgctgcttgagcagagggcgtggaactggagaaggtaggacgggaatttggctgatggcccttaggttgggaccagtcctcattagagtcccctaatgccttattctcaaatttgagcccaaactaagtacttttcctatttcaaaacgaagcagttagttctaaagcttgtgacacaaacacagttctgtgagtcctgtttgttgtgggaaacacccatgaaacactacaggtgtggagctcagagcaagccctgggaagcattcttgcccttggctggtgtttatttgccactttccttccctggcaggagagccagccacacagctgttcctgctgccacggggcaggcatggcatccaggaaaacaggaagtgggtcgtgagcaaatgggccttttcataaaatggaaggaaatcgtcaactgtgggagcagaatctgtccctactcaaaagtacattagaaaaaaacggaactgaacttttaacctgttactattgtaccttgaaaaccattaagtcaacccaacatagactgaagattggatgtagcttagaagtgaagtagtgagaatcaaaatagatctatatatagcttttcaaaaaaaccttatgagcctatttctttttgctaattacttcttagtcttttatttacaaggtacaatgtccctaacttgagagaattaaagaacttagtgacaactcagtggaacagaacagcactttgccagctcataaaagcagatcgttaaaatttcaggaattttgcaaaccaatggctgaacagatccactattaaaaagtaaattatatagacatacaattaaataaataatattaaaaacagaggtaacaaatactaaaaactcatcacttcctaattattttagtacatttcattactatttcagtgttcttgaggttgtttacatgtatcggatctgtaggatttaatgctttagaatagtaaaaatatatcatagtgtgctacta

SEQ ID NO: 125445 - DNA, 2076 bp, Homo sapiens
cagccacttgagtgaagttgggggcagatccttccccagtagagcctacagatgagaccatagtcctgatccacacctgcactgtagcctggtgagaggccatgagtcagaggcacccagcaaagccatgcttagattctagactcacagaaactatggaatagtcaatgcttactgttttaagcctctacattttaggataatttgttctgcagcaatagataactaaaacaagtttcaagtaagtgaaacccatctcaaacctacttcaacagttagggaatgtcttatctcatggaacaggaatcccagagtggagtagcattcagtattagttgaatctgaagcccaagttgtcatcaaggatcttagttcttcctaattcttctctgtatcatctttggggtcagcttccccctaaggctgggagcaatgggtctgtggctgttccatgtatcatatccagacactagaattttcataagaggaagagagactatctcttttaatagttttgtaggagaaaggaaacctttcccagaaagcccccactaaagagttcctctcatatttcattgactacaattgagtaatacactgacccaattctttggcaagaatggaatgaccttagatgagccaggcccatctggcagacggggatggggtcagctttctctgaggtacgtggaagtcactggtcaatactggagttctgttaacttggaagtatgggcaacatatgctatgtgaacagccagcagtgcgcactacacatgggttgcagccttcagtttgattttagtctggagcatgtaggatgtgtgatgagtaggtacagagaggatggtgaatcactgttgaagagcaagtgggtgatttggctcaaaaacagtaaggccaagcatctgaaagtcaaaagtcaccaaggaaccatcctccttgagggacgatttcagtgcagaactggccacttcaaatctagcctccacctacacttctcattttctgcttttctggagcagaggaactattagaaatgctcctagcagtagaatatgcctattcagcgttcaggaactaaagcatctgctttcttgatagtctttgtagtaagaggtgtgttcatcacatgaatctgaagaatactggatctcacttaaaattacttcctgctgtagaaagcataatcttgtctcttccagagttagtttacagtggacaaagtgcagcctttttaaaggcaacatagggcaagtgtgaaggtgtgtgtggccaaagaacaaactcgtgctccctgctgtcaccttgtatagaactgagatttctgttgcctgatccaggctgtccatgtcttcctggctgtcatggtcaggacaacttgcagagtctgagttgataaatatcacacatataggagaagggctactaagctatgtaacctctcaaagctgcatgtcacaaagggcatcactagtagggttttggtgtgtgtttgatgtttcccagcatggttttaagaacaatggaagactggctcccaggtctgtggtctttaatcatgttttttcttattaataagattttgcattaaacttcagatatctaatcatgtacacagatgctttatgtgcatgtctaaaccaatacagttgtgtgcatacggatttttcatcataactttcgaatcagcttgctttctgccgccatttgatttcagttgaaccttcattgtgaatcaccataatggagcctattcccttagtgcattgaattgtttatttacaagatttgcagtgctgattataattaggttattaacaagttatgaattatctattttaattagcagaccttggagatttaaagatcaatgcatatggagctcaaattacagatcctcaatttactttacatttttaaaatgaaaatattcagtgactgtcattttcttacacatttttctacaccaggcttaagcaaataaatctttccttgggcatacatttacagggtaattgacaaaagatcaaaaggcataaagggaagataggtcattgtctcctgttctaagca

SEQ ID NO: 125446 - DNA, 1009 bp, Homo sapiens
gcaaaataatcctgattcattttatctttcttcacaagtacttcttttccacccttaaaatacatttgatcatcttgacattagacatgcttccgaatgcaaatgaattttttagggcattcaaaaaggaagggttaggcttatcaatcagaaagactgcagccgtggcgtggatggctccagagccatttcatctctgaagacagtgggttttaagccccacacaccaaggccatgagagtcggtgctctctcctgtggccgctgtgctcacctacagaatttccttcctgcaggaaaaagtgagggaaagatagctggatgaaagctataaagccaagtacagcctgttggcagtcacagaacgggcccagcaccagtggctctgtggcagcctgcacaggatgggagagctgggtgcaaacttgcagaccctcgctttctcctgggctccctgtgtgttgggggcactcactgttcaggtgcagcatctgctggggcaacgggcagacaagatgtgggaggggtacttaccaaggcagcatcaggcttcctcctgcatctctgcagagcagtggaacctccccacctgctgcccttagacctttggacaggtctgagccggaaggagagcgaagtggcggagagaaaaccagactcaccttcgtcttgccttgtggctccatttcctccttgtgccctcttgccaactccataccagttcattcccccaggtacaggcacctgggacttcctttgccctcagcgtcataattcaccttctccctctcttcccctctcatgcccacagcaatggagttgggggaagaggaggttgggatggggaggccccaggaggtgttagatggagtgcactgatttcaactccacctccccttcagaccaggcaagcgccttgcccttcttgggactcagagtctcccctccctctcctgccccgctcctgccccgcgctcctggctgccagcgcaccacatgttcaagcatct

SEQ ID NO: 125447 - DNA, 1003 bp, Homo sapiens
cctgagtccttgtgtcccatgtgcttgggacaacatccccaccctctctacaactcaggacattcttcaaaacaaacttggagaactattattctaaacaaccaaaggggttgaaaagtataaatggactcaggagataagctaaatgaatgcttaatctagccagaataggtcagtggctctagaaaagcaacaagagtaggctaaaaacagatctgtgaacctgaaaaagactaacattaataaaaggagttcctttaaacttgacaaagctctgtcgagggtgttgaagaatagttttcaagcccagcatttatgtagttgtgtctgttaaaaagaaattgcaaccaggcacatctttccaaactgctccaatgatagaacactacgtatgtaaaatgttaaagtgtgagtgtggttggatgtggttggtgccagatgagaatggattaggtgctggatatgactggatctggtgttaggtgtggctggatctggtgttgagtgtggctggatctggtgcccagtgaggttggatttggtgcctagtgagtgacggcttggtttaacctgctgaagtaactccctgttgattccatataggtggtggacggcaggtgccacaaaagcctcccagaggcactgctcggggtccaccccagttagtgcttcccccacccccgccctaccctcctcccgacacagacgtggtggagcctctcagctttcccggggaaggcgctggttccgaggcctcagacccgatacccaaacgtatgttcctcttgcttcattccgactgtgttaactgttcatctctctgagcactgcgatgtcagggctgggtttccagattttccattcttgtctttggatgtgtgtgcctttccttctcagctcttgtttcccaatgctgaatgcagtgtgtctgatttcacagagaacacactctggagaatttaaccaggtaatcatgcctatctgtggtcagacttcagctaaa

SEQ ID NO: 125448 - DNA, 1530 bp, Homo sapiens
aggggtctttggggtgtctatgagcaacactgtgccacctccaggccactccttggacatccgctggtctctcgcctcatggcctcccctgcctgtgtgggaggacctggaaagggaactggccatctaacaaccctcctggagcaccaccttccggtgcaggtccctgccccagcacaatcaccctaatactgccttctttgtacttcataggtacaaagtactttgattgtactttccttctttgtacttcataggtatctcttgggtcacagattgatttacagaagaagaagcggcgagcgccagctccccctccaccacagccaccaccaccgagtcccctgatccccaaccgcactgaggataaggaggagaacaggaagagcacgatgggtgagtgaggctcggcctgccgtctgcatgcggggatgcttgctctgtcctggaatgtcagctctgatgtgaactcctgcagtggcctcatccataatgacattaacccaaaaaatattaatgctaaagaaagaagggctggaaagaaataattgcaagttcacttcatatcttactagcagtatttggtgggcattatgtgagcatttaggaggcgggggacggtggaaggggagaaacggctgcaggagccgggagagggtgaaaatggaaagcctgtgagtgtgagtgtgcgacgtgtgtctctgatggcaaaaggagaagttcctagggtgacatcgtggaaactgctttgaaggacatttggcatttcaaagagatcttaggccacaggtgatgtatagacaagttgacatcagctcagtaatttttggaccatcctgtttgaaattgatctccacttatattacctggtacacatttagcaaagaccctgattttctttgagggaaagagagcccagaggaaagaagatggaattatactatctgtgagcagaaagagacctattagatcatcatagcccacccctcgtgctacaggcgaggtggagagaagctgaatgatggcgctgtccaggtccaggggagtcaagggttcattttctttttaaatcattcagcatttgttatttcacttatgttggaacagaaatggctcttccatggagtggttggaaaatggcagcctaggagtcacaccttcctgagctgagagccccaagaatggcgtgtgtcagtgctcacgacgaagccaccagcactcacaggccactcaccatgccctttaacccacccaggcagccccgcgttttgcctttgccctaaggtctgcagctgcaggagggaaagtccttctgagataagtggctgccttggcagtttctggacctttagtgagagctccgtggcagtttgtcagcgtctttccccttagtcagttcctcgcttttaatgtgttagcatttcagcctgggagtcagttaccttaagaagcaataacctgtattccatgtcagctcatcctctttcccaaaggactgaaagaaaacattatcagtggatcattaaaata

SEQ ID NO: 125449 - DNA, 1761 bp, Homo sapiens
ggcagagctcaggcagtaatgcttgttcacttaccactcacctcttgctgtgcagcttggttcctatcaagccacgaattggtactggtctgtggcccagggtttgggaacccctgagataaactattcttggttggaagtttttaagtatccttgattggcaggtggcgttttttttctccgtttttagcactttgaatatgtcattccaccctcttctggcttgcaaagtttttactgagaaacctactgataatattataagactcccttgaaagtgatgaatcaatttctcttgctgttttcaagtttctttctttgtctttgactattgatagcttgattttaatgaattgtggtatggtcctctttgggtttattctagttggagtcctttgagcttttaaaattttgtatgtctatttccttcctccaatttggagaattgtcagacattacttctccagatcaactctctgcccctttctctcttctccttctctgatccccataatgcatattttcatccccttggcattgtcccataaagtccttaaggctgtgttcaatttttgaatttttttttattcctttactcaataatttcaactgacctgtcttttagttcactgattatttcttcttcttcttaatacagcctgctgttgaactcctccagtgaactttttagttcggttattttatttttcagcttcagaacttctgttttttatagtttctgtctctttattgatatgattctattcatgcatagttttgctgattttgtttagctgtctttctgagtattctcttgtagtgcactgaactttaatttttttgtcttttctggccatagatttccatttattgttatttctctctagatgtttattttgttcctttaattgggccatgtttccctgtttcttcatgtaccttgttattttttaatgtaatttgtgcatttgacaaaatagccacctcttccagcctttacggactggcttcttacagtgtaataacatgtcagtcagctcagctagagattcttggggcctctcaacccttttctggatatccatcttccctgggcttgttggtgtattttccaattagaaggtttgctgatttcttctttatgagcttgtaatctcgtgctctctcttgcatctgtctatggtactgcagattttctggcactgcggccagcttctgagctctcttattttctaaagccttcagtcatccatagtatttcagttttgtctgtattcctggtcaactgagacagaaatcagtccctgaacaagcctccccacaaatccagaacattgcatgtactttttactcatttcctcccgagggataagcagtgagctgggtgctttctcttgattgcactgagctgtgctggcctttgcctgtggcactggcagatctctgctgttgcaaccagcctctgagctccttttttctcagtagctcccaggcattcaaagtgtgccagtttcccatcagtgctcccagtcagtcgagacataaactagtccctcaggcagcccccctgaaaagctggaatgttagatgtacattccattcttctcttttcttcccaagggaaaagccatgaattgggcttttctcctgcagacactgagcgatactgggttaggggaagggctgtcacagttgaggtgaaatggcttttcttacccatttcagcatggccattcttggcattaagcttgcctatggtcc

SEQ ID NO: 125450 - DNA, 1046 bp, Homo sapiens
caagacacccttgtgtaggggactcagtttacctattaaagattgacacaatactctatattattcttgctggcatctttctttgtataatacctggcatgttacagagcaggtttttaaaacttttttggtatttcatttaagtgattaaaaataagtaacttgtggaagtttactaatctgtgttatctaattttagttttcattatccacaaatatataatacatagttattcatttattcagtcaatatacagttatatgcttacttttgtgcagatacaactataaatccatttttattgtaattgacaagtaattcaaaaatattttaaagttattccagctttcttttttcactattatttgaattattgcttttattatgttcaacactataaaattccaacttgagaagtctgtttctctgtgatctcaagattattgcattgggactgaaattgctagtgatggttggccattaaaataagtgatgatggaggctgtgttatgatcagttattagtataacccaaaatagacttttctatgaaaaatttgcttgtgtattcaatgaatattgaataactgctatgcacaaggccttgcacttgaaagcatgaattggtatttattactctaatatctcagcacagtgtatacataaaaagatagtatttcacactgtgtgaagactgaggacgatctgtgtatgttagacatttaatggaaagcattattacttgaagttccatttcctggatctggtaactagaataatacaggaagtgataaaactatgctgaccagactcccaaagacacgtttcatcaagaactgaagtgtccatttgatcatcatcagtcactctggtgtgttcttgatcctgttccgcagagaggacacccagggggaggcaggtcctggcagcccctgtactgggaaggccctgagagctgggctgcagaccacttggccaatggatgccagactcaagtgtcctctctgcatttaggcctgatattttttgcttattaaaatgagcat

SEQ ID NO: 125451 - DNA, 1461 bp, Homo sapiens
ccaaggtcaggagttcgagaacagcctggccaacatggtgaaaccctgtctctactaaaaatacaaaaattagctgggtgtggtgatacacacttgtaatcccagctacttgggaggctgaggcaggagaatcactcaaacccaggaggtggagattgcagtgaactgagatcatgccactacactccagcccgggcgacacagcaagacactgtcaaaaaaaaaggaaagagagaaagaaaagaaagaaaaaaagaaagaaagaaaactcattcctatgagtgtggatttcaaaattgtgatttccgaatcagggagcactttggttcaggtctgttcataaactggcagaagtggtaaagattacacctattaagtgaagggtttgctgccttgtggccacactggcatttttgccttaatgatcgctaaggactatgttttctgtctgaactttcacctggagatgatgtggcctggtgcttgtgttccaggctgagcagctcgtgctgtcgggtgcagacagcgatgaggacacctccagggctgccccaggaaggggtttgaacgtgagtactaatgccccagcaggtgcttccgctaattgcttggaacttcttgctttgcgcgaccttccagatagtgaaatcacagactggtttagtttggtgatttgttttttgtagtctagatagagtcgaaagccgcctattgattcttttttagttgcccatgctacttttggaatacgtggaatattttagtttctacttttctatttgccagtcagtgtgatcaggagaagccttcattagggtaattgaattcatgcttcccgaaactaccatcataaggagtagcctggtggttttggagctactcagtcctgttttccaaccctatagctctcagctgctaaactctgagcctacgctctgttcacggagcctttgaaaggatttctgaaaactacctgtgccctcacattgcacagttggcatctataaagtttcttcatagtttcaaatactcaagagaatgtaattcatgacatcttataaatattgacattttaaatgtatctaataaaagttggatctttactatcacctattaaaaattacatggaaagactcttctgtatcagtaagaaagtttatattttcttgatttcacatttccaggtcagtccccatgtaaaattttattctattcaattcatattttatgcttgaaagtctttaatacggactttaagtaaaatatgttataaaattaaaatatctaagttatattttttatttgatgtgattataaaactgtaagtagaagaatatttttctgggatgagttctcataaaaattacaaaataaatcaaaacagtataaatatattacaactattgacataattgttaaacatggaaagtaaatttttcttgaaaagacattaataagatg

SEQ ID NO: 125452 - DNA, 1291 bp, Homo sapiens
ggaaaggtggttcctgggagatttgatgcagttgtttcaaataccacctggggagcccatagctgttactccattttctggaaatgagcaggaaagctgctgatttatttcatttagttaaagtttgtacctcactcataattcttaaagcaggtgtattgcactgatgtcgcagtcttagagctgtgctgatttggcagccacaggcctcatgtggctcttgcatgtaccgagtccacactgatatgctgtaagcctaaagggctgctggattgtgaagacttagcaccaaaaccaatgtaaaatatctcatcaatactttttatatggactgcatgatagaatgacaatattttagatgtattggattaaatgaaattattacaattaattttacttggttctttttaatgtagccactaggaaatgtaaaattacatgtgtggtctggtttagctttctgttggacagctctgccctagaactttatttattttgtcattctccaaaagggcacaaccacacccagagaaaatgcctccatcattcctaaaagactgtgtaagaacctgtagtgatttcccaaatggacctgaggacttgaagtggctcggacagctttgaaagaaatagttgatggctttccctctcttacaagaactaaaagtttaagagtagaggattcatttattaagattttttaagtaaagtattgaatctcttgtttcagatgctgaaaaataacttagtgctttttttttccagaaacctttaggaaatcatcacttggcaatgatgagacagataaagagaagaaaaaatttctgggatttttcaaagttaataaaagaagcaatagtaaggtaatggattaaatacacatatgattttgtatcatgtaaaaaaaatagtctcttgaaatacatgcattcaacctgtcctggaacttttctaaacaattctatttaagaatactaattccttcaggtaaaagagagcttattagtatgcactggaatgacaggctgtgcttccacacttgattccaaaaggagtaatcttgggtgatggtggtttattcactagggggacaggaagcctgtgggctcctgatgaccggggccatgagcccttctgcctgtgggtgttccggtacttccacagaactctgcctgtggctgaaactcagtaaatcttgtttagattaatgaatgagtgaatggatgttatagttaagtgtaaatagccaatattgctatcagtgaactgtagcttatgcctcgtggcagag

SEQ ID NO: 125453 - DNA, 1008 bp, Homo sapiens
tatgtgttggattttaaatgtagagtcttccctgatgtttatttcgctgtgttgttagcagcttgttcactagcaagagattctaaaccagatttattattctagacatttgtttttcaatattcattatgctgttttcccccattactcactcaatttgtggaagaaggattcaggctacacacaatcctgccacacccaattgtcaaattgacacaagagttgaaggcttgtgggaggatatcttactgaattctttttgcctgtgtgttcttccagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagaggtgaggccccgctgcgtctcacgcacctgcccataatcacacggatgcgcggcgtgtacatgtcccctgttggctctccccagcactctcagtagcgccagggagagatgggtacatgaagttccaggcaagtcaagttgaagtaggcaaaaaagaaatctggcctgttttcattcctctggattgagctgtgcctcctttctcccagccctgaacatgtcctttatcctttgtctccctgcaaacttccacgacataagtaaaaggggaaaaggtgaggtgagattagagcttatgctctgaagtaactactccaaaccatctataatactttcttgtgggttggtggctcacacttgtaatcctggcactttgagaggctgaggcaggagaatggcttgagctcaggagttcaagaccagcctggacaaaatagtgagaccccgtctctacaaaaaaattttaaaattagccagacgtggtggtgcatccccattcct

SEQ ID NO: 125454 - DNA, 1003 bp, Homo sapiens
tcttggaggcccaactcagtttgcaaataaggcttgtccagaccccacatcagagtaaagggggcgtctctacaactgtgtgctggaaaccttcactgaagagtattctctaacctcaccgctcatcagccggcactgcagggcaccagcgttctagtatgtgtcaaggagtccaaacatcctagcatcagtctgccaggaaccccggtgcttgttttcaagaagtaattaaggctggaggcggtgcaaagtgtgtaggtggtgtcctaggctcagaaagacctgggctagaattccagtcttttccagctgtgtgattgtgagaaggttacttaactggttggatactcagccaccctgtctgtaaaatggggagaatacacttgcatatgaagttgccaggggtattgaacatacacagtgtggcatggtggctggatcatggcatgtttagaaaatgagggcttaaatcagattagtgttggactcagggatgtgggagctggtacaggatgcgaggattcctcattcccctctttggtaaccagttctgcaggctgcggtagcactcagctgtcttctgggcatttgtttctggacatctttctgactttttattattgctgagaaaactgggcactgacttggcagctgaatcccaactcactccctcactcactcacttactcactcacttagtcactcacttactcactcactcactcactcactcaacgcagtggtgaccgaattccttccctgggcccagcacttcacttaccagtgatgaacaagaaagtcatggttcctcttcccttggtagagggaagtctacaactgtggctgcaaataaatagccagacacaaaccagacgcagcttatgtaccgcttgtaaacaggatgaagcaaacatcctattgctgaagaatctcatggagagagaatggcaactcccttctgcctgcagcataaacagactctcttagccaggagagccgggtg

SEQ ID NO: 125455 - DNA, 1040 bp, Homo sapiens
gccctgcatatggctccccaggaacccctgcttggtttggtagaggatggagaggcaccaggtgaggggaggaggccactgtgatgtccttactagacagacctgctggccatggagacacttctttttgctgatcattcatcatctctttagcatgttagagggggaagggaagcacactggggtttcctctgcactagagcaaataggtaagaacagaagggtttgattccacactgggttacaatacttacactaactgaaggcttagatcccagccactgtggtatgggttttacaagaatgaaattacttaatttttgcctaatcctgtggagaaggtgtagttatcccaaatacaacccaaaggaagttaaatacattgtgttagttcactcactagttagcggtggtgctgagatttgaacccaggcagtgttaacccctctcccagtcacttccctaaagtcttctctcccgtagtacccctttgatctccactgccattgtgggacacttctagagtcaagtcttgtgtgacttcctcttttgtgactttactccattcattcactcactgaaggctggtgagggttgatggagacaggatagcaggggatctgccccacgtgcagaaacaccagggttcaagtaaccacgatgtgggcgatgaggggtgtggtggaaatagccttgaagttagaggcagatcagacagaggagtttgggcttcacccagtgggcagagggaccactaacgtgtttgcattaggaagaatggccagatggagccgtccttgaggaatattcatcttcagtgtgtggaaatgggactcaagaaggggaggcaggtgatgcaggagattccttcagagtccactgtaagagtctgggggagagaagacaatgccccgagcagcagtggagcaggggtggtgggaaggggccagcaggaagtcagatagaatcccatgtgtggggaaaggagcaacagtggagcaggaacggggtaaaggaggggctgggtttgagccttggca

SEQ ID NO: 125456 - DNA, 1030 bp, Homo sapiens
gattgagaagagtggtggagaggattgggggtccacctgtacctcaaagaggatggaaaaatgggggatggaaagagagggaaggaagacagataacaagggtatatgtgcacattaccaggatgttgtttgaatgttggccaatttgttttggtttggtttagttcagttttagatttgatgttgaaagtagtttttgtctatttgttgcaagtgaatagtgtgttttcccttatatacaagtctatatgtaggactcagtttagcacaaataatacttctgtaccagaaggactacagtataatcatcggaggtcatacgcctctcatccttccattttcttctaaaacagttggtcacagtcttgcctcatctatgaaggtcactttacatcagccataaaagtgaaagggaaaaatcattatgagctgacatggagtgatttgcagtaatcattgtcaatgaagaggggacatggaaattgtttatggtatatatctttgtgcaagaaagaagagaaaataagaataaacacatatttgctttcttttgacaaaaaaaaaacaactcaaaaaggaagaatgaggatgtgtgggaatgaggtatccaacataaaaataggaattagatttctttgaatatggcttgcttatataattttgattttgaactacacaagtttttatatattcagaaaacagaatagcatcaaaattgaaaaaggaaattttaaagttgaaaaacagaaacaaaggaatctaactgtctaaagttgataacacaactgcccagaataaagacttaattctgataattttgaacagttttctgaccatatatctttattggaacatattttaagaacaaaagaaatggcaaataactgttgagatttatctggtacaattatagttggtaatggtgttgtgttgtaattcttaaattattttgtaggtattgtaggtggtacaaaaaataaaatacaatgatgttattgggaatggaagttctaactgtggaagaagggct

SEQ ID NO: 125457 - DNA, 1105 bp, Homo sapiens
cacactgctgtgttcttagctcagacgaaatcaccattggtgttttgtgtttcgcagtagcttttgactctagtctcaccttcattcattcattgcacagatatttactgtgagcctgctactcaccagcattttatgccctgggaacacagccatgaatatgacaggtgaggtctccctgcaactctgacacattatgttctagtgggggagatagagagtaaataaataaagtataatttctggaagtgatactgagttggaagagagttgcaagggctgcagtttttttataggcgtgtgccaccacgcccagccaaaggctgccgttttggatgggctgtcaggagagcttctttgaggaggttttgctgtacatgtacgcctctcagtgaagagaggagtaagccatctactgtgtacggcagcatgtgcacatctcctgcggtggggctgagcttggcgtgtgtgagcagcaggaaggcaggcagtgtggcaggagtagtggggctctggggagaatggctggaggtgaagcaggagagatgggcaatggagaaggggtatggaggtttataaagttcatgagatgccctcagaaggttttggggaaaggcaggatgtgatctgagcctaccctccctatccctccagagaagtcatggctaaatgcaagtgccctgttattgacctgcctggagtcctctgagggtttctgccacctctgggataagatccaggctctgccgcctggtccctgcatcctttccatggctgccctgctgcacactgtcagtccccagctgcagcttacctgcgatcccagttcttcacacatcccacaacctttcccatcttctcctgtagcgacccttccttatgctagacatgtccttatcccattctgcaacacatagctcaaccagtgccttggaattgtcccctcaggccactaccctctttcctagaaagagcatctgctccacgagcattgtatatgagcctttctcatggcacaagccttggtgtcttgagtgtttgtttatctgtgtttcctaccagtgatggacttgcatcagggagggatcctgttatcctcatttgt

SEQ ID NO: 125458 - DNA, 1033 bp, Homo sapiens
agatccccaacacatgggcttttgcacccatccttccttgcctgcagttttgatccagcagttctgaggcttgggggctgcgattggaactcagaaggcatctcatggggaccaagctcagatagacctgggccggcgtcctggctctcttcctcactagttttgttgtcttttgacagctacataatctaggtttcagtttcatcttctataaaagtggaataacagcacctcccttgtgagctgtcatgaaaactagttgggacactaagaacctaccacagtgccaaactcatggttagcattccatcaactttagttatctcctgtcctcatttgaaatggggatcatagtccttatgtcaactgtttttgtataggaatcatatcaaaatatttagtagttgccaagaaagtgttcagtgacataaaaattgtgtcattatcagcagcacaatccaataaaaccagtctggctggttctgtctcccaggccttgctgggcagcccttgaacttaacaatcagacctgctggtgctgacaccagtgagctggacagccacgcctgggaactcttcatcctcccaggtactaaagcttcaactaaaagcactcaggtgtgggctccataattccccaccaaagtggggacctccacccactgtgtgaaaaaaaaaaagaacttttttttctgttttattgtcttggttcatagctcaggcccttgccagcactttgcagggcttctgaaatgctcttctgatttccttcctccagcctcctactttccttatccaccccccatattgctgccaaaagcagtttgtgaaacatatcccactgaccatttatcttcctgcttaaaacaatccatttgctccctccttctcacacgtgggagtgcatgagtgtgagacctcgtgggccctccccaggcctcctggcctgtgtgctcttgctcataggagcctagggctggagggtgtctcttgcacctttccccagtgcagtgtagatgacaggtgctgttca

SEQ ID NO: 125459 - DNA, 1100 bp, Homo sapiens
tttgaactgagataagttctattcctagggctgcaaacaccctgcctcacctcgacctgtgaccttgctagagcagaggtgcagcctgtccccatccagcctggggagccttctgccctaagcctggtggcggtttgcctggtgggtgtggctgggcgtgctggggtcagtggatggggaacagcccctgctctgggtttctctggaacccagttcttctggttctcccctctccacagctatttaactcccaacccccacctgctttcccaggtctttaaaagcaggtgtggatgcagatgtggcactacccttgtaaagcagcagtgaggctgaaacagatgagcacgcggttgttaaaggactgggaacacacacagaaaggtgtcagaaatgccctgaggttctgctgtgtagactttcttgagtggggcatcagaagtgctgccgctggttgtcgggcatcgggctgctgttgcatgccccttcaggaggccttcacattggaaacgtgagcatgagtgacctactgagggccagaggcctctgggcattctgggatgagaaggaagctgcacttgacatctaagtcctcttccatcccacagtttaaaatggcatacagttatgggatatttcctatggatatgaaatctgatttcatatgcacatgtgtatgagagagaacaatgtaatgaacctttggtgtacactccaacatggtatattttatttcattgtataccccacttgccctctacctcagctggtgtgttttgatgttatcaatgtgcatttaaaagcattttgttcatttttcttcaagtgttagaggttgctttttttttttttttttttttttgggagatggagttttgctctgtcacccaggctggagtgcagtggtgtgatcttggctcactacaacctccacctcccgggttcaagcgattctccttcctcagcctcccgagtagctgggattacaggtgtgcaccaccaagaccggctaatttttgtatttttagtagagacggggttttgccatgttgaccaggctggtctcgaactcctcacctcaggtgatccacccgtgttga

SEQ ID NO: 125460 - DNA, 1016 bp, Homo sapiens
tgtttctggtgacgacgcaaccctgccattatatggagaaagcagccatggacaggtgacacgcactgaggctggtgaaacaatacacagactccccagcgtggagatacaccaggcctggcggcctgtcccaagcattcctgggagtagcagggcctgtgcagaccctaaaggatgtagaggatttaggttgatgcagaggaggaagactggcttgtacacactccttagctcatgacccccctactgtctgtataggaataattaaattgaacaaaaataagttaatatgtcagtactatgtaccaggaacaaacatacatacttgcaaatttctaaaatctgatttcttgtttttttttggttttgatttttttttaagtcgaataataaaatgtattttaggcacatagtaattattgagcaaattgccatcaagtcaattttgaaaaaaagacctttgggtctttcagaattctttttgcataactttagtgtccgtatttattatttctccttttagcacctctgttttctctagaaatattctgcctttaaagtccagtctcaaggtagcatctgatgatggtgattaaatttatgttgtctctcccaggaatatttgtatttgcattatctgtttatccagtgaaaaaacattgtgtctttaaaaaattatttaagtgtaaggaagccggatgtttttgtcttctgccaaaattcaccctatgttcccttaccctctcttccccacgaggctcctgagaacagtgcctggcacgtagtgggcacatcatagatatgtgaatgaatgagcatattgaggaaattcaggactctaaccaagaatttgcatctttggaggagatcttgttttgaaatctttcttgaacggaactaccactattcagcacctcagagccagtcttggctctgagttttgctatatttgggccgtataaagaaatctttctagggtaaacatcttctatttccctcttaaaagggtgcatttt

SEQ ID NO: 125461 - DNA, 1045 bp, Homo sapiens
agggaggagagcccagaacagatgactgaagaagatcgcatttgatgggtgagggggacccaactgctacagggggagttggcgtcaccagagaaaacagcactgggtacgtgaactgtggcggttcgatgacacttcaaaatataaacacctaaaataggttttatgaggcgttggcattcccaaaacactgaagtgtttaagtattttgggaattgtatttaattattgaacaatttaggcaagttagctattttcaaataggtaaaattagtttgtctctctggtagaacttgtcattcatttttagaatcttgagttttaaatgccagatagatccagctgctataaatatgctgcagatgtagctgtccagtcactcagacaggcaagagctgatgattgaggactaattttcagtctaacggcagaagcaggtgtcacaaggtaagtcagcttcaaggcttcattccctgatgtcaatgatgacttccttaggaatgtcactgcagatatgggtttgtttttgttttttggtaaatgaggaattttagatagtggtagctactgttcaccacacataacctttgtaacaagctagaatatacattaaaaattcacaaagtatgcagctttgtattttgagataactttcttttctttttctttttttttttttttttttgagatggagtcttattctgttgcccaggctggagtgcagtggcacgatctcagctcactgcaacctctgcctccaggttcaagcgattctcctgcctcagcctcccaagtagctgggattacaggcatgtgccaccatgcccggctgatttttgtatttttagtagaggtggggtttcaccatgttggccaggctgatcctgaactcctgacctcaagtgatcctcctaccttggcctcccaaagtgctgggattataggcatgagccactgcgcctggctttgaggtaacttttcaatgccctattatttgacttttattccttaagagaaggatgtttttgttgttgttgttgttgtt

SEQ ID NO: 125462 - DNA, 1388 bp, Homo sapiens
cttcatgatgaatttaaaatgtgtgccacgcctttcccatacatttgtcaggcagcctctctgtgtatcactgggtttttagaaagccaagccataggattattcactgtcagtgcaggactagtacacagggcaggccctgatggtaatttgagtatgacaacagctgtatcactccttacaggactgcaagtgtcttaggagaaaagcatttccccggccacctgccgcctgctgcgtgggtgctgtgattagtcacaatgtgcattgtgctgggtgtgttttgtagttttgttgttcctgtaattgacagttatctccaaactgaaatcgtctggaaaagcagatgctacacgttgggggattttaattttcctgttctctagatgattggtgtcattttcatactgtaaaaaagtgtgctgttatttttgcttttggtagaagggcacatggtggggctggtctatcactgcctggatttggaggcttgagtcaagaacctgtctaggccaggtgccgtggctcacgcctgtaatcccagcactttgggaggctgaggtgggtagatcacctgaggtcaggagttcgagaccagcctggccaacatggtgaaaccccgactctaataaaaatacaaaattagctgggcgtggtggcacacgcctgtaatcccagctacttgggaggatgaggcaggagaattacttagaacatgggaggcagaggttgcagtgagccgagatcgcgccattgcactccagcctggcgacagagtgagactgtgtctcaaaaaaaaaaaaaaaaaaagatcctgtctaaatatagcatgcttgtctccccaggcagctgggaggaggggcctgcatgatcatagatgagggtgccttgtccacctggctctgggctctcactgagcatgctcttccttgggacggcttctcaattcagctaatctccagattagattcaccctgtttggtgtgcatgtgtgtgggagtctctgtgaatgtggagcttctaaatttatttatcatttgatacgggtattgcgttctagtatttgcagagctggcactcaaggctggccactatgtttttagttcagagatatgattcagagagatgattgtagttgagacgtccctaggggcccgctgttgatttgttgtgtctctctgctgtacttcacgcaggcacagagaagagatcagtaaataacgaaatgaatctgccctatgatgttgacagatatgtcctctcttacttgctagttcctcagaggcagcttgggaatattgttgggtggtcagaaagtatttagagagtctgggctacaagtgacatgacttgtctgtccatctgctgtgcctcttgagtgttcttac

SEQ ID NO: 125463 - DNA, 1005 bp, Homo sapiens
gttccccgctgtgcccctcagtctttcttcgctgcctcgcgatggcttgctggctctaacagggatttctgctttccttgctctggcgctccatgcagctagccgttcatctgtttattcagtcataccccaagggttgtgagcccctggcaggaatgggcactgtgcaaggtgctggagacctaaagaagacgtggcctttgctcttggggaggatggtgaggggcagaggcagattccatgcagtacagtgtggtgttgctatggcagacaccagccggagggaagggcacacacctggggaggcaccctgcttcagggagtggcactggagttcctacctgaggtcaaggtgttcacatggagaggggagtatgcatggtgccagaaagggtgctggcccaggtgtctgggggaagtgggatttagcatattagtattcagggttattatttgagcagtttaatcttcctgaaactcacaaggaggggccgaggctgaggttgtgtgggaagctggagagaaagtcagggcagtagggagcccaggaaggcttaagcagggtggggcgagcctaaatttgaatttagaaagatagcacacatctttcacgcaccctttgttctgatatctgtgtttatttaggggtaaactaacttctgattaagacaagatttaaaggaaggctgagcacaaatcattttacaatgtagacaagctttttccaagccagcaatctgagttgtgacattgcaggtttcacattatctctgctggaaaggaccctggtgatcacccggccaggcattctagtttgcctgttccttcagaatccatgttccccaatgattagcagtcagatttcaaaataatgcaaattagatgtgctgatggcacacattgtcctctggtaaccagtagcacataatttatgccactggcattgtgacttgcccattctattgagtctctgtgattggtgtatgcatttgattgtgtttgctc

SEQ ID NO: 125464 - DNA, 1496 bp, Homo sapiens
actggtctgcagtaagatgagtgcaccactaggagtgagcatctgcagactttcatagcagcttaatgttgttgcgatatttaagtgcatggtcattgatggtgcctcaagtagggtacagatgacctgtcttgtggagtcatgggtcacctgtgacatggagagcttttcctgtattatgttcctcatccccctagtagacctgtacataggtgctgttactgtcactttcttgaagaggaggacactgagtgtcagagaggttgagcagcttgctcaggatgacagcccacccctatagccatgaagcctggcagcggcctctccctcagcaccatttcagctcttcatgtttcattgttctcagagcaggactgccagcctcttcctgggcccagggctgcagcacccttcctccttagagagcgccaactgggtttgaggagtgccagcatgctatgggtcagtccccctgaaacctggactcatatgctagggattattaaccattcagtccctttgaaacttgtgacttttgggaagaaagagagacagataggagaagataggtaaaatttggatgtccatagtctccattgatttaccttcttttctgttctagcaaatcgaagcaaaggatttgcacaagttctttggaatataatactttctaaacagccagtgctgcacctcctgggcagacaggcagtggacaccgctgtgtgtgactgttgctggctcacgcattcgttagtgtcttaaggatgtccagccctggaggagtgtgtgtgtgtgtgtgtgtgtatgtatgtgtgctcatagacttggaacgttgtgtggctcatctttgggaggtgtgctgtgcagcctgtctggcctaagggcagaaagatatgaggtgcccaccggcaacacctccccttggctttcctggcctatgccattcatgggtgaggaaagctgttcagatgttgcctccctgactccatgaagattgattgtgctggggagagtctgagtggagagtatcttggggtagaggaggaagaggagagctgagatatgagaaagggcttatgtgctcggacaagtggatttgacctcagagcttcgatgtcatctgtgctcagacaaaggcactgtaggcttgtttacagttttggatggtacagtatcatgttagtggtgcagttgttgttattaactcctgaggtaggatgagactcatgcagcatgtgaagtgacagggtcaacagtgaaaatttacacatttgcaccattttgcagctttcggagtcccaacatctgtgtattcatttgacatgacatgctcatgagcctggtgggcaagcatttctttccctacttttcagatggtgaatgagccatgagctaagtaagagcaatggagtggcctgccttgctcacatctgctttgttgctggggtgggggatgccctgtggccccagcccatgtgttaggaggtcagagctca

SEQ ID NO: 125465 - DNA, 1724 bp, Homo sapiens
cccctgaaagctttgtcacttcgagggactgtttagcctcctcatccctcatgactaaggcggagatgactggattgcagggttttatgagatgattagagaccaggagtaacagcatcagtggagggcctgtcacaggacagttcctattttttttttccaattatttttcattataaaatattgttattttcccattattgtttttctgccagtattccatcattctggtccaagaacatataatagatgtgaaactctgtcctgacacctgtttttacaaagacttgcactgcctttccagtaggaaatattactgctaccatttgttttcttatggtagaaatgcggccaatgccaccttgataggaaactaatgattctaatgatcagaagggatctgttggtttagaacagaaaaatagcactagaaatacaatacaaatcatagcttgtattcacaaattgtttttcagtggatgttgtaaacacaggtttgtaccaggaccaggtgggtcacaccgatgaggaagtcatgggctggacagggtgggttggggactgtggggagaatgaatggtgactcccatcccactggaagagctttgttagaaggctggacctgcctgtgacctctgcctccccacttctaaatagaggtcattgtgttttgccctttgttttgctctcctagcagttcttggatgttgtgagggcgagaccacgattcctccatcatgcaggtgtggctgcctctctcacaccatcactttccaagctgaccttggtgctggcgacaacatgggactggattctggtctcctgactgttggaccagtgagtggttttgggggagcattagtgtctggggacttcctctgaacttcaaggtgccgccagcgttattccatgataccctttacccattaaaaataatataaaaataaatgtctgagtttagtgttggtgtgcatgcagtcagcagcctgtcccatatgttctgtcggcggctctgcagaccactcagagaaaaataacagcattgggtgaccacctttaaaaatgatgtttggatattggataaaatactcagccagtctgtagacccactgggaaaagtataaggaaaggatccatacagaacggatcagtatacatttgtaccttccctgtttggagttgggtcagcagataagctgaattttgatacatgtctgtgtttgtcacatgtaacatctaagagcttggtaaaatccctctcccaggcacattaacttcatataaataaataggtgctcatgaacaccagttgctttgacacacttccttgtggaatgagtctgtttttgctagaggaaagtaatgacaagtgatgcctctgtttctgtggctccctccatccgggagggctggggatgtcaccctgtcacctctcacctccagtggccgtctctgcatgcatggtcaagtcaggtgcgcacagagaccggattgctggttttgtatttttgtttgtttgtagagatgggttttgctggtcttgagctcctgagtcaggcaatctggccgccttggcctcccagagggctgggattacaggtgtgagccaccacgcccggcccgggattgttgattttggatgatgggctttcctgtccacattcgattaggttttgtgtccccagattttataaaagggtataaagcatttgtgtctatctctg

SEQ ID NO: 125466 - DNA, 1021 bp, Homo sapiens
gcaattcttctgcctcagcctcctgagtagctgggattacaggcacgtgtcaccacggctggccaattttttttgtattttagtagagacgggtcttcaccatgttggccgggctggtctcgaactcctgacctcaagtgatccaccgccttggcctcccaaagggctgggattacaggcatgagccaccacgcccagccatcatcgagtacaatgttttaagcgcatacctggtacctggtttaggggctttttagtgctgtgaatgagctggtgttcttggctctcctggggcctatgcaagcagaatgtccctcaatctattttttgtttttaacttagttttagtcactttcacaaaagtaatttatcctccttatgatgtttcacttacctgtgcagaatcctccttctgttagaactgattgttctaaatgacatgcaccaagttggaagattataccttttgtctctttattttaactgttgatctgtggaaaatattgctttgtagatgaggtatctagacagcaacctcagaggaaaattatatgttagaaatgttttcttgatgtttacttttcattttctgagttaaaaattatatagtattcttacagtcagggataagactggctgcagagcctgatgggaagtaaagcatggcttgtgtttacgctgggctggctttcatgatttacccatgtgcctaggaaggggatgcacttcatttgtgtaacattttttacttagggcggtgtttttataatgctaaatatttattgtcatgaaaaggtgttcttgtttattttaaacaagtgaaagtgacatataattgaaacagattttccacaaggctcagcttatgtccctctttgttgtgtcacagtgacatagggactggcccttgtattacctagtggtgctggcatttggaggggcgggggctatgctctggggagcacggctggtttgcagctctctggtaacttcttggtgagggtgtcaacctacagaacgt

SEQ ID NO: 125467 - DNA, 3140 bp, Homo sapiens
atggtgcgatctcagctcactgcaacctccacttcctcggttcaagcgattctcctgcctcagcctccggagtagctgggatttacaggtgtgcaccaccacacccagctaatttttgtatttttttttttttaatagagacgaggtttcaccatgttggccaggctggtcttgaactcctaaccttgtgatccgcccgccttggcctcccaaagtgctgggattacaggtgtgagccactgcccccggctgaggtcctgtatttattatatggtgttttcgtacattccttcattctctccccatccacatttaattatgaaggttttatgcgttggttaattttaattgtgtggttttttttttcagttaccttatactatagctgaaaaaaagttggtatttcatgacccactgaaagcttttacatatcttcatctttgtactttttctttatttaaaatactgtagttattggtttatattactacatagagatgtattgataatatgcctttttacacttttatgattttcatttatttgagttgtaaattttagtttccatctcccccattttatactttgctttctcgcttccaccttgtcacttgagtgtttctggatttttcagggccactccctggctttctgcttctgaattgatgggaagcctacgtcacttttctttcagggttccataattccttatttttcatctgtctcttgctggaatagaattaaaacttttttcctcttgtatactttatatgattctagttgcttcttgcaaagctaaggatggtcaatactttcaagacctagtgctatttattctagactagagtttgctgtctcctctggtgcgacaatagacaatgggtttccaacagtgtgtgtattttctgctgcctatctcagggccatccctgtgcttctgagccagcccctccagagaaggatggctttccccagcagggagaaaccctgtggcctcttggggtgttagcacgcttccctctgctctcctcatcaggtggcgagctgctccctgccagggcattgtcttctataggccaagtccaattagagtaatcccccagctaaaaacatttctattaaaaaagagaaaaagctttttaagcaactgccagagtatatttttcttggatacatttggttagacagattcccagaccacaaatacttttgtacaaatacttttgtagatccagttcccacctgcaccacaccaagtgatgcctgtaaaaaggacatcaattgatttagagaaaccaataaagtccttatcccttaaaaaaaaaaaaaatacaaccggccgggctcagtggcttacgcctgtaatcccagcactttgggaggccgaggtgggttgatcacgaggtcaagagatcgagaccatcctggccaagatggtgaaaccccatctctactaaaaatacaaaaattagctgggctggtggcacatgcctgtagtcccagctacttgggaggctgaggcaggagaatcgcttgaaccgggaggcagaggttacagtgagccgagattgtgccactgcactccacctgatgacagaaagagactctgtctcaaaaaaaccaaaccaaacaaaacaaaaacaaccctccaaagataaaccaggtaagtcacgcgtcctggctggtcgatcccatctcttgtcttccaggtgctcctctagcattcactgcccaagaacctgaatccccatggggagccattgccttagagatgctcccacctctctccagacagaggctgccgagggccagacagggcatccttccctgattcagaatgccctctgcttatttgttaatcctattgactttcttctatcaaaggcagacagcgggaggattagtggaaagaaaattgtctcaggaacaagaagctttggaccctggtgccagttgtccaaggtgaaattgctccttctccacgcagcctgcaggcccatcctgatggggcctctccagactttttcagcccagggctgtctgatgatgcttctgccaggtgccagtgttctctgccagtgctgccagacacaggtgcttctgaacacttgactggtgattattgcaactgggagctgagtctttcaccttttaaaattttaatccatttaaacttacatagctgtgtgcggctagttccagtggacagcgaggctccagcctttggatttgccactctttgtttgccaccgcagcttcccaggcctcacctggggtctcaggctttctctctcaccttggcctggagagctttcttgcccctttctcagaatgcctgttgtttaagctgcagctggggctcccccaggaggccttctgagagtatccctctcacaccccacgccctcccctgtccgaaaacctcctatgggattatgattgtccctttacttgcccctctgacccactgaattctgagcagctccttggagccaggactattactttgtaagcttttgtgtcattggtttgtggcctgtgatgcacagaacaacccctgcttccttcttgctggtggagggagttagataacatgatcttaagactcatgtgagctctaaaatcatatgattcagtgttcccagaatattctagagtcctctttcaaaaaaactgtttcttaaattgctgcttaaatcttgtttttgccagcctgtatgagaacagaccgatcaactggcactaacatatttggaactgatgtgcttggactcagcttgccagccatgcagcctagttcggtgcagatttgggaggtgttaagaggtcttattttgaggaacataaagtgacagtggcttaaagaggagataattctctctcctatctaaaagcccacctcgggagtcctgggctggtgttggggtgcagcgttcccagagacctgctgatttttatttggtgctcagctgtggctggtgtgcagtctccatctgttccagcctggcctgaggagggggagatgcaccccgtcctttcgtgctccacctgccagccatacaagtccctttgctcatgtccccttggcccaaccataatcacatcgtccttaaaagggcagcttggaggcaggggggatc

SEQ ID NO: 125468 - DNA, 3165 bp, Homo sapiens
gggggcttccctgggctcggacgcccgcgtccgcaccgcgcgctcccgggcagggcgccctctctgccgccccagcgggtgctggtggtagtggtggagcaggtggtgcggtgctggtgttgggtgctggtgttgggtggtggtgcgtgctgtgtactttgggcacccgggtcgttgcccaggtaaccgtgtcgggccggggccggagcgcacttttcgcgcggggtggtttgtatgcaggcgtccttatgggggtccccgccagcacagcccccactcagctccgagctttcctcaggccccccaagtgtttgccgtaggggtggagcggggagcgaggggacgcccggcctttgactccggcctcttccctgcgggcttgcccctggccggttcccatcaagtcttccctctcccggcctcggcggcagccccaggatcggctctcccggcagcgtggaggggagggctccccggcttcgcagccgcccgggccccgcgttctcggaaggtgttcggattgcccggagggtttcatggcagcagctctccctccctgcctttattccagggtctcccctggcagtggaaggggcgtcctagtggggccaggcctgaggcgcagacatccgtagcggacccgcgagtctggcggcccatccctgtcttcgcgattccgcttttgcccaaacctctcccggtttctgtttgctatccccacaccttgcgtgcagggattacacgtcacattcaggatttgactctcagaaagagtaatttccctcaaacaggacgagcagccctgctcattattcagaccccgagccaggtgcgccgtgctcatcccggccagcggtgcaggctgggccgcggggtagcgcgcagtcccggtggactttgtagttttcagcgcggcgcgccggggaccttcgaactcgctcgctcgcctggagcaaatgtgtatgagtcttgcaaatggaatgagggttggggtgagccctgcacctgcttactgaatgggcccactttctgctatggcaactggacttgaaggaggcagctttggggacaacaaatctttttttctgttacagttgtgtcccactgactcaccctgcccatgtgcccataggcgggcgtgttgcccaagtgtgtaaaagactttcagtcgggctctttttaaaattttaaagttttcctttaatgccaggaaaaggtgagccaggttagcaaatcaaataatcctgaagctgaggaatgttaaaaagaagttttctttctctctctctttttttttttttgcagtgcacttactggtggttatataattctctttgaacaaacaaattccccagaaagaaagtaaatgtgggaaatcctttttcatggtaataggcatcccaaaataacagggaaatgtgaaacagaggtatctttaaatctgtggctttcatagcctattaaatgagcctatttaaggacactgaattattttgtcactatcaccttataaataaatatgaagacagagagaacatttaaaaggccggcaaaactgtatccaaagagtatctgtaagatccttgaagggagtctaatgatagaagtgaaaggacttaccctaagagcgtggcactcttttcagcctggtactgtgtggcaagaggtagtcgagggctggccttctcagggcttcccagagctctgattggctttcatatttgaattgcaaagtaaaactaaggatttttgctatggaaaacatgaaattattcctgatgcattcagttctttccctcactcatatccagtgtctaatttacttgtccgaacatctttgtccaagaaatgtagacatattatttttaacttctattgttctcactttgtcatttgttaatactttcagtgaagaagcatcaagaaaatgttaatatccttatattttttcagacaagaattacgtgtttaataagcaattttgtgttcaaatctgaggagataaatggtgttaggtcttcgaatattttatataatttaggtgtatgcttgctaattataaaggttagatattgctgtgaaatttgtggctttagtacattattggtggcaggcagattctgttggctcttcactgagattactcctctgttccctgagattaaggcagtgtttgcagtgtgcttgagggaaatttgttttccatctgattctgcaaccgtttattataaaatcaaactttcagtaagcctctgtcttcccacatgataacaaactgatgtggtgaagctgttgctgttgctgaaactaccactcctccttgtgttgtatagaaacaagctagactgggtgcagtgaattaacgagatttcaccctgtggcctacaaacgctcttctagaagattactgaagggagataggttggtgaatgtaaactcactgactctgtgtctggctaaattattaacaggtagttattagttatctttgtgaaaaacacaaatatacgtttttacttggattgaaattgtatgttttttactaggaatttcattaaaacagtgatgtatgacttccttgactcctggggaaagtgttcttttaggaaagaggctgtgtgcaaaaactaacaagtcagacttgatgtgacttttagggagttttagagctcagttgaagtataagaattgacagaatactcagaacacaagtaaaggcaaattgccttttggtgaggttttgaagtatatttaactctctactttatctgtttactttgcgtttgtctgaatatttataggagccatcccagtagtcggctgttacagaacacagggctaaatttcccattggaccctctgttaataaaggacagaagaaggcttgctgtttggcaggaccatgcttaattttttttttcctatggaggaaagacatgtttctgtagaatacagtaatctccaatgacatgaaatgtcaaaacagctggtgcatttgatcaatggctgtattcaagcagtttgctcatgtaaaaatcagtggaagttttgctaatcagtttcgtcaaaatgtggacttcatgtacacatagctgttattcatttctttgcataaatttatatttatttaatcaagttattagaaccaaaagaaattttaaaaaa

SEQ ID NO: 125469 - DNA, 1033 bp, Homo sapiens
gttgctgttcctttgttttcagtgaaatgtttttttcagatgacaaaacacagtgggagtccacagaagggacagcttgtggagaggtggcagagaagatatttgagtaaaaataaaagcttaagactttatgaaagcttgtaaaaacttggggttttaaaataaatagcaagcacaggaagttttgaacatctcagcatagctaaatttaaatgctctaattcatggcaagttagagtctggaatacattttaaattctgtgcctagtctcacaccattctgaggaaagtattgacccatgtttgcctaaaatcacgtgctgacactgcagaacagtgcccagtgttcacacaaaactggtctttgtctcttaaccccatttcctgtactggtgtgtgaagtgtatcaactgcaatacacctttctttctctctaccttgtctacccatgtcatgggattgtaccggcccattttgttcactgtcccactatcccatcctactcaacctgtgcagggtggcccctgaatgcctttgaacactatcattgcatctctgaacttggacctttttggtcacaatgaattatttattcaattaagtgctttctattggttgttgatattttcctttgctattttgctggcaagtagttttctttctgtggcacgtttatcatattttagaatcactgctatatttaatttgtagaatgtcataggaagctttgctttgtgtatgttcaaggtctttgtttcttaatttgaagtttgaaatagcttacttaccaaggtaaaactacatcttcataattatttgaaaacactaccacaattttaaaatgtattttagatttaggctttttaatatcttaccatataaatagcacttctcataattaatcttcaatttatttcatattttaacttctcaaggaacagtttcacatttcttatatctgtttctttatggttattattttttatcaagttcattatgtcttatctatttgataaaattttaagggatctat

SEQ ID NO: 125470 - DNA, 1051 bp, Homo sapiens
tttggatttgtaaaactcacattgttgagttatacctgtgatgggctgaaagtttttgattctttcctgttcttcatatgccagtaccataaacaaaaagtatctcagatctgtcactttcttctcctaaaccaatgtgattgcagctttttgccttcagccttttccctatccaatatctcctacatagttaccttttgatcctaaggaactgtttcgattgggtcacttccttgcctaaaattccattgattgttcattgttaattctaaaatagagttcaaatttaaaggcatgtaagttcccctataatggatttcctctactcccccttccgctgtaatctcccatttttttactgaaatgcttcagttagcatgagtctttagaggtcttgatttacaattttcctgaagcaggaataccttgctttcctctactagtttaccacaattacagctctcttttaagcctcagaaaaaaatctcacttccatcttgaagtcttaatccatgctttttatatccatgtgcctactccttctctgaaatctcctatggtttatctttttattcatttaatatcccacgaattgattttattatatattttttatggttgcatgtggtctttctagttatagcaatatacacatacatgcataaatacatatacacctatgtaaatgtgtgttgggagtatgtattcacacacatacatataccccaaggccatgtgtcatctttatcaatatttaagttttggaattgttttgtttgcctcctatatcatagaataaatggtaaagagggctaatttattactctaagtgtatttcttattatattaatatcagacattatatagaatgtactttgttttactcactatttgtaagatacaaaggtatataaactgacttatacatcagcttgaaacctgagataatgctaaaatgttctaagtattttaaatgtttaaagaggacaatcatgtaatgttgctaaacatgaaaaatgtcatcaagtggaataaagaatagctgaagtta

SEQ ID NO: 125471 - DNA, 1036 bp, Homo sapiens
taatccccaccctttgggaggcagaggtgggtggatcatggcgtcaggagttcgagaccagcctggccaagatggtgaaaccgcatctctactaaaaatacaaaaattagccagatacagtggcgggcgcctataatcccagctagtcaggaggctgaggcaggcgaatcgcttgaacctgggaggcagaggttgcagtgagccaagatcgtgccactgcactctagcccggaccacagagcaagactccatctcaaaaaaaaaaaaagtacggtgaaaatttggtcatctctaagcctaaggagaccatatagtcacatttatagctattagctgcttaaaggccaaaattgtatgtgcatatatatgcaagtgcgtgtatacttgtgtatgtttacatatatgtatatatagatagacatttacatacatgcacctatatacgtgtatattttaaacacggtagaaattctgaaatgtagacttggtgctggcaaatgtgtgttatgttgttggttaagatgattctgaacattaatattttttgacataattgtaaattcctattatagcatacatttaggctgattattttgatgacttacttggttcttgacacatgagcggataaggtattacatacatattttgtatgtatacatgcaaatgaaatgagggctgaccaagaattctggtgatagagcagagtaaccttcacaagcaacagttgcatttcttaagtaggaaagaataagtatatttttcttattcaccctactcctagcatatatgagagctatatactgtgaaacagtattaaacttcaccatgcatgaatcacctgaaggaatttcttaaacattttctgtttgttaagtacctgtagcaaaacatactaatgcccttcctgtggcagttccccagtttctcttctttgcaagcaaagtcatctcgtttttcttcaggttgtgtaccacgtgtatgggtacgtgaacaacacgtttttgttcacttgtttttaacatcatgtaattgg

SEQ ID NO: 125472 - DNA, 1051 bp, Homo sapiens
tgtctgccttgggtcatactcaggtccgtcttttcatattagattatgagttgtgaggcaggcctgccttgttatttatattgtatgtctctcctatagagtctggtccagagcccccttgtatccgttaaaagcactgaataagtgtttgttgaattaagtgaacaacttcaggttcttgtctttttaatggtgatggtggcaataataatagttaacattcattgagaactttccatgactgtgtgtcaactcatttaatcttcatgaggaaacaggcatggggaggctaagtaatctactcagattgcatggctagtgatagagcaacacgggaaatctttcagaagctagttacttagaaaacttttcttctagttaaaaaaaatggtttcaatgtttaagaagttaaaaaatctatctttagatattttttaccttaacatgaaggccaattaaaacattttgtgagagacactacagaaaacttactcttttctcatgttatgccaggacagctgtaaaactgaaaggaatcttgctttccctgcttgaaagaggataatcattgtttaaatcattttgagatggtagcaagggaaataactcattgggttgaattatcagttttttcttaagatttttttcttcttttttttctaagtatagcaatcaaaattaatattcacagtattagaatttaaaataggcacttgctggccttttagttatagcaatactatttaatagcataagcatttaaaatgctaaacattaaagtatatgctcaggggtattttatataataattttctcttttttttgagatggagtcttgctctgtttcccaggctggagtgcagtggtgcaatcttagcttattgcagcctccgcctcccaggttcaagtgattctcctgcctcagcctcctgagtagctgggactacagttgcaccccaccatgcctggctaattttttttgtatttttagtagagacggggtttcaccatgttggccagggtggtctcgaactcctgacctcaggtgatc

SEQ ID NO: 125473 - DNA, 1133 bp, Homo sapiens
agatgatagtcaaaatcacattaaaattcaaaactcacttgtaaataacacccaaggagatgaagaaaatggattttctgatagaacctcaaaaaaatcacggggaatggaggccttcaaaatacaaatataagtctaaaatcatgtttagtaaagccaagtcatactataggagaacacattcagatgcaagtgatgatgaggctttcaccacttctaaaacaaaaagaaaaggaagacatcgtggaagtgaagaagatccacttctttctcctgttgaaacttggaaaggttaggtattggtaatcctgcaatcacttctgaccaggagttagatgataagaagatggagaagaaaacccgcaaagtgaaaggagataaaaagcagaaaaagaaaactaagaccttcaatccaccaacatgtagaaattgggaaagtaattactttgggatgcccctccaggatctggttacagctgagaagcccataccagtatttgttgagaaatgtgtggaatttattgaagatacagggttatgtactgaaggactctaccgtgttagcaggaacgaaactgaccaagacaatattcaaaagcagtttgatcaagatcataatatcaatctagtgtcaatggaagtaacagtaaatgctgtagctggagcccttaaagctttctttgcagatctgccagttcctttaataccatattctcttcatccagagctattggaaacagcaaaaatcccagataaaacagaatgtcttcatgccttgaaagaaattgctaagaaatttcatcctgtaaactatgatgtattcagatacatgataacacatctgaacagggttagtcagcaaaataaaatcaacctaatgacagcagacaacttaatccatctgtttttggccaaccttgatgagagctgattttgaaaatcaagagtttctgtctactactaagattcatcaatctgttgttgaaacattcattcaacagtgtcagtttttcttttacaatggagaaattgtagaaacgacaaacactgtggctcctccaccaccttcaaacccaggacagttggtggaaccaacggtactacttcagttgccgccaccattgcaacctcag

SEQ ID NO: 125474 - DNA, 1015 bp, Homo sapiens
cactctcttgcgtcataggccactgtgttggaggcaggagtgttggctttggaggcatagagattaaaattagagtaacacgtgagcactgaaaaggttaaacagtagagacatggaggactcccgacccccatgtacccctttcttaaccctttaattaagatcacagccctagaaatagcttgcaaaataattaactactgatcatttataccttagtgcttctgtgagcatgttttctctttcattgctgctcatctgcatggaaaaatgtgcatgggtttctgaatataactccatggtgcttgcttccattatatttgtgccatttggatcataactgataagcaaccaaagagtcccatattactgcacgttcccatcgctattttatgtgaaggtggtcctgggggctgttctgaattctcagtttccttttttcccctccccagttctttgaaaatatcagaaacggacttgtggcatctttgaaaagctacttaaaatgtgctgctgtgctctgaacttgaaaatgtgcttttaatacaaagtttgtgcagcccttgctgctcatacgagatgaatcttaccatgtggtggatgcccgtctcatgccaggcactgtgctctaagcccattggtttatttcagtgcttgaaattggctttcgagagaggcaccacggttccctttttacaggagaggaaacaccagaggatcagagatggagagtctttctccacaaactcacagaccccaaaggcaagctcagggttgtcagcttccaaagtctgcctgctccaggacctcatgttgcatctccattctcttcactgagggtcaaatggaaagaacacatgggggtcaagtttcagaaaataagagaaatgaagaaatatgtgcccggaagcaagaacgaccgacctcattaaactggctcccttcacctcctctcacatctttttctgccttttggccaagttttctctcccccgcatttcctccttgatctcgt

SEQ ID NO: 125475 - DNA, 1050 bp, Homo sapiens
aattgagctgtgaccaacatgacagaatttcctgttttagggcttttataatatagatagtttatatctaatttcagaatatattcactggggaatggacttagcaaccactaccacaacaatgcaacaatgtgttttggaacaaatttaccaatctgaatttccccctagattaggtcacaggaacattgcagctgatgtacagctatgttcctcctgaaacttggagacacatcctcttgagctgggttataatgggccacccaaagctcgagttcctgtaatggatacactcaggcagcagaacctaccaccgtagtgaggacagcacccagagccctcagaggccatcacaagtgcaccacagctgccttctctggcacgctcagagctacacagtgtactctgggattggaactctttatttttttttcagttgatttgtaaataagattgcacaaaaatccatgcacatcaactctccaaatcagaatttgctgagctaaaaagagcattaaattagatgggctggctttcaaggggtgggggtgcaatagtggaactctgcacaacagttctttacaaagagacaagcaagcacatcgcgtggaaatttccattcaactggaaatgtccaagcctgtttacctcaattaattgtccttgttcacttgtccagcctagcaattgtccattagtaatttgttataaatgagacatttggtattaaagcatctctttgggatactggtatggtttattataacattctgttagtagtgttgtacaagcttgagatgtattaatacgaaatccaagctgcatgagggctttatttttcaagcctacaccttgctgaaattctgaattaaaatatgattctcagtacaaatgaataaatcaacagaaatggtaacgcatgtcaaatattcttaaaacccaagaaagccttgtaacttccttcaatctaatgggaaatgcaggcaaatacaagactgatgtccttgagttttattatcaagactcaagggcaccagtaaaatctagttt

SEQ ID NO: 125476 - DNA, 1088 bp, Homo sapiens
tgctcattaacagtatatcctgagatatttcctataccatttaatattttaaaagatgtttacactggccacagtagctcatacctataatcccaacactttagagggcaaggcaggaggatcacttgaggcttaaaaattagccaggtgtagtggcacatgcctgtagtcccagctactcaggaagctgaggctggaggatcacttgagcccaggagttcaaggctgcagtgagctataattgcaccattgcactccagcctaggtgacacagtgagaccctgtttctaaaataaataataaataaattaaaacatttaaaaatacatgatgtttaattattagaggactcaattttatatctatgtatacaataatttttaagtttcttaatattggacttttagtacctttttaaaaatactatttttaaaaaaatctgtatttctaactttttataacaaggaacctttggctttgagatgactggggaatccattctttcctatagtatccatgtccaatggacttaaagtattaatcaatgtgtttatgttttgttatttttctggcattacaaaaaattctaaatatattgttaccgcctgtataaatatcagcttttgagagaaggacattgtgtagaaataatgaaacactgcaacttgtatttgtattattcttttttttttttttttttttgagatggagtctcgccctgtcacccaggctggagtgcaatggtgcgatctctgctcactgcaagctccgcctcccaggttcacaccattctcctgcctcagcctcctgagtagctgggactacaggtgcccgccaccgcgccgggctaattttttgtatttttagtagagacggggtttcaccatggtctcgatctcctgacctcatgatctgcccgcctcagcctcccaatgcactgggattacaggcattatattattctttaaattcacatgagaatttagtatggcttcaaaaaataccataagttaaaatatcaccaagactctgttcagacaaaagtatcagaaaagtgagccaggcactcacatagtttatagtttata

SEQ ID NO: 125477 - DNA, 1057 bp, Homo sapiens
actggtgggtctgtccacactgcctagctgagccttggtggctgctcttagccaaacagctgaggcctttgcatccctggagaaatgtcatcacattacttaaggcaggcacacaaatccagaaacatctgtaaataccccttcaagcattcttttaaagacacttcttgactcattgggcagtatgacctgacatttgcccatgtttgcaagcaaataaataaaactaaagtcttccgcaagccattacaccaaaatattctattcgctgagttactcaatgaaataccgagttgccctatattttgaagcctgttaccagagagactgaatgtttttaaatgcatggcagtgagtaacaacataaggctaatagagtcaacatttctgctttgacttaaaccttttaaaccagtggatttatgtgaagtctctgcagtgtggcatttaaacatttcaatctaaataagagtgtgtaatttgattgatgctattattctaccagattcacgagtgcagtgggctctggaggtagcattacatgcatgggatgagcatttgcaaaagaaagttgtatagggaatatgacagagccaagttaatgtaaatattaatgcctttctgaactctaggccacagagttgatcttttttaacttccttggtttgggctaaggaagctgtgatccagagaagccacgtgatttgtctaaggtcacatagcagtctggcctaaaatagcttgatatgctgtggatggaaaataaatgtgatccctcaagaggcatgaggatttccaggcagtagccatacctccaaattgtttaatctggatttagattgttgggtagtcacatgcagcagcacagttaacagtgtgtcctcctgtggaagttgccagcacagccagccctctcacttgcatgcatgcccaccagccttctcacttgcatgcatgcccactgggtatgtgctgtactggagacgccgggggtaggggcccagtcccaaccccaaattctttaaagcctatttttctaagttgcatctggtttcct

SEQ ID NO: 125478 - DNA, 1023 bp, Homo sapiens
cttgatcttacagaagttgaaatgtttatatagttaaatccatccatttttccttttttttttaattctttgatttctgcaagttgtttgttgttttttgtgattctacttatgagttatagtctaaatagggtattatctcattaaaaaaagtaaccttataaaaaccaagatagactccaaccaatgatgcactgagatggtccaaggaaagtaacttctgtctgttatgtttgtacaacttagactttaaagtatttattgcaacattgtcccattcttgtgaagttaaagttatctcttcttttggatctcagatcattcataatttcataagacggatccagaccaaaattaaagatcttctgcagcaaatggaagaagggctgaagacagctgatccccatgactgctctgcttatactggctggacaggtgaggctgtggggtctaaatcactgatacattttattcttagattatgagatgtaagacttgactgaaattttcttctcttttaaaatggtaaagatttggccaggcacggtggctgacgcctgtaatcccagcacatttggaggccgaggcaggtggatcacctgagcttaggaattcgagaccagcttggccaacatggtgaaaccccgtttctactaaaaatataaaaattagccaggtgtggtgtcgggcacctgtaatcccagctacttgggaggctgaggcaggagaattgcttgaacctgggaagcggaggttgcagtgagccgagattgtgccactgcactccagcctgagccacagagtgagactccatctgaaaaaaataaaatggtaaagattttatatcttttttttttctttttttttttttgagacggagtctctgttgcctgggctagagtacagtgtctgttgcctgggctagagtacagtggtgcaatcacagctctctacagccttgacctcctgggctcaaaccatcctcttgcctcagcctcctgtgtagctgggaccacaggcaca

SEQ ID NO: 125479 - DNA, 1285 bp, Homo sapiens
ccccctggctgttggagctgtgatttatcacaaactcagaagtgactgtgagtcccaggaatgtgtcacaaagtgagttttagaactggaaacattttctcccaattcccagtggaagctcttgctgtagaaagatattcagaaaggaaactatttttccattcatccattgttgtaaacagatcactccaaaatgttaatcttgagcatagtggtgggatcatatgccctctttttatccaagcatgtgtgtgccttaattttgggaagaataaatatatttccttattttaaccatgtttcctaagcaattttttgttttcttcaatgcatgaaaattagcttacctgctttagattcaccataataactaaactgatgttaggttcaacccttaagtaactgattagatatgctaatgatggaacaattagggaatgtaagcttttattgcacctattggtttacgttcttccttgaagaagcagaaatcacggttcattcctagggtctggtagagtatctggcacgtgctagtcagttaatgtttgttgaaagataggatgacgctgggtatagtggcatgtgcttgtagttccattaacttgggaggctgaggcaggaggatcacttgagctcaggagttcaaggctgcggtgagccatcatcctgtcactgcacaccagccagggcaacagagcaagaccctgtctctaaagaaaaagaaagaaaaaaaaaaagacagaatgacagtctaattcccaagcattggtgacattgcagtccttttttttttttttctgagatggaatttcgctcttgttgcccaggctggagtgcaatggcgcgatctcagctcactgcaacgtccgcctcctgggttcaagggattctcctgcctcagcctccaaagtagctgggattacaagcatgtgccaccacacccagctagttttgcatttttagtagagacggggtttcaccatgttggtcaggctggtcttgaactcctgacctcaggtgatccacctacctcggcctcccaaagtgctgggattataggcgtgagccaccgtgcccggcctgcagtaccatttttatttaaattttaaatcactttcttttacttctggatttcaaaataaaattttatggtttaaaatagatgtaaaggtagaaattaacagaaagatgttttgtttttaattttgacattcaaaaggggactagtaaactggagacgtttttgttgtgttctggatttgggagtatttttaaaaataat

SEQ ID NO: 125480 - DNA, 1038 bp, Homo sapiens
gtgttagtgagaggtccttgagtaggaagggcaatccaaagactgttttgagaagtgctttcctcccctgcctcaccatccctttgtagaaatttacttacctgttagacatagaactgcatatttatgtttgcttactaaacattcatagagtgctccagggtaactgccaggcactgttctataaatgttacacgttatctcattaatcctgctagcaattacttttatcttcatttttgtttcaaatgggaagtgaacacttaacactgctgttaagtgtgagggcttaagatgctaacccaggcagtctggttccagtgtgtaccccacctcgatgctctgcttcctctgccgtctgcgcacacaggaacatgttaggaatttgcatgctctacatcgcgagggcagtggtggccctggaaagtgtattccccttagaaactcagtcacccttccttagaaagaccatgtgatttagcctacaaacggtggcactttgaagagtgaaataggatgttgttaagagctgtgcctggacagtgggcatcaccaggactctcctgagaaaccctggttgtgttcccctcctgaagcccaggtagggcttcagggaggaaccggcagcagctgacagcaccatccctctcctagggaggcttcttggaagctcattactggactgacctttcttttctattaactcagagtttcctgtgaattacatgcacagccagtgagggccctgattttatctccctctcccctgttgctctgtgccagctggttatgatccagggacccaggccacgaatgtggcagattctaagggtggctaagagtagggaacctcagaggcctttttggttcataaaatgctaaggttctatgcctttgttccgccagctggctgaagtgaggtcctgcaaacaatccttacaggaagagtgaaagtactaagctgtctcctagtagccctgctgaagttattctcagtggccttcacacagtaactccttagaaactaaaaggaaaaaa

SEQ ID NO: 125481 - DNA, 1051 bp, Homo sapiens
aagtgatttgcttaatttcaataatcagatttataatttctgtgaagatattgatcacttaattctcaatgtaaagattaaagatgtcatcttatttgtggataatccatgggggcaatagcaagaagtccctttttcaccataaaggaacccaagcgcttgggtaaggttcccatcatggcactgagcccatggtggattagagcagaggtgtagagtgattttaaggagactggattgcttgagcccaggagttcgagaccagcccaagcaacatagcaaggccccatctcaacaacaacaaaaacataataaaaaataaaaaattggctgtgcttagtggtgcaagcctgtagttccagctactcaggaggccggggcaggaggctccctcgagcccaagagttccagactgcagtcagctaagatcatgccactgtactccggcctgggtgacagagtgagtctctgtcttaaaaaaggagattggcttagtcactcacaggaaatcactcttggatttttttcccccttttgagatgttatcattcagtatatatgaagtttgcctccaggaagagaatgctcagccaagccaactcaagcatcttgtgccttgagagtgacatctttcactgtcattgttagtaggttgctatccttgtttatatgctgccagctcttttgaatgaattagagtgaatctgtcttcccaagtcttgtcacctgtgggaccctgatatgactgagacttcaggccagagcctgggcagtgtggtatggatttactgggtaatgcatggtgtgtcatctcctgatagaccttaaccatgtgtcttctggtgacctccctatgtcatttgaagccccttccttttcacctttgattctagaagactgcttttgaaaaaatgggcacattttaaaacatttttaggaattcagatgcatcactaaatattttttttttaagtggtgcaagtatgaaaggaaagggctctgagccaggcgcagtggctcacacctgtaatccaagcacttagggaggctg

SEQ ID NO: 125482 - DNA, 1026 bp, Homo sapiens
agacaagcctggccaacatagggaaatcttgtctctactaaaaatacaaaaattagccgagcatggtggcgggtgcctgtaatcccagctactcaggaggttgaggcaggaggatggctcgaacccaggaggtggaggttgcagtgagctgagattgtgtcactgcactccagcctgggtgacagaatgagactccgtctcaaataataataaagtaaataaaataacttttgatttgccttagataacttgataccagtttgataaaccattagtcttcattttaaacagcctgccctgagtatggtgaaggtttagtctaccgattctcgttagcgtatctaattcagtgtcttaaacaaacatcatctcattcttacagggctcgtgcaatccgcttcagacaggatggtaacgaagccgtcggaggattcttctctcagattgggcagctgtacatggtgcaccatctttggggtatctgtttttcccttttcgagttactgggatttaagagttcattactaagttgtactgggaagtagagcacatcttgagtcagtaaccttaaccactacagcaaatccgacgtcacagagggacagtctgtacggggctgtctggaactagcgaggtcaacagtgaaagtccatagattgatggcattagtgagctgaaagtgagtagggatgatggggaaaggaataaggggtaaagcaagcagccatggaagaaggaggccagggaagtcaagagtgccttccacagagtggtcccagcctttctttgtagactgactgcttacttcctcgacagaggcaggcctgcattttacccagagcagcagcttcctgcacatactcactgcctgcctttgtagacgtggttccactgtctcatgacattgaccccctcaccatttccatccccacacacttttgtttggcaccatctttggtatttttccaggcctgccccagatgtcacccttccccagtagtgaacatcatcactcctcctgagccc

SEQ ID NO: 125483 - DNA, 1050 bp, Homo sapiens
taagaatgggccaggcgtggtggctcacccctgtaattctagcactttgggagactgaggcgttttgatgatttgagcccaggagtttgacatctgactgggcacaaaaaaatacaaaaattagccaatgtggtagcacattcctgtagtcccagctattcagcaggctgaggtgggaggatcacttgagcctaggaggtcaaggccgtggtgaaacatcatcgtgccattgcgctccaggctggttgacagagtgaccttgtctcagaaaaaaaaaaaaaaaagactgaaagtttgcttttcccacgtggcctaatataattttgctcagaatttccccagcccagtatattacacacctgaagtagtccctgagaaaactagatgtccaggtgaagcaagactttaacggatgtatgggtggaatgcagtgtatgtgttttaagtcttacttctctgtgtggttatttttaagcttacagggatcttcagaccagggaagacatacggaatgcagcatggcacaaacatggctgggaggaattggtatattacacaggtaatctcttaacagccatgaaatatgctttttgtcttactgtttcaatcatgttctttcaccctgacactaataggtgggttttgtaatagtatgttgctaggatagtgagttatcaggttgtggggggaagggagatagtcaatttttctctaatacttacatgactttttttcaataaagtagaatatccatgctttcaaataggtatatcatctgttacagttttcagacccttggatgttgtaaattttacatcattacctgtttttgtagatttctatattctctgaaaacttattacacaaataaaatttttttctaagctttccttttccatcagaattgttagtatcccaaatcagaacttaatacatcaattaaagagtgattttgaaattagataaattaaacttcctgtatgtacagtatgtatctgggtacataatacatgcatgtgcacatacataagtatattatgaaaccctgtt

SEQ ID NO: 125484 - DNA, 1069 bp, Homo sapiens
cacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccacatatcacgtttggattttcttttttaatttgttctgagattgacaaacattgctgtgaatgaccttgtcactcttgcaaaatagcttgtcacaaaagattgaaggaagtgaggaagtcagctggcttctggggaaaatccctccataggaacaaattacgaggccctgggcaaggtcatgcctggtatgtgctgagggcagcagaagccagtggcag

SEQ ID NO: 125485 - DNA, 1012 bp, Homo sapiens
aaaaaaaaaacaactatatatatatctaaaagaaaagaaagatggcttcaaggaggcacaggtatttgagctactcaggaggctgaggcaggagaatcacttgaacctgagtggtggaggttgcagtaagccaagatcgtaccactgccctccagcctgggcaacagagtaagactccacctaaaaaaaaaaaagaaagaaagaaagaagaaactggtgtagtgtgggaagtaaacaaaaagaaaaggaaaaaaaaatgaatctgtgagaacactcttatgtggcctgcactgactttgacacaaattagattggcttagtaggcaaggtgggatcttttcataattttatttgatgtctttaaatacatttatcttttttcttgtaggaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgtagggatagcatttattcactttatgaaatgataaagactttctaaagagtgactgttttggatgaagtgctagaccctggctatggaacatttgcactaggctttttctttcattccttagagctgaatttgacatattcattcatttatataaatatttatggcaaacaaacatggataagacatgttcttagcttgatcggggaatgacaaccgtcactaactaaagaagatggcctggggggcgaggtccaagtgtccagtggctttgtgtcatggttgaaagtgtgaccttagtggttccctggaaaggttcagagtctcttggtggatcctgggtcagatcccctctctccctcctgccctcccgccctgcagctggggacctccctctgcagtcccagtcccccagtcatgcaccatgtcattttctttttttttttttcgagacggagtctcattt

SEQ ID NO: 125486 - DNA, 1031 bp, Homo sapiens
tggcggcagcgcggagcagcttctgaaggtccgggagctcttttcctctgcaaagcggaggtgccacaggcaccgtgcacctctcagactgcaggggctgagcccccggaggaggagggggctggttcagggagcccctcccctggggcggggccaaatcgtcctcccagcccggctttgcagagcagacagatctggtgtctccagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggtaagtcccggcttgtgccttccctgcgcccaactttcagattttgccgactttccttttcctcttccaggcttcctctctgagtctacatttcttcttaatcgcgtaggcagatcatttcctaaaatctccaggctttcttttcattgatttattttttgggtagcttcacttgtctaatcttacagcagctgcctgttgccaaacagcatgaatgaatgatgcaatcctacacaggagcacccttagtgcaagattggaacaatccccaaactcagagttgaagtgtccgactttgtcttctttcccattagaattagaattttaaaataagtacttaccagatacattgttataacgatacagccttaagttgggaattaaataaatcatgctttcattcattaaatatatttattatattttcttttctttttttatttttatttatttttttttttttcagacagagtctcgttctgtcgcccaggctggagtgcagtggtgtgatctcggctcacttcaacctccgcctacagggttcaagggattctcctgcctcagcctcctgagtatctgggtacccaccatcatgcctaactaattttttaatttttgtatttttagtag

SEQ ID NO: 125487 - DNA, 2944 bp, Homo sapiens
aaaattacaaacctacaaaaataattataatgtgtgtgccctttaggagatacctggcttattctcactagagctctacacttgccataaagaggcaaggatgtacaattatgtgttactgttaactggtagctctgtcatcttgagtaaacttctactgagcctcaagcttcctcatctgtaaagtagagataacctgggaaataaattacacatgaagacgtttcaatcattataattgcatgtgcatgatagttaatcgaagtaatttgtagccaacatttgggtagctttttcaagtagatagcactcaaagaggcccttcctgcattttgtctgtggtatatttagactgcttcatattgttttaagtgattcattctttttctacttacagcaaattcaacacccaacagcttccttaatagcaaaggtagcaacagcccaggatgatataactggtgatggtacgacttctaatgtcctaatcattggagagctgctgaaacaggcggatctctacatttctgaagtatgcacaactcttgtttctgtaatttttttttgtatataggaagtgtctgatatttatacaaattgatgtgctgttaatagtagctgaggtcatacagtagaattagggggcttaaatctgggtctttatcctggtctaaaacaaattgtgaccttggacaggttatagaacctttcttggcctgaaaataattttgtaatcaagttgcattgcctatgtgatttgcatctgtctttagtgtagattaataattgagatctaaaaatggaatgtttaggactaggcatatttgttaggaaaaaggcaaccaaaagcttatatttggataaattccacttttttagccctgactagttccaaggttaaagcaaacctcagtgaatatgaatgtattgtcagaatttcctggagaaagagaacagtctttatttttattagtaaatgatgtgagttagtttgagattacctatagaaaggatagaatagtccaggcgcagtggctcacgcccataatcccagcactttgagaggccgaggtgggcggatcacctgaggttgggagttcgagaccagtctgaccaacatggagaaaccccgtgtctactaaaaatacaaaaattagccaggcgtggtggtgcatgcctgtaatcccagctacttgggaagctgaggcaggagaattgcttgaacccaggaggtggaggttgtggtgagtcgagattgtgccattgtactccagcctgggtaacaagtgcgaaactccatctcaaaaaaaatgaaagaaaataaagataggataatgctaccatctgtgagttgttgggacacagtgttggttttgaaatgattcagagtggtttgcacagtgaacacccaagtgtgctttatagttcccttggctttgaccctgtgctagagcattcattacctgttcatctgctctgcattgaaaggaatatttgtccttttaaatgtattcagaaagccagcacattatattacctcgtgttcaaaggtatgatgatccagaacactccttcaataattacctgaactttatcatgaactatggttgcacctaattgaagatgcaagtgttaatgtgtgtttattttagggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggtatgtattaaattttgtctatgtctggtatagtatacctatatagaaaatctctgatagtagaaacatgaatatgattaccaatttcaattacaaggtgctgtgtaggttcatttttgtggcaatgatacctaatctgtgtctctaaaaatgaggaaattaaaataatagtatacctaaccaggttataaaagtaaaattgaagctttcattaaaaggtttataaagtggagatttttttattagaaagcttccagttaccagtatttttaataaaacgaggaatgttaatgttaattaatgttaatgtttgggaattatagatggagatttcagaaatgtaaatgacttcagctgttgccttttacatataatgtattctatttgctgatagaaaaagacttaaatcagtgtagaattgtaaaatgaaactgcctactttagccttctgaaaagcaacatgtttctgctgcaaattgaatttacttaacggttatgctcctccaattgcaggctgtagtggactccattttggccattaaaaagcaagatgaacctattgatctcttcatgattgagatcatggagatgaaacataaatctgaaactgatacaaggtaggtggtagaagactgtgaaatactaatgggcatggaggctcacacctgtaatcccagcactttgggaggctgtggtgggcaaatcacctcaggtcaggagttccagaccagcctggccaacatggggaaaccccgtctctattaaaattacaaaaattaaccaggcgtgccgggcatgactgtaatcccagctactcgggaggctgaggcagcagaatagcttgaacctgggaggcggaggttgcagtgagctgagaccacaccattgcactccagcctgggtgacaagagcgaaaccccgtcccattaaaaaaaaaacaaaaacaaaaaataaactgtgtttagaaatttaggggtgctttgtacaatatagatagttggctttttttttttttgagatggagtcttgctctgtcgcccagcctggagtgtacagtggcatgatctcggctcactgcaagctctgcctcccgggttcacaccattctcctgcctcag

SEQ ID NO: 125488 - DNA, 2918 bp, Homo sapiens
gacttcatctcaaaaaagaaaaatgtgactgcgtgaaatatcaataccttctcatttcagtgtttaatatattaaatacccatctgaaaatcaataaccataattttgtgtgtgtttaaacagcttaatcagagggcttgttttggaccacggagcacggcatcctgatatgaagaaaagggtggaggatgcatacatcctcacttgtaacgtgtcattagagtatgagaaaacgtaagtttatagccccttaacagtgaaatggagaagcttcgtattttaggcgagttacttttttgtgaaactttgtttcccactgtaaggacaataatgctcaaattggtttgggggagctataggaaacagtctctgaagatgcataaggggcaggattggagctcagtgaactgttaaatcttaggactaatccagtttcagaagctgctttcttaatgtttccctgctttctgtaacttttttttttcttaatagagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaaggtgagaatgaaaactcaatgtataaactaaatagtacgtatcatcctttttacttttaaggtgaaagatgttgaaattaatttttatttttgttacagggaattgaccccttttccttagatgctctttcaaaagaaggcatagttgctctgcgcagagctaaaaggagaaatatggagaggtatccgagtaatttgacttttactcattttgcaagtgaattgggattatttctttttccttatactttatttttgggtttttcaactgtatagttaattggcattaactatattcacattgtgcaccccgtcagcactgtccatctctaggacttttttcatcatcacaaactgaaactgtatacccattaaatagttactccccatttctccctcccccttgccccttgtaaacattattttactttttgtttctgaattcaatatacttttttccaaagagctccccacaataaaaagctttttttaaaaattttttattattattttttgagacagtcttgctctttcgtgcagtggcatgatcttggttcattgcgactaccacttcctgggttcataggattctcagcctcccgagtagttgggattacgggtgtctgccaccatgcccactgaattgctttgtgtttttttagtagagatggggttttgccatgttagctaggctggtctcaaactcctggcctcaagtgatccacccacctcaacctcccaaagtgttgggattacaggtgtgagccaccatgcctggctaataaagagctcttgtccaccttttagatttcatttgctaacttggggagagtggtttaaatggagggttaagagaaaagactagtttttagctggttgatggcaaatggaaaggcttaaagtacattttaaaatttaattttgtgtgtaattctgaaaaattccttcctaaaaattactggtcttatctttgaaattcactggtaacgttgcttatccatctcccttaaaatgctatttcaggctgactcttgcttgtggtggggtagccctgaattcttttgacgacctaagtcctgactgcttgggacatgcaggacttgtatatgagtatacattggtaagtgtatttttttcttaaaggtaatagaaccttttagctcgtgaattatttttgtttgtttgtttgaggtggggtctcactcctgcccgggctggagtgcagtggtgtgatcacagttcactacagcctcatcttcctgggttcaagtgatcctcccgcctcaggcttctgagcaggtgggaccacagacgtgtgtgctaccatgactggctaatttttttttttcttggtaatttttgtagaaacaggttcataattgtgttgcccaggctggtcttaaactcccgggctcaggctgtccttcaccctcagcctcccaaagtgctgagattacaggcatgagccaccgtgcctggttcatgaagtctttagcagaaaaattaattgaaattcaggatcagatttttgtttatatacattttgaaggtttatgtgtagtaatgggaagccattgatggggaaaatcacatttcttttatgtgatttttcaaaaggagataatttgctttaatgtgatcaagtttgttccttattaatatgctacttgtcattctctgtaagtccctcttctctcttcactctgcacaaatcctgtttttgaaaatcatattttttctacacatagggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggtaagatcctcactgtatttcaattcttttatattgttttgctggtctgaaaggcatggccgaatactgtgtttttatcagtagtttacacagccagacaccatgcaaaagcagtcttccctttagaatgactgatggtatgctaaggtttttcatagcatatcattattaaaggtgaatacaaataaatgaactaatactgatctgttgaaagctgccagtggctagtgaagccattctggttgaaccattctcctatttggtatgttagtcacttgtattttgtcatagtaaatttgtaagaaattaatggctttcatatgtatattttgttattcataattagttctgcagttttcttagcatttttc

SEQ ID NO: 125489 - DNA, 2342 bp, Homo sapiens
gtctggtattctctgaagggaacataaatgttctgtctttatgcaatgagtttttttttttttttttttttgagacagttttgttcttgtttcccaggctggagtgtaatggtgcgatctcagctcactgcagcctcagcctctcgagtagctgggattacaggcacctgccaccacacccggccaggtttttttttatttttagtagagatggggtttcaccatgttggccaggctggtctcgaactcctgacctcaggtgatccaccttccacggcctcccaaagtcctgggattacaggcgtgagccactgcaccaggccgagattttctttttcttttttcttttttttttttttttttttttttttactatcagttattagttcctgttttctcaagaattaaatttgtttactttaggttcttgctcagaactctggttttgaccttcaggaaacattagttaaaattcaagcagaacattcagaatcaggtcagcttgtgggtgtggacctgaacacaggtaagagaatgcaactgttgtagagggaaaactagatgtaatacgtgtgagttgaagccaggaaagattaaaaatgttttgctttgcaatttgacaccagtgctgttagggaactctgggttctaaaatgggataaaataggatattaataaaaaatggaatgactaggtataattaagggacgagtagacatgagtaatttggggatacaattttggagatgttgagtggtggtagatggttcagattaatgttgaaggattttcatattgcatttgccttactcagtttttaatcaagtactatgataagaaaatagatgtggtgattatattcatgggtgaaaaccagctaaagatagcaattaatgccagaaaaggggatgtagaaatctagtgaaatggtgacagccctgatcttaggttcctgtaacaaaacaacacaaattaagtacaaagtaggagataacaggtacctccatgcagtatgtgcaagacctattgtcaacattaatagaaaaggtttctggaatgagggaaatgatcagtccattttagtcagattatagttgaagtgctatacttcagtatgagtaaacagaaatgtatccagaagaagagaggggtgttcaggacttctaagtataagtcagacattcatcaaatattgtggacgggggtcatggtttagagtagaaaattgggctaacagagaagctttgaattctcatagttaatactggaggaaatgagtcatcagtgataagcaaagctgcacacaatattgttggttcttactgactgaacttattttaagatttggttgccttttaggtgagccaatggtggcagcagaagtaggcgtatgggataactattgtgtaaagaaacagcttcttcactcctggtaagtttgggaaaatgaaaactaaactgttagagaatcatacttttttcatttggtgttctctgtttagttgctcctttcccccatgaataatgtgatcagctggaagtatggaaactgaactagccctctgatgtgtagaggggaagggggaaatttaattggatgtaatgtgtgcagcttggttggaagtgggaagttgagtcgaattagggctcctaatcatctgagccatcttatttttgtccccctttcagcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttga

SEQ ID NO: 125490 - DNA, 1027 bp, Homo sapiens
tggtgaaaccctgtcactactaaaaatacaaaaattacctgggcgtggtggcagacgcctgtaatcccagctacttgggaggctgaggcaggagaatggcgtgaaaccgggaggcggagcttgcagtgagccgagatcacaccattgcactccagcctgggcgacagagtgagactccatctctaaataaatacacaaataaacaaacaaataaaataaaaaattaattaacctcacagaactaaacactgaagagagtgaattttactgtatgtgaattcgttgtattctaatttaaaagaaaatcactcaggcttcaggttaattccttggcaatcatgaacactctgtggtgtataacttacaggacagggatatctgaagtttcctggagcaggagaagatggggtgggcacagaacctcaccagctgaaccagctgaactatgtctttatagggattttgtcagggagaaaaagtatcggacagaagctgagatgtttggatggagctttgtctttgaggactttgtctctgatgagctgagaaacaaagccacccagccaatgaaggtgagagaacctggtcttgcagctgaggggataggagtgggacctggacagggaatcctgtgggacatgggttacctgggacacagtggagaatcagacctgagaggtggaggcagaggggaagcaagagaaactcaccatggagcgtcagatcagtacacactcccaggaagttaaccctgaacccaagttagctcttgcctaaatgtccaagtcaggataggatccaaggaacttgaatcaagagatcaccttggtgggccgagcgtggtgtctcatgcctataatctcagcactttgagaggctgaggtgagtggatcacctgaggtcaggagttcaagaccaacatggcgaaaccccgtctatactaaaaatacaaaaattagacaggcatggtggcacgctcctgtaatctgagctactcaggaggctgaggcatgagaatcgcttgaac

SEQ ID NO: 125491 - DNA, 2650 bp, Homo sapiens
ctggactcaagcaatcagcccgccttggcctcccagaatgctaggattacaggtgtgagccactgcacccggccgtgatattctcattgcttgtggacaggttttctctactgagctgttgtcaactgctaacatagaagttagtcactgtcttttctgctcttcagtgctgtctcttggggccactgtccctccccctactcttgcaagactccttttgtcccaaagccccttcttgtcccctttctcccaggactggcacaggctcaggacctgtcctcacaccaggcttctttccagaccatgctctccccagccctcatgctccctgatcatggccggccctgcggatgaggcaggcaagatgggtaagccctaggcctttttctcaggacgtgtctgtcctctctccccttctctgctggcaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctcagacatttgtgtctttgatcctcaccctgtgaccctaagggaagaaagcctgagtgtcagtaactctgggcctcccctaaagagaaatggagatggtggctcatctaggaagtagaggagcagggggttcctggttctcaggccacgtgtgatctctgcccacccagggcctgccccagcctgcaggtattgctgtgtggtgggaacacccacttcccttgtgcacagcctttgagaggggatcgtggcctcagttccaggggttcctggccagggccaagtgctccttctgcagaggcctgcacgcatctcacccctttgacttgtatttccatggcttcccctccccacctgccccctagccctccctgactggccagcccctcagtagtcctcctcggccagggagaggagcacggccttgggtgtgttctcgaaaagggctgcccggttctgctgctgccccttcttcacccagtggccatagattcggaaagcgtaggcgtcgatgagccggcgcagaggccggagggcataggggtctcggatgacgatctcccgggtcacaggcttcacccggcggtactggtagtagatccgcactgaagccagcacggtcagagcgatcacctgcagggccaggcggagaagctgggctgcagcccccgccctgccaggccctgcccctccagcacagggacgctctgggctcgtttgccacgaagccttgggtggcttctgcggggccttcctagtgtcccccacttcccacttggccagcatcctcagggaccgagccagtgggctgacacctgccgtctttgaagccatcacagggcagctgggaggggagggatgggtactctggaaattcacggggtgtaaggactcctgggagaggagggggcttagaggtttgcacttagggagctggcgggcctggatcaggacgcttagtaccttgaacttcccccgggggctgaagtgccgcacttcctccaccaagtactgctggaagaaggggtgtgccaaggcctcttccgctgtgtagcggttctggggttgcaccaccaggaatcg

SEQ ID NO: 125492 - DNA, 1075 bp, Homo sapiens
atttttgacgaaaccgatttctttcattcagttcatactacgcgtccacactgtgcctccaaaaatatttgcccttataactgaatgctcagaaaggctaagaaatctgcccaaggtcccctggcaatccagccagagatgtgagtcactcttaaggttggatttaatacaaatgtttgaaggacggagcgacaggccagctgccctagggaagcaaaatgctaagtgctctgatgcgaggaccggaggacaaggttcgcggatgaaccacaggaacttccgggttttaaagatcctggcgccaagttcagggcgttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcccacgtccggaggcctagccgtcgcttacctaggatgccgcgtggaagccgaagccgcacctcccgcatggcccctccggccaggtgagaccatcgcagggtttgagaccaaagcgcggccgtccggactctactggggcaatgacgcagagggaggccgcgggcgggggtgaactaaggtcggctgcggcgtgggctcgcctctgccaggcgggggtagattgaacgtaaagcctatgttaggggagtgtggggagggaattcacttacggaaaaagcttcctatccaaacaacgggaaaggcataacgttatggccaggtggtaggaaggcataaattttgacctagcttgatttcggggaaaagagcacccaaggaaataatccggaaatggtcagagggagcgtgatacatatgaagatttttaaatacgtgcaggacataattagtcttttgttatttgagaaggggtctcgaaattgttgaaagcatctgaacgttgaacagatgaggaatagttgaagttgcttttggtataatagttcagacgagtcactttggccagtcttgttttgtaatg

SEQ ID NO: 125493 - DNA, 1030 bp, Homo sapiens
tatagagataattctgtcactggcccttattagggttatgccctgaaaagctaataagttaatggcatttctccaaagttagagaatcatagaaagccgtttaaaaccattggggtcagtacttcttttggtttggacatatacttacatgccttcctcttgttcaagataactccctgcactatcagtacctttccatcatgttggttaaaggatataatcgaacccgaccaccgctggtcttcgctggacaccatgaaccacactgtccaaaccttcttctctcctgtcaacagcggccagcccctcaactatgagatgctcaaggaggagcatgaggtggctgtgccaggggtgccccacaaccctgctctcccgacgtgatccacatctgcagcgagacctccatgcccaaccatgttgtctggtccctgttcaacaccctcttcatgaacccctgctgcctgggcttcatagcgttcacctactccatgaagtctagggacaggaagatggttggcgacctgaccggggcccaggcctatgcctccaccgccaagtgcctgaacatctgggccctgactttgggcatcctcatgaccattctgctcatcgtcatcccagtgttgatcatccaagcccattgatagatcaggaggcatcactgaggccaggagctctgcccatgacctgtatcccatgtactccaccttccactccttgccctgccccggagccaagtcctgtatcagccctttatactcacacacttttctacaatggcattcaataaagtgtatatgtttctggtgctgctgcgaaaaaaaaaaaggatataatcatttaacaatacttcatcctgttcagagtgttctcacatccatcatgtcatcagagcctcacagcagtcctgaaaggaaatagatcaggtgtctgcctgtgtccatgctggagaagtcagtgcagaaagaaagaaaaagatgactgtggcttcccaaggcagcaggggaaaggatggtagattcgtgcc

SEQ ID NO: 125494 - DNA, 1021 bp, Homo sapiens
gtttgtagactaaggtttccatgactcaggtgttagatttgggcactgtgttctgaagtttcatagtggctcaaaagggagcaaaggtttatgatgagaggcacgaatctaccatcctttcccctgctgccttgggaagccacagtcatctttttctttctttctgcactgacttctccagcatggacacaggcagacacctgatctatttcctttcaggactgctgtgaggctctgatgacatgatggatgtgagaacactctgaacaggatgaagtattgttaaatgattatatcctttttttttttcgcagcagcaccagaaacatatacactttattgaatgccattgtagaaaagtgtgtgagtataaagggctgatacaggacttggctccggggcagggcaaggagtggaaggtggagtacatgggatacaggtcatgggcagagctcctggcctcagtgatgcctcctgatctatcaatgggcttggatgatcaacactgggatgacgatgagcagaatggtcatgaggatgcccaaagtcagggcccagatgttcaggcacttggcggtggaggcataggcctgggccccggtcaggtcgccaaccatcttcctgtccctagacttcatggagtaggtgaacgctatgaagcccaggcagcaggggttcatgaagagggtgttgaacagggaccagacaacatggttgggcatggaggtctcgctgcagatgtggatcacgtcgggagagcagggttgtggggcacccctggcacagccacctcatgctcctccttgagcatctcatagttgaggggctggccgctgttgacaggagagaagaaggtttggacagtgtggttcatggtgtccagcgaagaccagcggtggtcgggttcgattatatcctttaaccaacatgatggaaaggtactgatagtgcagggagttatcttgaacaagaggaaggcatgtaagtatatgtccaaaccaaaagaagtactgaccccaat

SEQ ID NO: 125495 - DNA, 1052 bp, Homo sapiens
gacggcggcggcgttagccggcgctcgagctgtttcccttcctggggcgccgaccccgcccgcttgcttgcttgcctgcctgcctgcctgcctggcgccatgcaagagaaggtgccaggggacgcggagcgacgagaggcgcgcggtcccggacagctccgtctctggcgttggcgctgcagccgtgacggaggactacggcgacgactagggccgctctcccagctctctgcgtgccgcgccgctgcgctctgccgtctgaccatctggagtgcaggctgggaggcgggatggagtgatagggaagatgtttataaattcctctgtgggatcagagggcacgccaattgtaaccagaaaactccaagtatggcagcaaggatgggtgaacaggctgtattagggccaaaatcaaatgctgattcagactttagacaaagggccctggcctattttgagcggttaaagatttccccagatacctggcaggtgtgtgcacagaggctgtagcccagaggacatatagtgatgaacatgtaaagtttttctgctttcaagtgctggaacattaagttaaatacaaatactcagaactaaccacggttcaacaacaactaattagggagacgcgcatatcatggctgcaagctcagatgctgaatccccaaccagagaagacctttatacgaaataaagccgcccaagtcttcgccttgctttttgttacagaatatctcactaagtggcccaagtatttttgtttacattctctcagtagtggacctaaatccaaggggagtagatgtgtgcctgcgaatcctcatggctatcgattcagagttggtggatcgtgatgtggtgcatacgtcagaggaggctcgtaggaatactctcattaaagataccatgagggaacagtgcattccaaatctggtggaatgatggtaccaaatattacaaaattatcagtatactaattctgaagtgaccgtcagtgctttgaagtagttggggcttacgtctcttggatagacttaccccttatagccaat

SEQ ID NO: 125496 - DNA, 1049 bp, Homo sapiens
agtaaagctttcagcaacaagcagactataaaacaatgtggctgttctgaagtttgtctggactgtttacagacattcctgccagccctcagttgtcccttacaaaaggatattctcagaagtggagtccgtactttccttcatcgaatggttatttgcctgggggaagaagtttttccgttcatcccagctgcttcagaacgtatgctcaaagattgtgaagcagaagacctccaggagttcattcttcttatcaaccagattacggccaaattcaagagacaggtatctccgtttttacaacagatgttcatgcccctgcttcatgcaatttttgaagtgctgctccagccagcggaagaaaatgactagtctgctgctttagagaagcagatgttgtggaggagttactttgctttcctgcaaacagtcacaggcagtgggatgagtgaagttatagcaaatcaagctgcacaaaatgtagagtgctggttactgttacccaaggagcagttgaatatccagatccaattgcacagaaaacatgttttatcatcctctcaaagttggtggaactctggagaggtaaagatggaccagtgggatttgctgattttgtttataagcacattgtcccctcatgtttcctagcacctttaaaacaaacctttgacctggcagatgcacaaacagtattggctttatctgagtgtgcagtgacactgaaaacaattcatctcaaatggggcccagaatgtgttcagtatcttcaacaagaatacctgccctccttgcaagtagctccagaaataattcaggagttttgtcaagcgcttcagcagcctgatgctaaagttttaaaaaattacttaaaggtgttcttccagagagcaaagccctattgactggatttccctgtgcctacttcatgatcaggaattccagttaatttataaagaagcgatttgtgtgtgccattcacactggtctttttcacattgttttgagcttattgcagtatatgttttgggatttttatgtgaaatggg

SEQ ID NO: 125497 - DNA, 1072 bp, Homo sapiens
tcttaaaaatatggctaaactggttgcatattagggtgtcttgttttttaaaggatttgctggatgtgtgatactttaaaaaatgccaccgatgctatatatactggtatatagaatgtcattctctgaggttttcttttcttttttatttttattctagatattaattttaattactttgcagcaacataatttagtaccaaatgttgaacaagtacccattataatggctaaactgtgaagtcaaagtcactattatttgtatctgaccagctatacaaaactcattaatttttctcttgacaaaatgtagtaaaaatcggaaacaataaagaagatactactcattaaaagtcatgtttactaatctaacaccataattccagtcttagaacctcccatgcagttagaaagggagtatgggaagaggtgagtatgttggaaatgtagggtagttctcaaattggggccccattttgcttgcgctaaagcaaaaaacacagagtctagcaaagaagaggagcactgaggctggagataaaaacaaaaacttttagttcagatggtaaaggaggccctcaagagcagtagaatcagcatatcccgaaggcagtgctggaggcagtctcatgaactagggagtttcttcttggcatccaagtcctttttaatttcttcaagttttttagccaggtttggtatgtcatagttctgagccagatatattccaaccacattgcccaatgtaaatccaagcaggaactggagcatgatgtcagtggggagggcgaggagggcgctaaggactgctgcagctccgcgggcccggccgagcctgcctccccatgagccaggggaggaaccctctctggggttttctagataccattttatttctcatcagaaattcacactctaagcccttatggcagacacgtgtttgttatgtgatgggaacatgaatctcactgagctggtacaggtgctgcacccattcctaacttgttacaccatccaacaagtaaccttttgatgaaaggatcttttattttaagtttcttcaggcagactc

SEQ ID NO: 125498 - DNA, 1068 bp, Homo sapiens
cactggcaaactatcaattcaaaaactcaagctttaccctagatcttcagagtcaaaatctacattttaacaagatctcctgttaattgatttgagaataagatgtgagaagtatgcttttaactcaccatgaagtttccatatgggaagtatagacaactcatcttatattatgtaaatatagcattaagaaatgtacatacctgtgttaatgtcctttatttaaactgtatcatcaagaaaagtattgcacatacactggtttcatgatcttatgccaccttttctcagagttaaaaatacattagagaatatctctgtgctggaaagtatcctattggataacttcagtaactcatgtaagtcagaaccagctctctttactctcattttacctgacgtcaaatcaggagttctttctatggtcacttggtaaatatgttttgttttccagggagtgttgacattcagggatgtggctgtagaattctccccagaagagtgggaatgcctggactctgctcagcagcgtttgtatagggatgtgatgttggagaactacagaaatctggtctccttgggtgagaataacttcaatatacaactcatattctacattaaatattttattctggttttttttttggaagttctgctttgcataagtgagttccagaatcctgcttcaaaaagaaaaaattgggtatctgttcaggtagaaaatataatctttaagatgtttcatcttaacattaatctttcccttttttgagctcatctgtgtagagtctaaattagtggtaatatcagaaatttaatgcataaaatattgttacccacacctaaaaatgcaattttcacaactgacttttgattcagtatcactgggtaatagagctaagaacccacaaatttaaaatactttctaaatattctaaagtttatgttagtaaacagtagattggaattaattttctagagtcttctataatgttctttcttctctactgagcatagtactagattagtaatcggattatcctagcaagagtcatgttatttttttct

SEQ ID NO: 125499 - DNA, 1055 bp, Homo sapiens
atttatacatctatgaaggaattatggcctgtggtattttgatatggcattttgctaatgtaccttgtgtaattttatatatttcatgtgtagaatacatttatatgagtccagaaagtggagtaacttgtgctttttgtgtctttcagttacgcgttcccatttcacccaagaccttcagccagagcagggcatcaaagattcactccaaaaagtaataccaagaacatatggaaaatgtggacatgagaaattacaatttaaaaaatgctgtaaaagtgtgggtgaatgtgaggtgcccaaagaggttatagtgaagttaaccaatgtttgtcaactacccaaaacaaaatatttcagactcataaatatgtcaaagtctttggtaaattttcaaattccaatagagataaaacaagatatactggaaagaaacatttcaaatgtaacaaatatggcaaatcattttgcatgctttcacacctaaatcaacatcaggtaattcatactagggagaagtcctacaaatgcaaagaatgtggcaaatcctttaactgctcctcaaaccatactacacataaaataattcatactggagagaaaccatatagatgtgaggaatgtggcaaagcctttagctggtccgcaaacctcactagacataagagaactcatactggagagaaaccctacacatgtgaagaatgtggccaagcctttaggcgctcctcagcacttactaaccacaagagaattcatactggagggagaccctacaaatgtgaagaatgtggcaaagcctttagcgtatcctcaaccctcactgaccacaagagaattcatactggagagaaaccctgcaggtgtgaggaatgtggcaaagcctttagctggtcctcaaaccttagtagacataagagaattcatactagagagaaaccctatgcctgtgaagaatgtggccaagcctttagcttatcctcgaaccttactagacataagagaattcatactggagagaaaccctacacatgtgaagaatgtggccaagactt

SEQ ID NO: 125500 - DNA, 1055 bp, Homo sapiens; identical to SEQ ID NO: 125499

SEQ ID NO: 125501 - DNA, 1051 bp, Homo sapiens
aataatattttatgacgtgaaattatatcaaattaattttcagggctcatatatacattttattggaacacaatcacacccattggcttgtatatcctctgtggctgctttcttgatacaatggcagagttgaatagttgcaacagtgtcttagtcccttttttttttttgtacttagctatttaattaggttcttaagacatttagaacaccaatttgtgaggataaattccattcgtcagggcaaacacagatcgcaggtagccctggagctgagaaatagctttgacttttggtaaaatttgtgagtccacagctttctgatcaatcttgcgctgctctgtaatctcatatttctctttttctgtgtcgaagatgttgccttcctggtgtctgggcttccgcagctgctgcttcttgaagtaagcatcagtaagatgttttgggatttttacattgctgatatcgattttggttgaggtggcaatgacaaatttctggtgtgttcctcgtagaggaactcaattgaggaccagaggtccagtcacaagtaacaagccactagccagctgcttcaggaaaaccaccctcttgcccctgtggcatccagtgaggatgatcagaatggtcccaggggtaatgctggcttgcagttttctcacatgctgactgaagggttttttgctgtggctcaacagctttcgaggtacatcttcggtaggatagtatctaggcattttgtgaagtttaaccacctgggtaccaccattcttgtcaccaccaactggttttgtaacagttgcaagaaccttctcctttttcttttcaatctttgatttagcggctgagtacttcctcttatacatggcctttctagaatacatggcagatcgggaatacctgccagttcctctgacaaggacagggttgtggctgcaatagggcttccccttcttgggctttttaactttaagattaccctcttgcaccttgccaccagcatcagccttcttggcttcgggtttcttctctttagtatctggcttctcaa

SEQ ID NO: 125502 - DNA, 1049 bp, Homo sapiens
ggtctccctgggtgaggataacttcaatacacaattcctaatatatttcttttctctcttttctaaaatgttttttggtaatttctgctttgcatgagtgaattttagctctctgatttgaagaaaatcttggggattcattggtgtagaacaaattcttcaagatgttttatcttgacctgaacttttccctttcctgagcttatgtatctttcactctaggttagtggcaattccaaaaatgtcatggcataaaatatcgttgcccacaccttagaattcagttgctgccaccaatttttgattcagtagtactgagtagtgaaattaaggacctacaaatttaaaatattttctaaatagttaaaaagttctgttatgaatcaatattaattttctagaattttctattatatcctctttactaagcataatactcgtttggtaattaaagaattcagcaagatttatgttacttttttttcttaataaaacaggtattgctgtctctaagccagacttgatcacctgtctggagcaaaataaagagccttggaatataaagagaaatgagatggtaaccaaacacccaggtaagtgagagtggatgaagcggatgacacagatgagaggtgcaaaagtcaaggaggaagccagtccttaaaatgtgatttggggagatgtgcttccatggaaagagtttctaagaagcccgagtcatttttttttcttttgctctcagatagggataccttctgccccatgcttttaaattctctaaggattctactttcgcttcagtaatctttcttcaagttcacagtgtgagccaaagttttctttatggcttatcagagactgactgctttaccattgttttgggggcatgctaatatctgcatatttttgagaaactctatgttaaaccattaaaaatttttttttgcatcatgtctaaaacgtgtgagaatagtagtttctgtttcattggtggttgtccgtttttctgcacatgccattctgttgtcattactatagacttgaaatat

SEQ ID NO: 125503 - DNA, 1278 bp, Homo sapiens
attctttctatggtcacttggtaaatatgttttgttttccagggagtgttgacattcagggatgtggctgtagaattctccccagaagagtgggaatgcctggactctgctcagcagcgtttgtatagggatgtgatgttagagaactatggaaacctggtctccttgggtgagaataacttcaatatacaactcatattctacattaaatattttattttcttctgatttttttggaggttctgctttgcataaatgagtttcagaatcctgcttcaaaaagaaaaaattgggtatctgttgaggtagaaaatataatcttcaagatgtttcatcttaacattaatctttcccttttttgagctcatctgtatacttcagtctaaattagtggtaatatcagaaatttagtagcataaaatattgttacccacacctaaaaatgcaattttcacagctgatttttgattcagtattactgggtaatagagctaagaaccacaaatttaaaatactttctaaatattctaaagtttctgttaggaaacagtatattaaaattaattttctagagtcttctataatgttctctcttctctactgagcatagtactagattagtaatcagattatcctagcaagagtcatgtttttttttctaataaaacaggtcttgctatctttaagccagacttgatgacctgtctggagcaaagaaaagagccttggaaagtgaagagacaggaggcagtagccaaacacccaggtaggtgggagtgaatgaagcagatgacacaaatgacggatcccaatgtcaaggaggaagccaaacctttaaacatgcttccagaagctctgctccagtggaaatggtttctgagaaaccttcatttctttctcttgctttaacatagggacattttttgtcccattcttgtgaattttccaagcactgtacttccccttcagtaatgtgtgtgtgtgtgttgtgtgtgtgttttgttttgttttttgtttttagtttacagcaataatgaaagtctttcatggcttgacagaaaatgtgtgatttgactgcttttccattgctttggggaaacagcaatatctgtatttttgagaaactatattaaaccatttttttaagttctgtttttggataatgtctaaatatttaagttttggtgatattacagtttggatcagaaatcccaggaataccacaaaaagatgtgtgcttcctgctttataattttctattctatggaaccttcaaac

SEQ ID NO: 125504 - DNA, 1498 bp, Homo sapiens
tagccagtcttcaaaccttactgaacataagaaaattcatactggagagaaaccctataaatgtgaggaatgtggcaaagcttttaaccgattctcaacccttactaaacataagagaattcatactggagaaaaaccctataaatgtgaagaatgtggaaaagcctttaatcaatcctatcaacttactagacataagatagttcatactaaagagaaactcaacaaatgtgaagaatttggcaaggcctttaaacagtcctcacaccgtactatacataaaattattcatactggagagaaaccctacaaatgtgaagaacatggcaaagtttttaaccagtcctcaaaccttactacacaaaagataattcatactggagagaacctctacaaatttgaagaacatggaaaagcttttaacctattctcaaacattactaaccataagataatttatactggagagaaaccccacaaatgtgaagaatgtggaaaagcttataaccgattctcaaacctaactatacataagagaattcatacgggagagaaaccttaccaatgtgcagaatgtggcaaagcctttaactgctcctcaacccttaatagacataagataattcatactggagagaaaccttacaaatgtaaagaatgtggcaaagcttttaacctatcctcaacccttactgcacataagaaaattcatactggagagaaaccctataaatgtgaagaatgtggcaaagcttttaaccaatcctcaaaccttactacacataagaaaattcatacttcagagaaaccctacaaatgtgaagaatgtggcaaatcctttaaccagttctcatctcttaatatacataagataattcatactggagagaaaccctacaaatgtggagattatggcagagctttcaacctatcctcaaatcttactacacataagaaaattcatactggagagaaaccctacaaatgtgagtatggcaaaacttaattgatcctacaagcttactacacataggaaaattcatactggagagaaactacaaatgtgaagaatgtgttaaagcctttaacaagtcttcaactttttctgcacacacgaggtattttatactggtgagaaaccttacaatgtaaagaatgtggcacagcttttaactaatcttcaaaccttactgaaagttgagaaaattcgtactggagagaatcctacaaatgtgaaaaatgtggcaaatcctttaactgatcctcaacttttactaaacataaggtaattcatactggagaaaagccatacaaatgagaagaatgtggcaatgcctttaatcagtcctcacacctttctacacataagataatttatactggagaggaactctatagttgtgaagaatgtggcaaagcttttaaccaatcctcataccttactatacagaaattcatactggagagaaagcctacaattgtgaagaatgtggcaaag

SEQ ID NO: 125505 - DNA, 6286 bp, Homo sapiens
caaaaacattgacattattggtgagctttttagaaatttagaatatcagactgttccagatcttctgaaaaaataatctgcattaacgagatctgaagtttatcatacacattaaaacttgcgaggtaccttttaactcaacatgtctttttcatctcaaaaatacacacaactcattctgtatgatgcagatatagcatttaaaaatagacatgttggcgtttatgccctaatttatactttattatccagaaaagtaccatatatacacagatgttgtggatcttcttataccactttcttttctcagggttagataatacattagaaaatatttctgtgttaaaaattcttttatggatagtttcattcactcctataagtcagaaccagttttctttactgttttattttaccttgaaatttaaaattatgcccatggccacttggtaaatgtatgtgattttgtgtatgtgtgtgtttttgtgtttttcagggaccattgacatttatggatgtggccatagaattctctttggaggagtggcaatgcctggacactgcacagcagaatttatataggcatgtgatgtgagagaactacagaaacctggttttcttgggtgaaggtaacttcaatacacattttctaatataccctaaaggttttaattctcttttttgtagaatgtttttggtgatttatgctttgcataaattgagtttcagatccctgttttcaaaaaaatcttttagatttgtcattgtagaaaatagtttattcaagatgtttcatctttaccataactttccacattcctgagatgatctttatcattcagtcttgattagtggtaattttagaaatttattggcataaaatattgttgcccacaccttaaaatctaactcccaacaacaattgttttgattcagtagtaccaggtagtgaaattaagaaactacaaatttaaaatattttctaaatctttagaaatttttgttataaattagcatttggggattaatttactagaatattctattgcattctctttactgagcacattaccaagttggtaattggagaatatgtgcaagatttatgttatttattttcaataaaacaggtattgctgtctctaagccagacctgattacctgtctggagcaaggaaaagagccctggaatatgaagagacatgagatggtagctaaacatttaggtaagtgagagtgaatacacagatggcacagagaagaggtcaaaggccaaggagaaggccacagcttaaaatgtgatttggtaagctgtgttccaaaggaaatagtttctggaaagcccgagtttttttttatttttctctcacatagaacatattttgtattgtttttcaattctctaaggattcctctttccctttagtgatctgtcttcaatttcacagtgaaagccaacatcctcttcatgggatataaaagactgcacaatctgactggtttttttttgttgttgttttgggggacacacaaatatgcataattttgagaaactctatgttaaacagttttttaaattctctttttgcatcaagtctgaaatgtgtgagtagtgatttctgttccattggtttttttgttgttgtttatttttctgtatattccattctgtttttactactatagctttgaaatatagttacatatgtaaggcatatgcagtgccaatataccttttcaggatttggctattttggattggctttttctttttatttggcaggacagatttgctgctggtattattctcacttgacagctattttcttcaggacttggacaatgtcacacagttagttcccttctggcctgcaaattttcttgagaaattcactcattacctcataagactatgcttataaataacatatcacttttatcttgcaactcacaatattctcttgtctgtgacttttaaaattgtgcttatatatgttcttgttgtaaatatctttgtgtgtattctagtttctttgttaacctttttaatttttacatcagtttttcttataatttttcagttccttttttatattttttacctccacaatatctgttttttgatatttttaatatttttgttatcccaatttttatgatttttaatagttgtctgtgtttctatttcattcatggagtattattcaatttatgttaactttttaaaattaattttttaatggttgctttctgaaaattttataatatctgatagagctatgttgccctaaaattttgtatgcattgtaatctttaattgaaatttgaacattaaaaacaagctacctgtcacagtgtctataatgtagctttgtcctggcaaagtctgaaaccatttgtcttagctagagatcctgagagtctttcaaacatgttcttaggatgtgtcttgtctgaaatgttctagttgttttttagttaaaagactttattcatgtttcttcttaatagtcatcacttgccacaactgttccctgtctgtagtacagtctctttcctgctgtaacatttacctttgatctcagcagactcaaaatgtcattccaaagtataccactgttaatttcagcactttatgtcattggagacagaaaccagtgtccgccaaagcacctaataaagccagaaataaagatgtgggtgtgttatttttcttgtctgttgaaaaagaaagcaaaagttggtaatgtacttctaaagacactatgttatactgaggagcagaaagagctgtgttgggtaaatgtaaccaacttttctcttccttccatgtggcttttggaattgtgataacctggaacactgcacacacgtaactcatttataaattttctataaatgcattttggtcaatatgctcttgttacatttatatgtctatgaaggaattagaacctgtggtattttgctatgccatcttgcttatgtagtttctgtaactttatgggttagatttgtaaagtatattcatctgagtcgagcaagtgaagtagtttgttacttttatttctttcagttatgttttattattttgcccaacacctttggccagagcagaacataagagattctttccagaaagtgaccctaagaagatatagaaaatgtggatatgagaatttacagttaagaaaaggctgtaaaagtgtggttgagtgtaaacagcacaaaggagattatagtggacttaaccaatgtttgaaaactaccttgagcaaaatatttcaatgtaataaatatgtagaagttttccataaaatttcaaattcaaatagacacaagatgagacatactgaaaataaacattttaaatgtaaagaatgtcgcaaaacattttgcatgctttcacacctaactcaacataaaagaatccaaactagagtgaatttctacaaatgtgaagcatatggaagagcctttaactggtcctcaacccttaataaacataagagaattcatactggagaaaaaccttacaaatgtaaagaatgtggcaaagcctttaaccagacctcacaccttattagacataagagaattcatactgaagagaaaccctacaaatgtgaagaatgtggcaaagcctttaaccagtcatcgacccttactacacataatataattcatactggggaaattccctacaaatgtgagaaatgtgttagagcttttaaccaagcctcaaagcttactgaacataagttaattcataccggagagaaacgttatgaatgtgaagaatgcggcaaagcttttaaccgatcctcaaaacttactgaacataagtacattcatactggagagaagctgtacaaatgtgaagaatgtggtaaagcctttaaccagtcctcaacccttactacacataagagaattcatagtggagagaagccctacaaatgtgaagaatgtggcaaagcttttaaacaattttcaaatcttactgaccataaaaaaattcatactggagagaaaccctacaaatgtgaggaatgtggcaaagcttttaaccaactctcaaaccttactagacataaggtaattcatactggagagaaaccctacaaatgtggagaatgtggcaaagcctttaaccagtcctcagcccttaatacacataagataatccatactggagagaatccccacaaatgtagagaatctggcaaagttttccacctatcctcaaaacttagtacatgtaagaaaattcatactggagagaaactctacaaatgtgaagaatgtggcaaagcctttaaccgatcttcaacccttattggacataagagaattcatactggagagaaaccctacaaatgtgaagaatgtggcaaagcttttaaccaatcttcaacacttactacacataagataattcatactgaagagaaacagtacaaatgtgatgaatgtggcaaagcttctacctgatcctcaaaactcattgaacacaagaaaattcatactggagagaaaccttacaagtgtgaagaatgtggcaaaacttctaaccatttctcaacccttactaaacataagatgattcatactggagagaagttacacaaatgtgatgaatgtgacaaagcttttaaccaatcttcaaccctttctacacataaaagaattcatactggagagaaaccctacaaatgtgaagaatgtggcagagcttttaattgatcatcaaaccttattaaacataagaaaattcatattggagagaaaccctacaaatgtgaagaatgtggaaaagcttttaaccagttctcaactcttactacacataaaataattcatactggagagaaaccatataaatgtgaagaatgtggcaaagctttcaacctatacgtaaaccttactacacataagaaaattcatactggagagaaaccctacaagtgtgaagaatgtggcaaagcttttagccaagtgtcaactcttactatacataaaagaattcatactggagagaaaccctacaagtgtgaagaatgtggcaaagcttttaaccaagtgtcaactcttactatacataaaagaattcatactggagagaaaccttacaaatgtgaggaatgtggcaaaactttcagtcgatgctcaaaacttactacacataagaaaattcatacaggagagaaaccttacaaatgtgaaaaatgtgctaaagcttttagccagtcttcaaccctttctacatataagataattcacactggagagaaatgctacaaatgtgaagaatgtggcaaagtttttaaccgatcttcaaaccttacagaccataaaaaaattcatacaggagagaaatcctacaaatgtgaagaatgtgacaaggcctttaacctgtcctcaacgcttactaaacataaggtaattcatactggagagaaactgtacaaatgtaaagaatgtggtaaagcttttaaacagttctcacaccttgctatacataatataattcatactggagagaaactctacaaatgtgaagaatgtggcaaagcttttaacttatcctcaaaccttactgcacataagaaaaatcgtactggagagaaaccctacaaatgtgaagaatgtggcaaagctaacctatcatcaacccttactccacataagacaattcatatttgagagaaaccctgcaaatgtgaagaatgtggcaatgcttgtaactaaatctcaaactttactaaacataagaaaattaatactggaaactttacaaacctgaaagatgtgacaatgattttgacaacaccttcaaacttttctaaacataaaataaatcatactggtgagaaatcttaaaaatatgaagaatggtacaaagcctttaaatggttgtcacacttgattgtaggtaagataatttatactggaggaaactcccagaagtgtgaagaatgtggcaaaacttttaatttttcacaccttatagcacaggaaagcacttcagaaaaattgtacaaatataaatgtggaaaagccattaatatctgcttacatcttactcaacattagagagttagtgcttaataaaagcattataaaagcaattagtgtaaaatcagaaaatgaaagttttttttttttttttagatggagtcttgctctgtcacccaggctggagtgcagtggtgtgatcttggctcactgcaacctctgcctcccaggttcaagcaattctcctgccttagcctccagagtagct

SEQ ID NO: 125506 - DNA, 1004 bp, Homo sapiens
atgtggagtaagggttgatgataggttagctttgccacattcttcacatttgtagggtttctctccagtacgatttttcttatgtgcagtaaggtttgaggataagttaaaagctttgccacattcttcacatttgtagagtttctctccagtatgaattatattatgtatagcaaggtgtgagaactgtttaaaagctttaccacattctttacatttgtacagtttctctccagtatgaattaccttatgtttagtaagcgttgaggacaggttaaaggccttgtcacattcttcacatttgtaggatttctctcctgtatgaatttttttatggtctgtaaggtttgaagatcggttaaaaactttgccacattcttcacatttgtagcatttctctccagtgtgaattatcttatatgtagaaagggttgaagactggctaaaagctttagcacatttttcacatttgtaaggtttctctcctgtatgaattttcttatgtgtagtaagttttgagcatcgactgaaagttttgccacattcctcacatttgtaaggtttctctccagtatgaattcttttatgtatagtaagagttgacacttggttaaaagctttgccacattcttcacacttgtagggtttctctccagtatgaattcttttatgtatagtaagagttgacacttggctaaaagctttgccacattcttcacacttgtagggtttctctccagtatgaattttcttatgtgtagtaaggtttacgtataggttgaaagctttgccacattcttcacatttatatggtttctctccagtatgaattattttatgtgtagtaagagttgagaactggttaaaagcttttccacattcttcacatttgtagggtttctctccaatatgaattttcttatgtttaataaggtttgatgatcaattaaaagctctgccacattcttcacatttgtagggtttctctccagtatgaattcttt

SEQ ID NO: 125507 - DNA, 1359 bp, Homo sapiens
gaccagatactctgtctcatttgctcttaaaccaaaatcctttcgctttttagaggggaaataattatcatagggccaaatggaacattttaaaaatgcatttaaaatgtaggtatcagtttacaggggaaaatgcatagatgtgacaaaaagctcacatttgttgttggttattcagaacaaagttaataggctgattagactctcagatacgctttgagaaccattgagtgtcttttatgcaaacattgttatgttatttccactttcagaaaggacttttaaacttacaagtaccttccacccaaagttagttgaatgaataaatatttaaggaaaacattatgcagcagcacatttcaagtattttaagaaacaagaagaactaaaaatgacttttgatcctagtttaatatggaatttaagcagaattattaccaattttagatttttttttttttgaaacaagtagtctataataaatggaccttttaatattggggcatggaaagagtacttactgtatgcttaagttcttttttttttttttttttgagacggagtcttgttcttgtcacccaggctggagtgcaatagcatgatctcggctcactgcaacccccgcctcccaggttcaagtgattctcctgcctcagcctcccgagtagctgggattgcagacatccgccatcatgcctggctaatttttgtatttttagtagagatggggtttcaccatattggtcaggctggtctcgaactcctgacctcaggtaatccacccacctctgcctcccaaagtgctgggaatcaagcatgagccaccgcgcctggcctgcttaagtgcttaaaattgacttggccgggcacagtggctcacgcctgtaatcccagcactttgggaggccgaggtgggtggatcatgaggtcaggagttcaagaccatcctgaccagcatggtgaaaccctgtctctaccaaaaatacaaaaattagctgggtgtggtggcatgtgcctatagtcccagctacttgggaggctgaggcaggagaattgcttgaacctgggaggcagaggttgcagtgagccaagaccacaccatggcaccccagcctgggcaacagaatgagactccatctcaaataaataaataaataaataaataaaaataatttaaaaaattgacttttctttaaaaaggtgtatttagcatacactctaaatattctcatagttatatcctgctagagctgcgtgtttgtgcataaaacatcaagtagtatattaaaaatatgtataagtacatgtaagactaaaggtaactggatctctttatagttttaaatgtgaatttaatat

SEQ ID NO: 125508 - DNA, 1102 bp, Homo sapiens
aaagccatttatatctgctcacatgtaaaaacatcagttcatacttaataaaatgcaattaccgtcaaatctttcagaaaatataagcctttaatacgaggaagagtattcttaagatgaacattacaaatagaaagagggttgtagtacctttagttttatgatagatcttattgtacacattttgtaccagaggaaaaccctaaagcattagttgctcaaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagattttttggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgaggtacatgttcagactaacattcttttgcagtatagtgagaaaaaaacattttaaaattaattatcattttgttgattgtgcttttatgtaataaaatgcagtactttaaaacatttagattgtgtgtgaacttaattttgtaattaaacattttttttagcatgctaagactagtgtattcgatgaagtgttattatgccactaactttaaccttatcctaccttactcaagggtgtggggtaaaagatggtaa

SEQ ID NO: 125509 - DNA, 1060 bp, Homo sapiens
ttatgacacgtttaacacacacatttaagttacgtgtcaggtggcacagacgtgtcacacgtgtcactcacatgtcggtgaagtgtctcacatgtcacacatgtgtcagtcatatgtcacacgtcagtcacttgttagtcacgtgtcatacatgcatcacccatgtattattcacgtgtctgtcacatgttggtaatgcgtgttacacaagactgtcatgtgactcgcatgtgacatgactgacatgtgtgatgtgcgtgacacatgggtgatacgtgactgacatatgtgtgaatgggcttgacaagtgacagacacgtgactggtatgtgactgacgtgtgtgaatcgtgacagacgtgacaaacacgtgactgacacgtgatagatgtgtgtgacatgtgacttagacgtgtgacacatgactgatacgtgactgacacctgtgagacaagtgactgacacatgatcaacacataaatgatatgtgacacatgactgacacgtgactgagacctgtgtgacacgtgacacttgtgtgacacctgataggcacatgtgtgaaacctgattgacgcgtgtgacacctgtgtgacacgtgactgaaatgtgtgtgacacctgacatgacttacaggtgtgtgacacctctgtgacatgtgaccaatatgtgtgtgacacatgatggacatgtgtgtgacacgtgtttgactcgaccaaattttttcacacctggctgacactgtgcgaaacctgacggacatgaatgagacatgtgtgtgacatatgactgacacgtgtgtgacatgtgaccaacacgtgggtcacaagtaattgacgtggtggacacgtgtataacgtgacatgtgactgacaggtttgtgatgtgaccaacacgtgactgacatgtgtgacatgtgattgatgtgacacgtggctgacatgtgtgacacgtgactgacacatgactgacgcgtcttttaaaagtaactgacgtaatagacatatgacttacacatgtgacacgtgaaaaattaacacgactgacacgtttgcgacatg

SEQ ID NO: 125510 - DNA, 2656 bp, Homo sapiens
gaaaccccgtctctactaaaaatacaaaaaaaattagccagacatggtggcacacgcctgtagtcccagctacttgagaggggctgaggcaggagaatcacttgaacccgggaggtggaggttgtggtgagctgaggtcgtgccactgcactccagactgggtgacagagtgagactctgtctcaaaaaaaaagaaaaattaaattcttgtctaggtaaggcattcgctgcttcggatttgaaagataacaaagcatgtacagtgaaaagtctccttcatatcccttccaccagacagttctcccgctcagtagaccgctgtgaaacttttcagagccgtttgacacatagacaaacatccacgtgaccatatgattcctccctttttttaacatggaagtatcacgtatgcatccttattgatagcctgctttttgcttggcattcgttccattgctcccatactttaaatgcttatgttcatatttagtgaaatgttaataactgctagtacgtaaaagagaatttgttctagtagttttgactaaccaagataaatttcagaaataaaattcttaacattatcattgtttcttggtatggaaatttcagaagcaggttgaactgaaaagagtccaagaggaatagagaaatatcacaaggaagtgaatctggactgtagtagagataaatgttaatacttacagataatgcttactatgtgctaggcagtgttctaaatgttttgcatacattattgaagtctctcaagagtcccatgaggcaggtagcttttatcaccattttacacatgagaaaactgagcaacgcagactaacacttgatccaggtagtacagtggcagaggcctgattctaacccaggcagtctggctcaagagtccaagctctttaccactactctttcgtcttcctttcttcctttccctcccaccctccttcttcctttcctttcttttctctctttcttttccttccttcttttctttctttttccttccttccttccttttctttatttttccttcttccttcctccttcgttccttgcttccttctttccttttctttttctttcctttcctttttttttctttcctttcttttctttcttctttaactttttgagacattgtctcactctgtctccccaggctgagtgcagtggtgcagtcatggctcactgcagcctcaacctccctgggtcaagtgatcctccaacctcagcttcctgagtagctgggtctacagttgcacaccccaccatgcctagctaattttttctatttttcatagtgacgaggtctcactttgttgcctgagttggtctcaaactcctggcctcaagcagtcttcccacttggcctcccaaagtgctgagattacaggtgtgagccaccacgcccagccttttaccactactttaaattccatttagatctaatattgatagagtgataaccatatcaaccagattttttaaatatgcaaacaatggtgccagtttctgtatctatgtgacaaaaatatatagagtttgtggtatcacttttacctgtttagagcactctttggaaaggcagggaaattactgtgaaggtattggtattccagaagtaagttcctggagtgtttgccttctaaggtgtgaggacgtggtttgtcacacccagttaactaacagatagacggtgtagtgagctgtccggaagacttagcaggttagcctagggaggaaggagaaaggggttctgggcacatggagggagggggagggaaaagagtttgtttgaatctgtcctagattggggtagctttttcggagggaggccttgtcgtgtggacctgctgcatataaagacaggagaattggacctgaggtgtggtgctagctaaagcgccacacagatctgggaatttaagaggagttcatttcctcaatcattaggaagaacttgaaagggtagcaaactgtggtcatttgagaagaacagcaagtggtcatatttgaatgtaacatattcaactgggttgggaaagaaccagaatctagatcttgcccatagcaagtgcaaaaccaggcgttcttataaaccatgtactcttgtaaacactgataagacatagcactgagtcctgagcttttcttctataaagttattgtacaggttgaggatccctaatccgaaaatccaaaatctgaaatgcccctgtgagcatttccgttgagtgtcattggcactcaaagttttggattttggaccatttcagattttgaactttcagatttgggatgctcaaccggtatataatgcacatattcccaaatctgaaaaaatcccaaatccaaagcatttcagctccaaagtgtttcagataaggaatattcaacctgtactacattgtactaggcttgtattagattcccagttttcaaaatttgtatctcagaatccctgttctctgtcaatgaaacagggatttcatacacctttgattcacattttaatgttttaagtttaaaatattataaatgtttatacacagtcaaatgaatctcatgctaaattttaatatattagagacaactgatttgtctgccaggttatctcaagagagttaatactgagtgaaaa

SEQ ID NO: 125511 - DNA, 1021 bp, Homo sapiens
gaggttgcagtgagctgagatcatgccactgcactccagcctgagcgacagagcaaactctgtctcaagaaaataaaataaaatagactgggtgtagtggctcacgcctgtaaccccagcactttgggagactgaggcgggtggatcacctgaggtcgggagttggagaccagcctgaccaacatggtgaaaccccatctctactaaaaatacaaaattagtcgggcatggtggtgcatgcctgtaatctcagctactcgggaggctgagacaggagagttgcttgaacccaggaggcagaggttgcagtgagccaagatcacgccattgcactccagcctgggcaacaagagtgaaactccgtctgaaaaataaaataaaataaaataaaaagtaaaaaagcaaaaaaaaaaaaaaagtgcatttagaatatttgagagaaaataagcaaaaggaagaaaatgtaaattatctataatgcttacacccaggacaataatccttggaatagagtgtctcactttgtgtatagaaatgaaacttttaaaatgccattttattttttaattaaaattttttctttccttttttttcctcctcagagttagaaaggataaaaatgttattgattagtaagactgtagctttatgttgatattttgaaattttaggctagtgcttgtttgttcatgtaacatataagcacattcagtactattagaactgttgcattatgcaataacatgactgcctaatgcatatatcaggattagtacatattgtaaagtttttattttttaccaaaatgtttacgactaccaagtattcattccttaacactattacataattaatttagaaatgttttacttttaaaacttctggacaggtgtaattaaatccttagatagcgttaatgtactatttaaaaaacacacacaaaacattatcattggcaaaacatgctttatcatctattcatctttgtgaatccggtttttcttgataccatgccatcaaa

SEQ ID NO: 125512 - DNA, 1889 bp, Homo sapiens
agtttagactttatcacttagtgatagtgggtttaaaaataaaaattgtttttgttttagttaacattttattattattcaccagccattaaggaacacattaattactatttattctttctcgttgaatctgtgcaattttctgagaagtaggtaaacccgcccctgtgtgtgtatgtgtctgtgtgtgtgagatgcaatttgtgtggtgctagaaattgagaaattacagtaatttcttattattctggtcagagatccctggaatatcaaaattgtctgcaatctatagtcactgttttcaagtctatagggtccctgggagaaatacttatattaaatatttgcactgacaaatggacaacaaaaggactctacgttttattcttaactaggacttgggcaccaaactccagggtaaaagactggaatgaacccagctggttcaggtggaaatgttgtttttttggaatctagttaagcttaaattgtttcaaactaaagcaggccatgagatgaacccttttcatcttcccagttctcaaacacactgagatcttccccacatttcactcctttctgtcagttgctcgaggtcatgtaaccagagtgagcccatttgccctggctgactgctgatctggccttggacacctgccttggcctcttctaccgaagctgcaggtttggccctgtctctcccttactgcggtggtgaggggggtgcaggggggagttgacaaccttcttaaccacttcagtcacatgaaagaagcagacaagtgagcttgcatctgtgtgctgaccttttaacagtgatgctgcccagtacactcagacccaatcagtgttctcacatctgccttcctccttcctgagaattaggagaaagaagagctcagccttgatttcttacctcaaaagacagcacaaacaaacttgcagccattctcagaagtattggttttctgttgggttgttgcttgtgtcaagtcagctagaaagaggtggagtaaaaactggcctgctgagtagtacccataatccatgtcctccccaaccccccaactacacatcaacctgcagggagtgacttcttactcttgagacgctctttcctcttgcttaatggttcgtgacagttcttcattttcctcctaccactctcaatttttttttttttttggctggcttattctcctgtatctggccattaaatgttgatgtcccaccaagcagccttaggcccttctgtcattcttctttcccttaacagtcacagccatgtccatggtctcactcatgggtgaatccaacatttttatctctaccccaacctctgctgttgagtacttcatttgctaatatctaattgcctactagacatctctacttggatgtcccaaaactaataaattcagtatgtccaagatttatttcatactcttcctccaaaaatgctgttggctatctcagtgaaaggcatcaccacctaagcagttgtgcaagtcagaaacctgggacttgtccatgattctcttcctcccctcccccaccaaattcaatcaatcaccaggccccattgattgtttttcacgttcttttattgtgaactataacttacagaaaaatcattgagcggtgcatctttttgttgttgtaatcaccaaagtataaccctgtaaccaacattccggtcattaaatagaccaatgccagcactccagaaagccctcccttaactttcccctagtcaactatatgcgtcccccttctcaaaagttacctctgtcctgacttttatgagaatcattttcttacttttctaagatcgcacctaaacttagtagtttagttttgctatttgaactttatataaatggaaccat

SEQ ID NO: 125513 - DNA, 1221 bp, Homo sapiens
catttttaagggtactgctcagtagtgtaaagtatattcatattgttgtacaaccagtctccaaaactttttcctagccattaaacaagtacttaatacttcccctacccttggcagtcaccattctactttctgtttctatgaatttgactactctagatagctcatgcaagtggaatcatatagtgtttgcccttttgtaactggtttgtttcacttagcacaatgttctcaaggtccatactattttgtgacttttgaatactttactttgtttattatccatttttaaaagagcactaaagtaaaaagacatgaccttattcagagctgattaattacatggtaaaaagttgaaggctggcgtgtcttattcatttcaaccaatattaaatgccagtttgggcagcaaaacaactttctgccaaagtgccatttgaagcctggtttatgacatgtttctccttttgtcatctttgggtgccacccaaaatgcaggctcaaggccgcagcctcttgactctgttcaacagtttccccccttggcttattgtccaacattggcctactcttccaaatccacctctttatcccaggaacaagctgcttctatgccaagggcatggcttcctctttgcagattgtctcatatctctgacctggaaaaaagggggtttttcattctgctagctttttagtgctgctttgagatcattattctagagccctctgcagtaatgttttttctcatggattgaaattcattgtttccagtaggatttttgactagacgtggaaacagaaggacaaattgaaatgactctgaagcttatgggaggactgagtatcattaactggcacagagggagaaaggcaggctctaggtggaaggtatgtgacttgcttttgaaaacagtggtgtgagattctggcctgtgaaaacagctggagttacgagatagaaatggggacttaaaaaatagcttcataccagacgtggtggctcacgcctgtaatcccagcactttgggaggctgagacaggcggatcatcttaggtcaggagtttgagaccagcctgaccaacatggagaaaccccgtctctactaaaaatacaaaaattagccaggcgtggtggtacatgcctgtaatcccagctactcgggaggctgaggcaggagaatcgcttgaactcaggcggcagaggttgcagtgacccaa

SEQ ID NO: 125514 - DNA, 1295 bp, Homo sapiens
gcttatctcactctccagtttgaaagctactaaacgtctttcatagcaattagaataaaattcaaactcttcggcatggcctacacacaaggccctaaataatgtaaatgattggactcgctcccagttctcctgtcactctcctcaatcaccatgccccagcctcagtggccttccttggcacacccacagctcattcctacctcaaggcctttgacttgccattgctcatgagaccgattgcttaccatcactcaggatctcattcaaaacttcattcctggaaaaggtccttcccgaccatcaagctagaggagcttgctgcaccccttctctgcccacagctatggatctccaagtgtgggcttcagaccagaagcgtcagtgttgcctgcaagcatttcattttgtgttgtgttttctctggaaatgcagagtcttaggccccaccacagacccactgaaggaacagctacattttaaccagaccccagagtgattgtgctttaaaaatttcagaagcactgatctagagtttccccttctaattttcctgtgtatctgttacaaggtgtgtccattgctgcaggtaatctggcatttgtttacctgtttattatttctcttccctaaatagaatttaaggtccacaagggcagcacctcgtctggctcgttcacttctggatccccggcacgtagcgtcagtgcacacagtacatgctcaataagtatttagatgagtgaaagaataaatgaatataatggaaattattttatgttctttgaaatgtataactgaaggctgggtgtcatagctcagcctgtaatcccagcactttgggaggccaaggtgggaggattgcttgagtccagtacttcaagaccagccttggcacatggcaaagctgcaactctataaaaaaataccaaaaaaaaaatatatatatatagctgggtgtggtagtctcagctacttcgggaggctgaggcaggagaatcacttgaacctcggaggtcaaggctgcagtgagtcatgattgcaactgcactgtagcctgggcaacagaggaacatcctgtctcaaaaaaacaaaacaaaacaaaacaaacaaaaaggattgcataattctacaataaaaatcttcatggctttcacttgtttgtaaaatcggggtgatttttctctcccaacatcatcgttatacaggggtttcattctatatcttgggcatcaagtgctattaaactattgtggcctgtgaagaattacttatttatccttgctttggggcag

SEQ ID NO: 125515 - DNA, 9055 bp, Homo sapiens
ctgccttagtctcccaactagctgggattacaggtgcacaccaccatgtccggctaattttttgtattttgagtagagacgggtttcaccatgctggccagcctggtctcgaactcttgaccttgtgatctgctcgcctcggcctcccaaggtggtgggattataggtgtgatccacgggcccggccctacatttaaaaaatacattcccagtatatttcttaatgcatatcctggtgaaatttgtgaagaaacaacttttcaatctatattctttgagtgaataaatagcacaacttacattctatggttttcaactgggggcagtcgtgtcccagcggatgtttggcaatggctgtgactgcatttttggtagtcacacctgggatggaggagtactggcagcatctagttgggggagctctggggtactgttagttatgtaatgcacagaacaccccacagcacaaagaattatctagcccaaaatgtcagtagtccactgttaagagacagtggacaactgtctccttctgcatagagaagtctccttctgcaaatactaatgccattggaaaacgaatactttgccctaccttctggagaagagaatatatagaaattggcaactgagagattcagatgggtatactggcacctttagatatgttcattttagatgattatttctaatcagaaatctagtgactggcctccctctctttggggcaaatcactctctcaacacaggacatttaagacatttcacaacttagttgattttagaattggataacgttctcaaataatgatacattttttaaaatagggaaattcaaatatagggttactggttttccttattttacagatggggtcgaggatttggtcttttgggttccatttttggaaaggatggtgtattaaaccagccaaacagtgtctttggacttatattttatatactacagttattacttggtaagtatttatcaatacaaaaataagtttgttatattccgtttagtactttgtgtctttgccctgaagtgtcttgatgttaaagcatgtgttatttatagaaccactagcgtgtacaacatttttgtgttatgaaaacttgattcactgagatttttattatattattgttgaatttatgtcaattgctgtttaatcatggagagcagtatctcatgatgtccagaaaaaccagtcccattccaggaaattatcactcccatcttccctgttaacgtttttccttattttatagactcagtggccttgaaaaatatcatatattaaggggacattaacaagaaaccatattcataatcccattacctttacatatccactatttccacagtcttctgcttttaaaaataatttttgggctgggtgcggtggtgcacacctgtaatcccagcacttagggaggccaagataggcagatcatctgaggttgggagttcgagaccagcctggccaacataaagaaaccctgtctctactaaaaatacaaaattagctgggcgaggtggtgcatgcctgtaatcccagctactcatgaggctgaggctggagagtcacttgaacccgggagacggaggttgtagtgagctgagatcgcgccattgcactccagcctgggcaacaagagcgaaactccgtctcacaaaaaagaaataaataataataataataataacttggggccaggtgcagtggctcacacctgtaatcctaggactttgggaggccgagaagggcagattacttgagcccaggagcaacatggtgagactctgtctctgtagaaaatacaaaaattagccaggtgtggtggcacacacctgtagtcccagctacttgaaaggctgaggtgagagaatcacttgagtccaagagatggaggttgcagggagccgagatcacaccactgcactccagcctgggggtcagagcaagacgctgtctcaaaaactaataatttaatgtgaactgtgtttcaacatagtgtcgtttatcctaagtgttattgttaacatctaggtttcactccttttacttccaaataatgctgcagtgatcaactttgtttaaagacctcctgctccttccttcctttgaattatctccacaaaataaatttccaagcatagtatcaaaaaacacagatattttcaattttaatcagtgttaccaatttgcttttccctcagttctttggtttccctgaagctccagcggtctttatttttaagacatgctttgtaaaatttcttttttttttaattgtaacgataatcttcacctggaaaaattgctaatagttacacattagtacctattactttaatttttactctttttaatttccttttattgcccatttagcatttagttattggatcccgatactagtacatttttatatgtgttacaaacattttatgcattctttatccttttttgttagtgttatgaatttgtattgtattaagtttttatacttttagagttaaatccatctgttgatgcctttgcattttatttttcttcttttttgtagatcttgttgcataccaatgcttttgtattttaattgttaatattccattacctgtcagctcttctgatttggttcattaaaaatacatgtaactcttctatctgaaattgatttgttatgaggcaaattataaatctaaatcatcctcagtagttctgtcgagtttgcccagttccatatctatgtatttatcttgcagaagtagaaagatgtgtgcacaaggatattcatagcagtacagtgtaaaatagcaaaaaaaaaatggaggtaggttacaaatagataatggttgaataaattagaaaatactatgaaatactatgtagccattaaaggaaaaaggagatctatgtttatatcctagaaagataaagacactatttagtgaaaaaagcaaattttggtataataggtataggataaacgtgtttgtatacatgcatgtaaatgcatagaaaagggtcgggtggttggggaggagggagaaatttcactaggtattctgcatgtttccattttgctggatttctagagaagaatatgaagtataagcccagatgcaagatgttttcctttaaaggcaaagaacctaagaacagcctttgactagattaactcttgaagatagaggtgtgacagccaaatttttgttttaccattaatttaatgccatggtatatacatattttaaatcatatttatcacatgtgttttttcattcgcattttttgactcgcatttagatgcttcacgtgccttttaatgttggtgtcttcatgggaggcacatttgaactaacctagcaatttccagagcacagcatctgtactcccttctaacctgtttgagacacagcatttttaatttaattttttcataggtaatccattcacgtggttcaaaagtttttaaaaaggaccgggcacagtggctcatgccaataattccagcattttgggaggccaagatgggtggatcacgaggtcaggagttcaagaccagcctggccaacatggtgaaaccccatctctactaaaaatacaaaaattagccaggtgtggtgccgcacacctgtaatcccagctacttgggaggctgaggcaggagaattgtttgaacctgggagacagaggttgcagtgagctaatgtcgcaccattgcactccagcctcggtgacagagcgagactccttcaggaaaaaaaaaatatatatatatatacatatataaaatgttacacaaagaaaaatctatcccaccccttccctttatgcctggtttccagtgctcctcagccccgactggtagcttgttattgtctctttatgcatatacgagaaagtacaaatacacaatcttaattttcctcctttttaaaatataaaaggcagatgctatacccactgttctgcagcttgcattttctttttttgcctgatgaatatatcatggtgatttttccatatcagtatattaaatgtcttcattcttttctacagctgcagaataatccattgcataattgtaccatcatttatttagagttacagcacattttaaattccactgggaatttgaccctgagccaaacgtacctagctgcattacagtagcatttaatggatatctggtatttatacactattctaagtgctttaatcctgcattatctcagctcatttaattgcccagcagtcttaagaagtaggcatgattgttatcccaattttacagttgagaaaagaaaggcatagaggaagaaataagttgcccgtatcattctgaagttaactttcttaggtaaaattgtgaccacattaatttcgaaatgttagttgtttagcataggtgaagtcagcaaactttttcagtaaagggcctggcagaaaataggctttgccagttgccgcagccactcaactcttctagtatgaaagcagtcacagacattacgtaatgaatgacattacataaatgaatgagcatggctgggtgccaataaaactttatttacaaaagcaggtagctggccagatttgctagtccctgcaacaagtaattcagcagcaccttagtcttgaagtgccctatgaaagcatctaggcccgtggctgtgcggcagccggcccacaggcgtcttcttgttgcatttttttttttgccaacagggcccaggatttcagctctttaactgacttctttatacctgctcccacctgttattttgttcctgtttctgttatccttatccatgagtcattgggtaggagggtagtttaacatgctctgccttctctgtccttgaaaataaatgcacatattctctatactgttgcctataagaaattaaaaacaatacatgtgaagatagagtccagaattcaggtgcctttttttttccttttttttttttttttttttttttgagacagagttaagactctgtcgcccaggctggagtccactggtgcaatcttatctcactgcaacctccgcctcctgggttcaagtaattctcgtgcctcagcctcccttgtagctggggttgcaagcgtgcaataccatgcccagctaattttttttttctcttgtactttttagtagagaggggctttcaccatgttggccaggctggtctcaaattcctgacctcaaatgatctgcctgccttagcctcccaaagtcctagcattacaggcatgagccactgtgcgtggcttcaggtgcctttttgtattgagagcctggatttagcacacatgtccaccatttttcttgatcaggtttgacccacatgcagccaacgggcaaaatgtggtttcccttatccaccagggtgagcccttcctgaaatgtttatcaagagtttctttttctctcttcagcagcttgttggtgtagtcacctctcattgtggatttttaatcaatttgatctaaacatggaaaagcaaattttactttccacagatgggcaggatgtagtgaaagtccagagaaggttctcaccaaatgtgtgcagctcggaagaaaaaggttgtggtcctcatgtcccgttattcatttggtgtcttggggctgttgatgttacaagtcagcttcattgcttaatgtgattgtgagattgcatgttttctttgtgtgcatattttcaactaggctagtttgtgaaattagtaatgttttacctgaaagattgagaaatcaaaaacatcacagctataaaactggcatttggctgggtatggtggcttatgcctgtaatcccggcactttgggaggctgaggcaggaggatcacctgaggttaggagttggagaccagcctggccaacaaaaaatcagccaggcgtggtggcacgtgcctgtaatcctggctacttgggaggctgaggcaggagaattgcttaaactcaggaggtagaggttgcatgagttgagattgtgccactgcactccagcctgggcggtagagtgagactccatctcaaaaaccccaaaacctggcattatcaactgcagagtcaacctgtataattttaacaaaacagagcagtatttctgttctcaattttcagagttggcaggaagatcagtattcaaacactgcagcaagtcacacagtgttattccttgtcactcagaaagcctctctccagcaccaaggcctgactgagcctgcgtctcttctcttacaggcatgacagcaagcgctgtggcggctttgatcctcatgacgtcctccatcatgtcggtcgtggggtccctgtacctggcctacattctgtactttgtgctgaaggagttctgcatcatctgcatcgtcacgtacgtgctgaacttccttcttctcattatcaactacaaacgactagtttacttgaacgaggcctggaagcggcagctgcaacccaagcaggactgacgcccgacagactccaccctaacagtctcaagcccctttccattcagtttattttgcagcaggtttttattattattattattattattattcacaacagacactttccctaagaatctcaaactgatttttaaaaatccggtaaattagaaggggccctcgctattttctgtgtcagtcttcattttaaatatggatacaaaaaggatacgccgagccaatcaaagacaagctttaactttactttgaagtgtttctgaaatgataaaatgtagccctagccccctgccctcaattgtaaagtgagcaaccattgctagtaattctttaatgtgtataaattcaatttcaggtataacaaatgtgatcatgacatgaaaatattctagaatagatactgtattaaatattgccatgtttacaatatgtaatatgtttttagccgatggatttaaacatgtagattcaactagaatccatttgtgatatttgtaaataaaggtagaaatattagatccatttctgcagaacttactgtacagtttagttggagtgtagcactgaagaactgtcagctcagcgttgactgaggagatagtgaaaatagcctatacacagcatcttgtgaaaagtactggcagccgtggttgcagcaaataatagggcaaaaaaaataataatagggtggtcggttccctttcatctccctcttctgaaaggaaaaaattgaattggaacgttcaagtccagtttgtgttcagtcataaaactgggccagttgttaaccttacagaatgagtcatgtggccagaccttcaagtccaaggccttcagacactaaggatgggaaaatgggtatttttctttggagaaaagctggaaatataaacatggcatttttaggtaaagtttcttccactagttgaattttcatgcagatatttttccttaacgttggtgccagtcaagcaaagagtattatgatggaaaagaccagtccaagccccatcgctccggagtgggagccagtgttcttgctaattgtttctttctgcactaaccactcagatgtctaatttaattgttttgcagtcaaatactggatttgtaaccttcagggctgacatgctgcccagtttgcttcatcgggagaatagcaacaggtagacacatctcaaggctaaatctgctcatgtcgccactgctctcataatgacacacatgcagtaagaagacttttgtaaggggatttgagtacacccaaatgaaattgtgacaggatgtttgtatggttaacatctgatatcagaatgttaaaagtgccttctgtcttaaatctcaaaccaaatattttgtgtgttgaccttgggcagaagaagtgtccttccctcctttcttcaccgtcaggtagaaaacctgcactctgcagaagggtcctgtgtgatcacttaatcctctggttgagaagcagcagtaatgtttttgcttccaacctgattaatcattttatgttgaaaatagtcaatgagaccagtatctcttgagtgctttatttgccttctctttgaagggaggggacgggctctgctctgtaaactcaaatgtgtagagtcagcaacaattccgtagcttccaactgactcagaattgatgcaacgtaggtcttctggcccgaggcaggtatcaagtccaaatcataatgaacttttcaccagtttcaaccagtttcttaaaagagagcttaagtcaagatttcatcaagacttgtgttttcccatgaatgtgaatctttcaatggctgttggagtatgtatgtactgttcttgcattctgaagtagttaaagaactctagaaagtactgattggccatctggtgtctatggagaaagaagtcctcacgtttgagggctgtacagtgaggccatcttgtagcagcgcatccagctctaccaaggcagtcctctggttcttttttctaagctacagtggaaatggcctaatggttaaaactgtggtatacatgacatcggttgtgctaaacaagttcctcgtgtcccaatatccaatggtttttcatcctattttgtatcaatcaacagagtatagttaaagcttgtcttgatgttgcattcttgcaaatgtcttcaactcttacctgagaaaacatggcaaaatggtcagccagacccttccagtttttcctttgcttttctaagcctcggggaaaccactgtttcagttgtataaaaacttttgccacattcctatggcccagtcgaattaataccctttttctcactgagagaggaacacgtactgcctgtcataacagcattgtaatgccagtgtctcagtaacagaatcctggtgggtgttaattgggtgttttttgccctggagaattcagattcctttctatacctccgattctgcccagaagagggggggaatcaccagtgttacaaaattagaagattgttttgcctgttttagactgaatatttgaacactgcagcattactagccaccagtgttaaaggacagatgaggggaa

SEQ ID NO: 125516 - DNA, 1513 bp, Homo sapiens
tgaaattaaaactgtttgctggctgggcatggtggctcacacctgtaatcccagcactttgggaggccgaggcggttggatcacctgaggtcagaagttcgagatcagcctgaccgacatagtggaaccctgtctttactaaaaatacaaaaattagctgggcatggtggcggcacctgtaatgccagctcctccagaggctgaggcaggagaattgcttgaacccagtaggtggaggttgcagtgagccacagttgcgccattgcactccagcctgggcaatgagtgaaactctgtctcaaataaaaaaataaaaataaaaactatttgttgacttttgtttttcatttagttttggaaaagactatttgcaaaagtacagagttatcttcagcaattacttcacaacttagattggtaccaagagtgacaggagatcttgtcttggaagatcattattagatgccaacaaggagacccactgtgatttctggtaacctatttggggaaaaagacctaatgacctaatatgcaatttctgtcctcgtgtctttttctctaacacacagtcatgggtgaaacatttcagacacctcaggcagcacttatggtttctaattgtgagaactacccttccatcaaacaaaaagggcaagggtgggagccccggctacttggttaaacattttttactacaaattcgcccagaaaaggtgaaatattttgttataaaactgtattaagcatggcctaagtatttattaggtatatgatctgtgtagtatgttccatcagaaatatttcttactagtgctttaagctccagagtaaacagtcatttaaaatggagttcactgggcaggtttcccctttaatctagatagaaatactctttatcagagatttaaggcactgttttgctaactggtaaataaaaccaaatgtaaatatgtaagaatgtttatttgttgcacataacttttttggtataaaataaatgtagaagttacctgtggaagttgtgctcccattattcttaaactgcagggttgcattccaaaagaactgaaacgaagtctttttagactcagtaggagccttatattcttgaagtcaatactgtaacctcatttctaaggtatacagggttgattctttttctcttaaatcatatgtaacttgcagaagattcagagtcctcagacctctagttcttggaattcctgtaggtttacggtgtatgtgattgtcaagaattaatgacaaaaatgtgtcactgcctacagttctgtgaacactcagaatgtattaatgagctgtttttccatagttttactttagcttaccttgaatactccctgtataatcctctaaaaaggtagcatcggcaagaaagatgaatccgttggaaatacagctgagccatacttcacggaatagaacaagtgtgttctgtgctggagctcaagacctgtggaaagggactgcccccactgggtgcaatggctcatgc

SEQ ID NO: 125517 - DNA, 1020 bp, Homo sapiens
catgttttgtttgactttataaccttattcagcaaagcagtagtgttgggactcaactgcaagtcactgtgatacgatgtcctgtgtcattttttctttttttcgaggtggagtttcgctcttgttgcccaggctggagtgcaatggcgtgatcttggttcactgcaacctccgcctccccagttcaagtgattctcctgtctcagcctcctgagtagctgggattacatgcgcctgccatcatgcccggctaattttttttttttttagtagaaatggagtttcaccatgttggacaggctagtcctgaactcctgacctcaaagaatccacccgccttggcctcccaaagtgctgggattacagacgtgagccaccgcgcacctggctctgtgtcatttttttctacagcatgttacttcctctgaagcatttggctctttaatcattttagtttttgcttcaggcacctagttcccaaagaactgcagcctggcttgtagccccagctctcatactgacatctcctccctaaagtatacagctctgtgttagggttgggattaggtctgccgggaatatagcaagaggacttgccttcaagacccagcttagatagggtcataaataactttgcatccctaaaaaggactcttctgggcacagattattcttgggagttgacaacgtatttggaatatgttcctctgggaccagcaaagctcagagtcgacggatgagttgtaggtttcctggtgtctgcagtcgggtaccctggctgctttcagagagtggagtcctgccccgtatctccccagagttttcccctttctctcccatgaacttttgcaagtcggggcttccctagctctttctctcatgtatgcttcagattacgtttacctcatggcagctttgtcttggttgttggggacacaaagatgaacacagtggaggtgctatggtagggacacggtggagagacactgaagtgtcagcaaacaccatgtgccaagtagg

SEQ ID NO: 125518 - DNA, 1046 bp, Homo sapiens
ttaaagatcctacttctagctgggcccctcatgtatccattggccgactgcagagtgtctctacctcctctccagagtatcattcctatctgctgccagagccacactgccatttactccaaggactttgtaaaattccacacctggaaagacctttagttgctcagtatccactttgtgtctccaaattgtgtaggactctgtaatcttttgactagtttctgagaaaacacaatgaagcatttcactttttttattgaaggccatttaataaaacacagctggtcagcccagtgcaaaccttattatctgccaccagtatgtaccattggttctcctcattccttgggccagcttctcaggtagctttagacctcaacaagttgtatctttgccagtgttccatcttgttcccctaaattaataaaatgcttttctccaggattttggcaaaggttggtgtggctgtggttttgctaatgcacctcctagatttcaaagatttaccagttttaccatgactcatatattaagatctgtttctactattcagttcctcaaactgaagctcattgaaaaaataatgtataatgttatttgttttattatagcaattattcctcattaaagcagtatttaatgcaatttccagttatttctttggagaatgttatgtccttgttgcattaccttaaaggttgtgaagatgtgatgtgtgttgcttgttcatcacaaaaatcagtaagcacaataaagtggatgccaaaccatcaaacacatagatgttcctgctgggtccctggatatgtaataagcaggtataaaaatattttaattatagttttcttacaaatataacttacgagaaaaaaatttgattggaataatactgtatattactaatttttaactatccctacccaaaccttatgactcacagaattttctcatatacagtattcagtgcacagaaaacttatgactggctcaagtacagtaagttacttctaagtaaaactctcaagtctgagtccatatttgtagct

SEQ ID NO: 125519 - DNA, 1014 bp, Homo sapiens
caggatggtcttgatctcctgacctcatgaaccgcccacctcaccctccctaagtgctgggattacaggcgtgagccatcatgcctggacccagaattcttttttaacaaaatatttgctttaagaaaatctgctttcaaatagtatatttttgagatcagattagtgatgtacatattgataggaaatatttgaaatattttaagtaaattaatgaatttgaattatttggcttatataaaagaacattttttaaaaatgtaatatgcctctgggactcatatttgctcaaatccaagagttggaagctgggtgatgggcgggtgaaaggaagtactatactttcctgtttatccttcaaaaccactgaccttggatagatatatttctcaaatttattcataaacgtcttttttgtatctcctcctaggtatttcagttactaactgatctgaaagagcagcgtaaagaaagtggaaagaataaacacagctctgggcaacagaacttgaacactatcacctatgaagtaaggctgggcttctgccaggcctacctaaagtaccattgagggaggggggtttattctcccaatgactggcagctgaaattaagattgctttttatatgatctgaatgttttattctaacctgatttttgtttgtttgtttgttttttgacacagagtctcgctctgtcgcccaggctggaatgcagtggtgtgatcttcgctcactgcaagctccacctcccaggttcatgccattcttctgcctcagcctcccgagtagctgggactgcaggcgccctccaccacggccagctgattttttgtatttttagtagagacagggtttcaccatgttagccaggatggtctcgatctcctgacctcgtgatccgtccgcctagacttcccaaagtgctgggattacaggcatgagccaccgcgcccagcctactctaacctaatttttattctgtttatagaagtgagaggagtttggtcaagt

SEQ ID NO: 125520 - DNA, 1050 bp, Homo sapiens
atggcgaaacctcatccctactaaaaatacagaaattagctgggcatggtggcgggcacctgtaatcccagctacttgggaggctgaggcaggagaatcgcttgaacctgggaggcggaagttgtagtgagcgaagtgtagtgagcgtgactgcactccagcctgggcgacaagagcgaaactccttctctagaaaacaaaaggaaataaaaggtttcacttacagtggcaagcacaaaggacttgagtgagaagttccctatattaacactagagccattttttctccctgggttcagaaaacagtcccagcatccaacatttattagcattcacttggaagccaggtgtcttttggaggctgaagcctcacctcttcagttacgcctgggctgtgatttgctgtggccctctgatgactgcctgctgactcagaggctcggtgaggaaatgaggtggccacccagcttaggacttgttgtgcccggttgtgtattgatttggaatgatttgtgagccctccggcctgaggtcagtgaatcctgtgacctcacaggccactgccctgaacagcactaccatctaggcctgttagtgatttcgtgattatgaagtcttgactcatatagagcgttattgcttgtaaaacactgttacatgtgttctccttttgtcctcgctgtaggcgttactttcattttacattagagaaagttgaaatttagaaagccagattcagtgaactgttctggatcaaatatttaatagtatacattgttgctatcagatctttgaatcattttgaggaaagtaggactttaggtttggcgacttcaagttgccatttttggaggtcggcaacccggtttgatgctcctgggattgagataataaatgtatcatttatgttaacccagctgttgatactttggatttttaagttttatttccccttatgttctcaactacctgaaatggttggtatctgagaaccttgagatggtgctttgaactttacttctttatttggactgtttctcctgtgttgga

SEQ ID NO: 125521 - DNA, 1052 bp, Homo sapiens
cctccccggtttaagcaattcttttgcctcagcctcttgagtagctgggacttcaggcatgtaccaccacgcctggctaatttttttttttttttttttttggtatttttagtagagacagggttttgccatgttggccatgctggtctcgaactcctgacctcaagtgatccacccgcttcagcctcccagagtgctgggattacaggcatgagccactgcacctggccatagcagtggtttctgatcaaatatttgatgcccagcttttcatagagaacatcacaaaattccagctccaagtaattttgggctagaggcataatttcccacaacaaacatgggaaacctactttcatatgagagtgactaggctaaagcaaaactaaactggaaaatatacaggaaaggtagagctatttgccaggctactttctagcctccgtatatatctgttatttcttgagtccaaatctagttctccattcttaatctctcccagatgaaatcttcagggacttgcagaaagtgtgcaaatatgcatcctgctcatttttataagtaaagcataatggctacatggatttatagttttcttctgtcattctaattagatctgaggtggtcatgataggacaattctggagaaaatacagttcaaaagctgagtatatttttaaaaactatttgctaatgaaagccttataaataatagcagatggtcttaaatttacttcatttgcaccataattgttgcatacctggctttttgttcatgccaagcctaataatgactgggacgtaccatggtatacagtcagacctgggttccagcttggcaaataatttgccatgtagcagtatattaaggaagttttttattccttctgggcctcagtttccttatgtgtaaaattctagaacagaaatgttcctttaccttatttttcgttgcagcaatgtaagggattgcaaaaaagattttgattcattcatcaacaagagtgcaaagtgatgatagaggcagatgaaatagactgatcaataaaggg

SEQ ID NO: 125522 - DNA, 1064 bp, Homo sapiens
aaaaaaaaaggaggtgaactctgtatttttagttttttttaaatgtagtcaaaccatattataacactggaaccagaagaaaaaagtaatgttctaatcctaggaaagcattagctgtctgggcttttattgagaaagttttagcaggatcagtcaatgcacatttatcaagtgctcaatatgcttgtagtatattgttatatactatggagaaactgaaaaagataagatatagtcaatatgtcccaagaactcacaactaattatacttatagaatctaattacagccataattaccttattggcaatctaaaattcattaattcattcaaaaggctctagtttcaaggagctcacagcctactggaaaaacagacaaagtaaccatgtagtgtgagatgtgatatagggtaaatacaagggcactaggaaggacacctgtgtcgtatgtggcagagagctttcaggaaagctgcgcaggaaagatggcattaaagtggaatgttgaaggatgagtgagagtcatcaggcagagagacacgcaaaagctgcagtgcatgcggaggctcaaacaaggaagggatgcttcaggtggatgacagtggcactgggtgagtgtgtgggggtggtgggtgggtgggtggtgaaacaggctggggagcagacaagggctgggtcaggaacggccttgtactaacgttatggtgaggacttaatttttttgaaaaaagtagaaagttgtggaagaggtttaagcaagggagcatcataagtatatttgcattttagaaaggtcgttcctggctgggagcggtggctaacacctgtaatcccaatgttttgggaggccaaggtgggtagatcacctgaggtcaggagtttgagaccagactggacaacatggtgaaaccccgtctctactaaaaatgcaaaaattagctgggtgtggtggcacatgcctgtaatcccagctactcgggaggctgaggcaggagaattgcttgaacctgggaggtggaggttgcagtgagccgagattgtgccactgcactccagcctgggc

SEQ ID NO: 125523 - DNA, 1064 bp, Homo sapiens
ctttggaaggccgagatgcgagtgagcccaggatttcaagactagcctgggcaacatagtgagacccccatctctacaaagaatataaaaattatccaggcatggtggcacatgactctagtcccagctacttgggaggctgaggtgggaggattgattgagcctgagaggtcaaggctgcagtgagctgagagtatgccactgtactgtagcctgggtgacagagcaagaccccgtctcaaaataagaaaaaagaatgaagaaaaattatatttgtagaatgctttcttatcagcagtcttccactgcattttaaggataactggctcgttggggatagttcttagggtattttgctcagtttctaggaatgatactcactgttgggagatttattctcagccaattactgcagatctgcataaacaccataattattagtgaccttacttctgatttctttctttctgtaaatctaatagccactttacttttaaacctttgtttagatgaggcataatttttggatacctaaaagctaaacattggttacactagaaaaattattaaacactagccttctgattaagagaaagttgctattaaagtgacattacagtttttattttaataagttatgctcacgtctttacaatatattatttcagaaagtgctgaaaattcagagctagattatatagcctaccagttgagtctatttcaaatcagatcttatacattcttttctttattgcagtaagatatatttaacataaaatttaccactctgacactttttaaagtgcacaattcagtggcattaaatacattcacattgttgtgcaactgtcaccaccgtccatctccagaacattttttgtcttcccaaactgaaattctgtacccatactcttcattgcctggtccctgtcaactgcagttttttgtgtcacttgtatatattcttttttgaaactacatttcaaataagacaaccatgctagcataagttcactgataggctatttgattccaaggtgaaaattccttggctttgtctgata

SEQ ID NO: 125524 - DNA, 1176 bp, Homo sapiens
atttgagacagagtcttgctctgttggcacaatcttggcttactgcaacctgtgtctcctgggttcaagtgatgattctcttgcctcaggtgggattataggcacatgctaccacgcctggctaattttttttaattttttatttttagtaaagttagggtttcgttgtgttggcctggctgatctcaaactcctgacctcaagtgatctacctgccttggcctcccaaagtgctaggattacatgagccactctttaaagttttatatgtattaaagttttgtgagctctttgtaattggtaattcatagctatctcctttgcacaatagtgaaagggttttttattaccaagatacatgtacaatgctattttgagggttcttaggcagtagacattatagttttcctacatgcaaattggcttggctagattatcctttgctttcttgagtggtgggttgggaagaatgctatggtttgaatccatgtgactaaagaatctatttcatacacacttgtggtttttgaaaggatttcaaaatacccactgaaattaaaaaacacccacccttcccccccccctcccccaccgtctctgcctatctttaaagtgacagataattttgaggaagaaaagatgaagtgtgaactatagtggtgtttttgggccttttgtggtaatgcatacaaactgacagtcttgtcttgtgagggtaggtttcataagacctttttgcaaactaaatcctgtgtatcttcaaagcttttttgcctgtaataagtcagatgctaatgtatccagcactgatgatcatgaggtttttgtaaagcagtgcttgaaaagagattgttgaccgttagctatgatatgagatgggccccagagaaagaggtggctggcgaaggtgttttccttagttatggggtgagagtgggagaaaaataacattttgactgagaatataggatttatatctctaagcctaaaaatactgggttggtttttttttttttttttttttggtacaattctgggtagtctgcaagtaatattgagtcagcacattttagggacatattacccaatattgaatggataatcatgcttcatggttactgtgactcacatagtaaattggtaatgaaacgttaacatattttataccctgtccca

SEQ ID NO: 125525 - DNA, 1042 bp, Homo sapiens
ttgcatagattcttaaccttttagacttaggaacttatttgagaatttgatgaatcctgtggatccccacctcagaaatacagacacatgaatacacagatttcactcacaatttcagtggatacatagatataccagaagtccatcagattaaggactcctattagccacaatttcagtggatgcatgtgtgccagaagcctgacagattaaggactcctattttatagtctccttgctcaagctcatccactcatagggctttcattacagcctatttgctgattatcataaatctgtatttcctagtgggtctctttcctgagccctaggttcattatttccaactgtcttctgtatgtgtccaccgaaatgctctcaaggacctcaaattcaaagtccaaaattgaatttattttctaaacttgttccctgagaggcagaagctaggtggaattgttcattaaactgagcaggaatccaccttgagagtggggatgatgctgtgctcatctatacttgcggtacctatgagccagagagcagatttgaggaacagagtcctcagggcacatggctcaaaccccaaaacaattcaagaacctggttgctaaagttagagagctgaaaagcagatccaatttatgaatggaatatttagttggaaacctgagtagatagtactgaggaagagcaagtgatcaaatggaaaagcatgtaccaaggtgcagaacccacagtaacagacaagaagaaacatgaaaatgaagtcagctgggggacaggggttagattaaatccctaaaccaaacaacaaaaagctgcagcagcagttggaattgatattcttacattaaaggtaaagcctggaatgaatgcatacttgtgttttctggttcctatactcagcaaaaactgcttgttcctgtttttttctatctccatacatagcatgcttattcacccagttacccaaattaggtctcctcacttaaaattcatgaatgactccactgttactacaggatagagtctagacttc

SEQ ID NO: 125526 - DNA, 1046 bp, Homo sapiens
agtaaaagttccccagtttgagaaaagaggggaaaaggactccagtgaaaggaaattgatgaaattactgttgactttacttgtatatattaactgtctttcagtgtctctgaaaacttgatttgggactatttcctttgaacagaaataatagcattcctgcctgataaatgtcctgtggtcaaataatatgatttcctaatcattctgcacactaaacttccccccaccaggaaatcaatgccttaatgctaaatttcctctgtactactttctgtaagagtaagaggttcctatttcacagtcacgacacattcccaactcaattcacattccaatccatcttgtccaacttcattgaaagttgatacactgaaccatttcctttacttaaaagaaatagaattcttcctaaattctatctactgttggaatagaaagaatatcatgcttctagactgactaattttttttcttcttgatataagtattgacaacatttattcatttgtttctaggcagcacaagactgttgaactttcctagaactgagtctgagatttgcaaagctgccaaaatattttgaaacaaatgaaaatatgtaaacatgaatgttatcagctgttttacagtatttgtgttttagagataatgagcatctggtggaccacaggagcccagggggatttcaaactccagattcctttttgtgtaatcatatctggctggagttatttgttttctctgcatgtgaaactatcaagtcataattcttcaaaggggaatgtttattgcattatttaaaaataataaattatattactaaataaataacagcaggccaggcataaaccaatgatgaaagtttgtcagaaactaaggcttctgattaattctgtgctctggactataattggaaggaaggattatattagagtttacaatgagtttacagaaagaaaggagagggataaattatatttagttcacagtaaatctgaattcagaacccctggttgtaagactagtcttttaacctttagagt

SEQ ID NO: 125527 - DNA, 1169 bp, Homo sapiens
gcccctgatctgcaggaacctccccaaccgcctggcttgtctaggcctgtagctgggaaggaagagacgaagacacagggagaacacaccgggactccacacctgtaaccacattctgtttgttcgccctaggaaagattgctgccttttcagcagaagggaaattcctaggattggctgtcccctgccaagcttggtggagcgtctgcaccttggctgcgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagcattctggtagttacatgttttcattaatgtgatttcagagaagcacagaccttatcagatgctgatgtgataaaccaaagtttccttggttggctgtattgtagatactcccctggagccatcacctttttttggaggggggtggtgggtagaggcagggtctcgctacattccccagcctgggctcaaacgatccttctgcctcagcctcccaaagtactaaaattacaggtgtgagccacggtgcttggcctgcattatcattttgtagtgaagttttctttttatttcaagagagaacctattgccatccactttgagaatcctgttctatttcatgcttgcagactgtatttaaggacatggaagttactatttccacttgttttctagaagcctttgttatgaaacccaggatgtccagatagtagtaataattcccatattgagtgtgttcacatatgtgccagccatgaaaagggtatataa

SEQ ID NO: 125528 - DNA, 1768 bp, Homo sapiens
ctccacttttctcttcctccgctgatgcctcccagctctcgtcagcctcctgctggccatctccttaacaccaaacactatgccttcaattcagttgcagagttttgatggagagatatttgcagttgatgtggaaattgccaaacaatctgtgactatcaagaccacgttggaagatttgggaatggatgatgaaggagatgacccagttcctctaccaaatgtgaatgcagcagtattaaaaaaggtcattcagtggtgcacccaccacaaggatgaccctcctccccctgaagatgatgagaacaaagaaaagcaaacagacgatatccctgtttgggaccaagaattcctgaaagttgctcaaggaacactttttgaactcattcgggctgcaaactacttagacatcaaaggtttgcttgatgttacatgcaagactgttgccaatatgatcaaggggaaaactcctgaggagattcgcaagacattcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaaagcagtggcaagtcaattgtattagcagaatattgtcctcattgcatgtgcagtttgagtacagattccaaacctatggctgagtttcttctagtatgatcaaaagtttcttttttttttttttgctctgaataaaactgaactgtgggttctctataagtggcattttgggttttccttcttttttgtaaagtaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagttaactaggatgtcttccagcctcctgcagtcaaggagtaccactgtaatgattagtctgtatgtagcagggctcccttcattgcatttgaggacttgttttctttttctttaattttatttttaatcctcttagttttaaatatattgcctagagactcggttactacccagtttgtggttttttgggagaaatataactggacagtttgttagcttttcaattaaaaagacacttaacccatgtgggatgtcatgtttttataatcattgttcccatgtggagaaaattattcacactacttgcatgtaaaaaataatttaactttttacattaaaatatgtggtaaaacccagaaagcatccatcatgaatgcaagatactttcaataaaaagtaagttataaaaaaaaagtcttacccagtcttacccaattcttatttataagttccatataagtagaaaagaaaaataaatagatcaagacatagtaacagtaattataacctagaattaaaagattaaaggaaccaaacaataaaataagcaaaagttatgtaattcacacagtagcctcataagggaataaaagcactcaaaagttaagataaggcctgtgcactgcccaatgtatctgtcccccacacgttgtctttcatggcagatgggccaaggagggttccccaggaagctgacctcagggatgatctaagagctgaaagaaccctttggtatac

SEQ ID NO: 125529 - DNA, 1056 bp, Homo sapiens
gaacactttcttctctctcctccctctgccccaccctcatcatctgccaagtcctacccattctaaccctcatagctcttttttttttgagatggagtttcactcatctcccaggctggagtgcagtggcgtgatgttggctcactgcaagctccgcctcccgggttcacgccattctcctgcctcagcctcccggagtagctgggactacaggcgccctccaccacacccggctaattttttgtatatatatatatatttttttagtagagatggggtttcactgcgttagccaggatggtctcgatctcctgacctcatgatccacctgcctcggcctcccaaagtgctgggattacaggcatgagccactgtgcctggccccctgatagcttttaaatcaggtctctccacctcaactccattatcgctgctctagagctcaagccttcagtgtcctttcacttcctgaatttactatcttagtgctcttgctcacattgtcttctttgcccaaaatgctcttaccagtctccttcttctgtctatatggcaagttaaatggacccatacagtgttataggttgttcactgcataaaagcacctggatgagagtcatctgctatgtgccctttttctttttttttttttttttgagacggagtcccagcctgtgtcacccaggctggagttcagtggcgcgatctcggctcactgcaacctccgcctctcgggttcacaccattctcctgcctcagcctcccgagtagctgggactacaggtgcctgccaccacgactggctaattttttgtatttttagtagagatagggtttcaccgtgttagccaggattgtctcgatctcctgacctcatgatccgcccgccttggcctccccaagtgctgggattaccggcgtgagccaccacgcccggcctgctatgtgccctttttctaattcacaccaacacaccatacagtttagtggcatctactcattctagaaatttctattcaagttcccctcatctgtgagcatttctgtctactgtcc

SEQ ID NO: 125530 - DNA, 1011 bp, Homo sapiens
actaaactgtatggtgtgttggtgtgaattagaaaaagggcacatagcaggccgggcgtggtggctcacgccggtaatcccagcacttggggaggccaaggcgggcggatcatgaggtcaggagatcgagacaatcctggctaacacggtgaaaccctatctctactaaaaatacaaaaaattagccagtcgtggtggcaggcacctgtagtcccagctactcgggaggctgaggcaggagaatggtgtgaacccgagaggcggaggttgcagtgagccgagatcgcgccactgaactccagcctgggtgacacaggctgggactccgtctcaaaaaaaaaaaaaaaaagaaaaagggcacatagcagatgactctcatccaggtgcttttatgcagtgaacaacctataacactgtatgggtccatttaacttgccatatagacagaagaaggagactggtaagagcattttgggcaaagaagacaatgtgagcaagagcactaagatagtaaattcaggaagtgaaaggacactgaaggcttgagctctagagcagcgataatggagttgaggtggagagacctgatttaaaagctatcagggggccaggcacagtggctcatgcctgtaatcccagcactttgggaggccgaggcaggtggatcatgaggtcaggagatcgagaccatcctggctaacgcagtgaaaccccatctctactaaaaaaatatatatatatatacaaaaaattagccgggtgtggtggagggcgcctgtagtcccagctactccgggaggctgaggcaggagaatggcgtgaacccgggaggcggagcttgcagtgagccaacatcacgccactgcactccagcctgggagatgagtgaaactccatctcaaaaaaaaaagagctatgagggttagaatgggtaggacttggcagatgatgagggtggggcagagggaggagagagaagaaagtgttcagatggacccgtgggcttgagtg

SEQ ID NO: 125531 - DNA, 1059 bp, Homo sapiens
attactgctatcttgtattttaattttttctgcttattagatgtttgaaatggtggctcacgcctgtaatcctcgcactttgggaggccaaagtgggaggattgcttgaggtcaggggttggagaccagcctgggcaaaatagcaagactgcatctctacaaaaaaaaaaaaaagatagccgggcgcagtggctcacgcctgtaatcccagtactttgggaggctgaggcaggcggatcacgaggtcaggagatcaagaccatcctggctaacacggtgaaaccctgtctctactaaaaatacaaaaaattagctgggcatggtggcaggcgcctgtagtcccagctactcgggaggctgaggcaggagaatggcgtgaacctgggaggtggaacttgcagtgagccgagatggcgccactgcactccagcctgggcgacagagccagactccgtctcaaaaaaaaaaaaaaaaaaaagatgcttgacgtgaatgtatactcatttcctagttgtttctttctataaggatgtctgacctggctaatttgtaaacaggaattctgcattcatttctctctttgctttctcaaccccaattgagcacacaagtgtttaatgagtacttaactgatttgataagaataactcattgatttctttgattttttgttgctggttttcagtgaaaaaaatgttatcagccgcacacggtggctcacgcctgtaatcccagcactttgggaagctgaggcgggtggatcatgaggtcacgagatccagaccatcctggctaacatggtaaaaccccatctctaataaaaatacaaaaaattagccgggcatggttgcaggcgcctgtagtctcagttactcaggaggctgaggcaggagaatggcgtgaacccgggaggcggagcttgcagtgagccgagattgtgccactgcactccagcctgagcgacagagcgagactccatctcaaaaaaaaaaaaaatgatatcagtacttactcattgtgatgtctacatatagaactaaaattctgtttacttatgtg

SEQ ID NO: 125532 - DNA, 1111 bp, Homo sapiens
acctgtaatctcagcactttgggaggccaaggcgggcggatcacgaggtcaggagatagagaccatcctggctaacacagttaaaccccgtctctactaaaaatattttaaaaaattagctgggtgtgatggtgggcgcctgtagtcccagctactcgggaggctgaagcaggagaatcgctggaacctgggaggcggagcttgcagtgagccgagatcgcaccactgcactccagcgtgggcgacagagcgagactccatctcaaaaacaaacaaacaaaactacagaataatgaaatagaatgtccaaaatttatcataactggtgtctcacgagataatacgtttgggtcctgtttagcaagttggattatatttttatttgtgtaaatttattggccgttgcagttggggttgtattgagaatgtagattttgtctgatgagagtgtagattttatttgtagtgagtgcatgtggatttttatttgtctagggttttaaaagttgtatagtcatgaatggacactttttaataccatctatgagaaattcaatggcaaagtgttttcatacccatatgctaactgctgatgctttttataaaacattgttaaggtgttacttgccccaggaaatacaatgttttatgacagagacagtactgaaattcagtatttaagttctttaaataccagctatgttgagtagatattactttctcccaagagcctatttttggtttatgacatattagggaacaaattgcagacacagttttttcattacctgtaagagcacttataggatgtaagctatttccttaaagaggaatttttgcctttttaatacttctgtctagtaactcaatgcattaaaagatacatatttttctagtgctataaatatattggtacatttaaatataatatacacacatataatggtgcttgagaaataagttgagattattttaaggttaaggttcttagattctgacagaaaaactgatcagccagttggactacaggtccaaccagttccagccccaaacatgagcaatagtgattatggtagtgattctgccatttacgtcagtgaaatgcaaagat

SEQ ID NO: 125533 - DNA, 1014 bp, Homo sapiens
caagaattgcttgaacccggaaggcggaggttgcagtgagctgagactgtgccactgcactccagcctgggcaacagatcgagactctgtcttcaaaaaagagagagagaaagagaaaaacttattggaaggctttgctaaatgaattttccatcttggaatcaccattttggtgagttattgtattaatagtttaaaaaaaaaagagcttcaagtttttagggattctttatggattcaaccttcactgatactagactttaggatatacttagcacatgtgtgtgtcagagaaatctccatttgtatacctcagagagctctacgatgttatggtaaacctcagaaaaatgaaaggataagtttcatcagcattcatcagtcttgggagttgcaaatgcctttgtaatgtaggacagggagtgaccttgctgaagtctccccatttggcagggtgtacactgttaggtcctgtcagacaacttcagttagaactgaggttgctgtggaaggcagcccaacagttggaagaagatttttttgtttgtttgtttgtttgtttttgtcgagacagaatatcactctgtcgtccaagctggagtacagtggtgtgacctcggctcactgcaactctgcctcccaggttcaagtgattctcctgtctcagcccccgagtggctgggattacaggtgcgtgccaccacacccagctaatttttgtatttttattagagaggagatttcaccatgttggccaggctggtcttgaactcctgacctcaggcgatccacctgcctcagcctcccaaagtgctgggaatacaggagtagagccaccgcacccagctggtaagttttttttttaagcgtatttttaaatataacattcttatacttttgttctgagtgtgtttaatttatttctagtaaattagttttttgctgtgtagacagtgctatgaaaatatactcttggccgggcattctggctcacacctataaacctagtacttt

SEQ ID NO: 125534 - DNA, 1083 bp, Homo sapiens
ctctgttgctcaggctagagtgcagtggcgtaatcaatcatagctcactgccgcctcaaactcccaggctcaagccatcctcctgcctcagccccccacgtagctgggactatggacgtgtgccaccacgcccagatcttgtgtttttgataggtacaatactggggagaaatcctgctttattcagttgtcccctgctattgttggatatgtagttttccattttttaacaattgcaaacactccaaaaataactctgagtagttaaatctttggagcaatgggtgtttccttaggtttagttcttagaagtagaatgttggagataaaatatgccagattttaacactattgatatgtatagccaagttggtttccagaaagtttataacacagctgtttccacgcccctttttaaggaacttgtgttcttgtaacttgtgggttgctagagatatctttgggataatcttggtattgccttttgcttgcttacagtgccgtctgatgtttagcgtcttcactgagttagtctcagagatctaaggtactgtgctgatagattttcatcacatgttctcacgtgcttgtgaatttgccttttggccatgttcagtgtaccctaaatccctgaacttttcagagaggcagcttcccagcagtggtcatttctttcttcatcttggtcaataccaggatgccctaattggagttggaatgaatttagcgggaggggtcaaatagtgtgctttcttttatctctttttctttttttttttcctaaacagaacttaatttattcattaattaaaactaacatttgccactgtgacgcttacagaaattttctcgtaactctttgcagaggggatacatttatttagtcttcattaatttcctatttgaaaacgcttgtgaatggtagaaaggaattttaagtttgtaaaatgtttggaatcttaatagttttattcaagctttcttttattattattattattttattattattattattttgagatggacttttgctcttgttgcccaggctggagtgcagtggcacaaagtcagctcactgca

SEQ ID NO: 125535 - DNA, 1018 bp, Homo sapiens
tagagaaagagagcaaggtgtatggaattgaccttttgggacattattttaaggtgactttatttaaagaaaagaattgtagttgcaaaatgagtttggattaatgcttttcttcaagcgttcttttcaagtttggttctgaggctagatcattttctctaagtgtaatatgctggattttttaaaaagattttcttgaataaattgatttgatttcacagtttattgagtatcttgtgccagtgaagagttcatattttaggttgtgaatataaaagtgattaggaaagccacatcatgctgcctgtgaagagggtggtggccgagttgtcatgatcttaaatgatcagctctgaattgtagtttgctgatgtgctgcggtgccacactggggtcttacctgtattcccgcagtgggagacaggcgctgcttaacacccatttctctttctttcactttcccaaaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggtatgcagtagccactctccactcaggctccttaggcaaccactgttacaaaaagaggatgcaccgtgtatgtttttactgactatattgtactagattgtagtcttgcgcgtgtcttttttttgttgagtttgaactacatgaaccatttctgttccatcgttacatggtaaagtacctggctagaagtagtttctcaaaagcctgtaggaatgagaaactgtgagaaaactgttaaggcctgtctaatatttacaaacatgta

SEQ ID NO: 125536 - DNA, 4254 bp, Homo sapiens
gatcacttgagcccacgagttcaagaccagcctgggcaacatagtgagaacccttctctactaacagttaaaaaattagccagatgtaatggtgcatgcctgtattcccagctactggggaggttgaggaaggagaattgcttgagcccagaagttggaagctgcagtaacctacgattgcaccactgcactccagcctggacaacagagcgagaccgtgtctcaaaaaaacaaaaaccagttaattctgtctccgcacagtggttccagatgggccgcgtcttgcaggagactttgagatttctagtaatttcttcctaggtgagattttctttttagggatttagtaacttcactgtctggttgatatgtgcaattagtgtggcatcctggtctttgggtaggggctgagttacctaggcttcccttttttgactggtttccctggcttgctgtcttccaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtttgtggcttaataatcatagtaacaacaataatacctttttctccattttgcttgcaggaaacataccttaagttttttttgttttgtttttgtttttttgttttttgttttcctttatgaagaaaaaataaaatagtcacattttaatactactctagttaggacagacttgtgcttttatcctgactaaaaagttaaatatttaagtcacatacatggtaaagatctaagtttcattttccacatggatgaccaggaacctggtcttgttggagctggcataggaggttctactgtcttgtcgtccactcttgtccctcccttctgttatcaaagttaaagcgcctcttcactcaaaagggcttcaaaatgtaaatggctctagagttagagtgactgtttgctcttctgctttctggaatgcagatgacagtatggaaagaaagaataatgattctatctaataggaaaggatttcttctttcttttttaaagagtgggtggattttctcccttttgttttgcttttattttcatgctactaacatatcttcagaaggaaatggcaactagtagatcagtaaaattacgaaaacgatgcctgcaaaatttgaaggaatgcaattctgatttgccatttatcagggaaaactgaaagcatttttcttataactttttttctttttctttttttttggaggggggaggcagggtcttgctctgtccctcaggctggagcttagctcagtgcagcctccaactcctgggctcaagcaatcctcccactttagcctcctgagtagctgggactacaggcgtgtgccagcgcgcctggctaattttaaaatttttttgtagagacagagtctccctctgttgcccaggctggtctggaactcctagcttcaaatgatcctctcacctcggcctcccaaaatcctgggattccaggcgtcagccactgctctcggccctcttacaccattttgtttgattgtctagtccctgtttctttttctttctaatccttattcatttaagcaaaaccatacattatcttttccagtcctttcttgtattcttactgtttttttaaaataactttttgccttaatagctcattgtcactaataacttctgtgttctcccaggcagtgttataacagaagggcaatgaaaacattggacatgaccatgagtgcttcctttccttaactctaggtttgtagtctgttttaaattaggattagttcctgcattctgaaatacattggcctagaacattttatcccaggcatttttgaatagaaaacagttgcgtgcttttattgaagattgttaaaataatcaccatagtaacttgatatgttagtatttttctttttccttttagtatgtttcaagtgcagtaatcgtacttgtctatccagtttctatgtatgatacgagttgcttacacgatgcatggctaacttgttaatttagttttctccttagagactttgagacccttaagagacaagattgagaaagagccatgtggcttggctctagaaacgtcattatcattaggaccatcagattttagattaagctgctattgaattaataaaatcccaatgaagcagagttatagggatagatttatagctggcagagtggtatcaaaggagaaaaacagtgaaaaagccaatttcactggttcgttcaatccagcttgttgctaatattagttacccttgttttaatgacagagagtggctggaatctgtagctaggggaggggcaacactgttagatgtgaggaaaggaagtgccaaaaatgcctggacagatggcttgtcccaaggccaggacacacactttaaaatccaacattcacctaagcaagtaattcttaaagatcttacagaaacgcagagtcaatcaggtttataaaggaaggctgaggggagagaggaggcctgggggcctggacgaagaggcctaggacctgaagagactccagcgagtctcgggaagcccaggggacctgtcaccatctgggcacttcccaggctcaatgctcagccagagtttgctggtggacctcaggattcgaagtgtgcaacagacggagtgcgcttgctgttcagggcggccccgtgcaggagcaccagctcaccctcaggcatctcggactggagggccagcagaaggtcagcaacttactcttaaaacgattgtttcggatcatattgatctctttcctttttccttttgtcctttcactgtatgacttgaatcagttttgattctatttgtaagtgtttcttgtcgtgaggcacctgccatgtctgttgcgttttcctcggcagcgtgtagggcttcagcttcctgggttttcacccttcctgcaggcactgtggggtcctgagggccagtgggtccatttcacctcttgctgcatgatggtcagtagctgatctgttatggcattcacttccagattaattttccgtgtttgaagtatgtgcatatgtgctttacagaataaaacatctgaatttatttgctccgcgtcttcttcctccagccggatgggtgttttctaagggaagaacgtgtgcgatcagcagctgagggttttttgcaagctgctgctttgaaatgtcacttctcatttggacgaggggtggtcattattctgctgaaggcagcctcacccagcacatgcatcttccccctgagggtacaaaacctcctgtagcttgctagaccaacaagtgcttgcaggcctgaccctaatcctgcccaaggaagtaaataataaataccagcagggagcactgaatagacataggagttccaagacacccctctcggtgacataaaccctcagcatgcactaagcctgtatgcccagccgcaggtgcccagcccgctctgcggtctcctgttgcagagctctggcccgctctagacctcctttgccaagacagtgcatcctctgcagtttccatagctaaagggagatcgtattcactaatgtgaatccttcccctttccagcagccagaggctctgtgtcccttcccttccctccccagcaggtgctggggtcgcaaggtcagtctcatggttgaggaaggtgctactcaatgagctctttgttccttctgcctccacctctccctgcctcctgcctggaacaggcaaactctgcgtggagcgcagtgttatttcctgctctctccttggactcaagtatttgtgtaggtggtgattcccctccatcccagtacagaatacg

SEQ ID NO: 125537 - DNA, 1041 bp, Homo sapiens
aagggaagggacacagagcctctggctgctggaaaggggaaggattcacattagtgaatacgatctccctttagctatggaaactgcagaggatgcactgtcttggcaaaggaggtctagagcgggccagagctctgcaacaggagaccgcagagcgggctgggcacctgcggctgggcatacaggcttagtgcatgctgagggtttatgtcaccgagaggggtgtcttggaactcctatgtctattcagtgctccctgctggtatttattatttacttccttgggcaggattagggtcaggcctgcaagcacttgttggtctagcaagctacaggaggttttgtaccctcagggggaagatgcatgtgctgggtgaggctgccttcagcagaataatgaccacccctcgtccaaatgagaagtgacatttcaaagcagcagcttgcaaaaaaccctcagctgctgatcgcacacgttcttcccttagaaaacacccatccggctggaggaagaagacgcggagcaaataaattcagatgttttattctgtaaagcacatatgcacatacttcaaacacggaaaattaatctggaagtgaatgccataacagatcagctactgaccatcatgcagcaagaggtgaaatggacccactggccctcaggaccccacagtgcctgcaggaagggtgaaaacccaggaagctgaagccctacacgctgccgaggaaaacgcaacagacatggcaggtgcctcacgacaagaaacacttacaaatagaatcaaaactgattcaagtcatacagtgaaaggacaaaaggaaaaaggaaagagatcaatatgatccgaaacaatcgttttaagagtaagttgctgaccttctgctggccctccagtccgagatgcctgagggtgagctggtgctcctgcacggggccgccctgaacagcaagcgcactccgtctgttgcacacttcgaatcctgaggtccaccagcaaactctggctgagcattgagcctgggaagtgcccagatggt

SEQ ID NO: 125538 - DNA, 1090 bp, Homo sapiens
tgtttacaagtacaggccctgttctaagcactcttcatatggacttattcagttctcctgacaactccctaaccctaccacagacacaggcagagaaaagaaagggagttaggaagttgtctagaaacacaagccatagtttaataaacataagagtggttttattgattacatacaattttagctatattaatatatattataaactttaagaattagaaataagtgacttttattttttaaccaagaataatctaagttatggcagcatgttcaatgaaaggtaagtccggcacaatttttctatatctgtttctcagataatcaggaacatcatccaagctttacattacgataccataatgaccctcagaacacaagttccattaagtagaaatgaagcatcatatgttttcttttttaggaaagacccccccttttgttgtatagacatacccctaataatcttactctactgtacaaataacttttcacccacaagagctgcctcaagtaactttcattttggaaagctatcaaggcatgagacagagtagcaaaatgccactctggactttgcatcttggagtttcaattttgctttaggatttagaccccagtttataattaaaaccaaatcattcccacattattatacttatgtaggaaagccttgctgtgtccactgttaacacaaagatagaaaatgtcaaatagtttaagcaagtatttggcagaccacagacatgaaacagtgccgtcggaaacggaaacactttagtgttttagaggtgaagagattgatgggtgtcattcaaatttctcatctccttcttctacatctttcagattgagtacttccaaagaacctttgcctttagtttccttttttattagctcatcaatttctcggaagcagcccgggtcaatcagacatacctgaaacatttaacgtagcagattaccacatgaggatgagcaagacacagaataaactcagctttaacttcctttgaggcaagcacaatgctgtccagatctctaataataccacagttctatggtgcaatagataagacaatgggtaggg

SEQ ID NO: 125539 - DNA, 1026 bp, Homo sapiens
gtgagccaagatcacaccactgcactctatctcaaaaaaaaataaattaacatacacatggtgtctacataagtcttcacattgctttttctccttcatacgtggaggtgactttactgagctataaaatgtaatgctaaattttagtatgagaagaatcagagttttctagtttgtcccttccatttacagctgaagaatcagaataagtgtttaaacatagggattaatgccttgtcacagggggctacatggacacttgagggcagaggctaaactggaacccagtgtgccgccctacccattgtcttatctattgcaccatagaactgtggtattattagagatctggacagcattgtgcttgcctcaaaggaagttaaagctgagtttattctgtgtcttgctcatcctcatgtggtaatctgctacgttaaatgtttcaggtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattat

SEQ ID NO: 125540 - DNA, 3003 bp, Homo sapiens
aggtggtgccaacgctgtgttttaacccggtcactaaacatccgcgagcatcctgtcagagctctcagctcattggcgaaagtaaatacgccaaggaaaagcacctccctttttgggcgtggaaagatggcgtaaaaagccacaatacgcaggcgtcatcgctcacttttcccctcccggcttctgctccacctgacgcctgcgcagtaagtaagcctgccagacacactgtgacggctgcctgaagctagtgagtcgcggcgccgcgcactggtggttgggtcagtgccgcgcgccgatcggtcgttaccgcgaggcgctggtggccttcaggctggacggcgcgggtcagccctggttcgccggcttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggagcggcgtgtgagtagccccctccctcgggcctgggcctgggcctgagccgtcacctccgaggcggcctgtctctgcccaagtcgagtgaatgggccaggctggggtgttggccggggaggaaatggaacattcctgctgtgagcatgagacgtcgctgtccgagcttggcgcctaagccaagggtttcttctttatttggttggttcggattgggttgttggtttggggttttgttttgttggtgtcataaaagctgcagccaagaaatctcgtaattgtggtccttttcctagaataatgatggctgagaacctagtcttacgaatactgtcatagttgtgggtacatctggtgtcatagatctcagtagccctagcagtttaaagtgcgtagtgtcttcactgctgccatctagggactggcattccgtggcagcagctgtctgcaccccaccccacccttgtgtttcttacgtcctcccatgacatttttctccagtgagcaaatggtaaggcaaatacggttctgagttttgaaaatgttccctcaggccgatgcgggcagttcacttgaggccaggagttcgaggccagcctggccaacatgaaaccccatctctactaaaaatacaaagttagccgggtgtggtggcgcatgcctgtaatcccagttactcaggaggctgaggcgggagaatcacttgaacccgggaggctgaggttacagtgacccgagatcgcgccattgcactccagcctgggcaaaaacagtgaaattccatctaggggcgggggttggggggtaagaaaaagaaaactgccctctacactaaaggtcatcagggggatttgttgtgtcttgccgttcatgttgttgccatctcgtatttaaatgtaaatgcatgtccaagtttcaagtatattcacataggactttctctcctgccctcacaagggaaaaagacctcgatgaagttctgcagacccactcagtgtttgtaaatgtttctaaaggtcaggttgccaaaaaggaagatctcatcagtgcgtttggaacagatgaccaaactgaaatctgtaagcaggtgggtaacagctgcagcatagctaaccctaataaccatttataacgtatttgtagatatattaaacattaaaggctgtttttctggaggaaagactaaccaagcaataatgtgaactgcacagtgtcacttctaataataaagaacttggtggttttgtttgttttttgtggtttttttttttttttttttgccaaaacctcctgaaatcagattttctactaaattacctcatttttctataaattgccccatttatagaatgtggtatacctgaaaactgaatttgttttcaagtatttcatctttcagatccttttttttttgggtggggggacagagtcttgctctgttgcccaggctggagtgcagtgcacttcactgcactcagctcactgcaacctctgcctcctggattcaagcgattctcttgcctcagcttccagggtagctgggattacaggtgcccaccaccctgcctggctaatttttggatttttagtagagatggggtttcaccatgttggccaggttggtctcaaactcctgaccttgggtgatatgcccgccttagccacccaaagtgctgggattacagatgtgagccactgagcccagccaaaagattcttgcatcttttgggcaaagctcaaaccattacttacatattgatagctggagaggatgaaatttaattttctctccatccagttactcattttttatggttagttaataaatagtgtgtgatagagaaagatagtgatttcttaaatgtgttggcatttttttagattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcaggtgagtggtttctcatgtcatcaaaatatagccatggaaatcagttttctctgaagaaatcattaaaataatgggtctggggccaggcacaatggttcatgcctgtaatcctagcactttgggagccaagatgggaggattgcttgaggcctggaaacagcctgggaaacatagggacgccccatctctaaattttttttttttttttttgagacagagtcttactctattgcccaggctggagtgcagtagtatgatctcggctcactacaatctccacctcccgcgttcaagcaagtctcctgcctcagcctcctgagtagctgggattataggcacgtgccaccacactcagctaattttgtatttttagtagagttgaggtttcaccatgttggccaggctggtcttg

SEQ ID NO: 125541 - DNA, 1096 bp, Homo sapiens
tcgatctcctgacattgtgatccgcccgcctcagcctcccaaagtgctgggattacaggcttgagccaccgcacccggcctgtattttttcttgattgatttggattttgtttccactgtggcaaattagcgatgatgagaatgtatagtctggataacggaatggcgtatatggtgaaatataccaggaggtatactggcaggagcaagggactgggttttctcccccgtgcaagctgttcttgctgtgtttcttagtcatgcccttcacttttgaagatgaaccatgtttatgaaggtgccctttgttctttgagatgagtatgctttttttcaaaggattttcttcattgagataatttatgccttgtatgttccactgaaacaattactttcttggttaggtgactagtaaaaatgtctgtgtcttcctggttgcgacatacactgacggcctaccaactgaaagtgcagagtggttctgcaaatggttagaggaagcatccattgattttcgatttggcaaaacttacctgaagggtatgagatatgcggtatttggcctgggaaattctgcctatgctagccacttcaacaaggtaggtctatattgaattataggaataaattctccccataaacacacacacacgcacacacacgtaaacacacacacgtgcacacacgcacacacacataaacacacatgtatgtgaaataatccacaaactttggtagctagtaataaatacatttcttctattattttattaattgattgattgagatagagttttgctctgtcgcccaggctggagtgcagtggcaccatctcagctcactgcaacttctagctcccgggttcaagtgatttctcctgcctcaacctcccgagtagctgggattacaggcatgtgccaccaggcttggctaatttttgtatttttactagagacggggtttcaccatgccagccaggctagttgtgaactcctggcctcatgtgatccgcccaaagtgagccaccgtgcccggcctcttctgtttttttttttttggaaacagagtcttgctctaatccccagctggagtgcag

SEQ ID NO: 125542 - DNA, 1012 bp, Homo sapiens
tttggaaaaagtaaattctcgacatgagtctttccattagaaacttgagtctaaggagaagttatcaagaagagtctaggacaaggaccagcaaacaggctcactggccagatccagcctattgcctgtttttcttttgagacaggggctggtctgttccccaggctggagtgcagtagtgcatagctcactgcagcctctaactcctgggctcaagtgatcctcctatctcagcctcctgagtagctgggcctacaggcatgcaccatcatgcccagctaagtttttttaattttttgtagagatgaggtcccactgtgttgcccaggctggtctcaaactgctgagctcaagcgatcctcctgccttggcctcccaaagtgttgggattataagtgtgagccactgcacccagcttgttttttaattttttaaaataaaagttttggaagcatagccatgttcattcatttatgtattgtcatagctgctttggtgttagaggggcagatttgcatagtaaagacaggattgtatgccccacaaggtcagaaatacttacaatttggtgttttacagtaaaagtttactgacttcttgtccaggataacatggtgagattggactagatgatccctgatgtctcttctgtgtctaatattctgaaatttattggaaatgatgaggtaggagcatagggcacatgggcaatacggaacttcttgcaattctaggaaaatgagtgcatcaggagatcctaatactgaaggtattgttatatatttagacaaactggttgggagacactggactagaagatctaaaaatggactaattgttagcaagtatgtttcacgtggtgtacttgtctcttcttgacagcttgggcatgaggctgggatatcagggtggagttaactggcagagactttctgttgaagctgggctaaattaaagaacacattcatacacttatttctgggaacaatttattttgtcatctggaagcaag

SEQ ID NO: 125543 - DNA, 1031 bp, Homo sapiens
cccacaagattgaggctgcaatgtgcaatagttgcaccactgcactccagcctgggtgacagagtgagaacctatctcttaaaaaaaaaaaaaaaaaaggaagaagagacatgagagggcccaagtcacttgctcactcactttccgtgtacatgtaccaagaaaaggccatgtgggaaagagcaagaaggcagccgccttcaagacaggaagagagccctcaccagaaactgagccagaaccttggaattccagcctccagaactgtgagaaaagaattttctgttgtttcagtcccccacactatggcattttgttacggcagcctgagctaatactcctactttgtcctgcatttacttggtcttccagttagttttttagactttgggaatcagagcagtcagttgtcagattttagcttacagttgtcctacctgtgcaactgaaatttcttccattttaaaccagagcagagttttagagtcaaaagaaaccagatcttttagtgcagaagctttcacactgtattagaagtgaggaagttggttttgtgagttgcagccagcagttctcttatgaagtgcattgcctgcagttttgtgaaagttgtattcccagcttgtgtgtgtatatttgcgtgtactagattgagatataaagtatatttttgactgtaggtatggtaaaaaaaaaaaaaaatttaagtccattgtattgctcaaactaatcctttactctctcttagaacacccatggtaaatgatcatgttagagtttgagggtgaaggagcatcaggattatgaaccagaggggtcagacttcagatctagaaatcaaaacaccaaagggacacaaatagggaagaagagagtatggtcatctcttgtctttcagcaagcaacactgggatccccaaagagactcctctacagggccaagcttgtgtgatttatcacacctgtccctgtactccccaagtgccttgtacataacctcacctgctatacatgctatgttgtattataat

SEQ ID NO: 125544 - DNA, 1028 bp, Homo sapiens
agtcacatggtaacatggaaacatttaaccctgtgtcagcgggactgcttgagataaacttgacttgtcttccgggcccagcaaaactgcaggcccaagggaaaggaagctctcctgtgattgtagcgcatcttggtttgataggaagtcatgtctggaacatggaagaggtttttttgtgtttgtttttgtttttgttttcttgacgtgatagggagaaaagatcagacttgttcatgattttaaaaacattcattttttttttctagggatgtttttacttctgacttgacacatttttttctttccagtttaaaattggtggtgaatggtggacatggatcgattataaccgcttccaggagctcatccaggaatatgaagatagtggtggatcaaaaacgttcagcgcaaaggattatatggccagaactcctcactgggcattatttggtgccagtgaaagaggctttgatcccaaggacacaagacatcagagaaagaacaaatcaaaggctatttctggatgttgagattatctgatttcaaggtactgaaggacaaaaacttggatggcctcaaaaggttcttgaacaccactgtgattctccaaggacgaattacgtaaattatactttcatacaaaggagacgataaggcagtaaacatggagacacgggggacagcgtccacactcagagggcctgggccacagccccgatgtttcttttcagaactcagcccctttcctgattttacttctaagaggaaaattattttggggaggaactacacagtcgtgattagaatttatctgatggttttgtattataacttgtaagacctgccagaatgctagtcccgagagtgtcagacaaggaagaagtccctgggcctcttccccttacccggcccttagatttcatggagcagccacttagcattgaattgcactaccctgagctaaacgtgtctgtgctttctaagataagagcttgatccctttcttctatcttaagacagcacct

SEQ ID NO: 125545 - DNA, 1031 bp, Homo sapiens
ttgtgatttctttgcgcctccccccattacccccccatattctttttttttttttttttttggtgaagctggggaagggggcgttttctcctggttgggagaaaggagggaggaggggagagaagagggaagggtggaatagctctctgtattctgtatggggttctgttacagaaagggttaattataatattatctatacacatacataggcacatgtgtgtgtgtacatgagcaatttagttaaaggacagaaaaaggtacaccagggaagactggtgggagggaagaataaaatcctagctgctatctgaagggcttgtcaccaattgtccctctccctttccttttttgtgttttcttttttttctttctaagtgattggctttgtgtgtgtctatgtgtgtgtctttctttattccttgggcacctgcagcgttgattttcaaatgcacattttccttccagccaactggctcctagggtagggggaaagggaaaagggagggagggggagactgtccagggttggggggaaactgtctttgcctggacctgtctcctttggtgtggtattggtcattggcctctataaatttaaccgcctaatttcctcccccacctccctgtccccaccccccacacaccatgcacacacacacagaaggctttgagattctgcagagttggtccacctttcttaagcacaaaaccaagatacggtttatagttggcttatagtgtttcatgcacctgatgtgatggtttgaggttcctgaaggaaacttttccctttccatttttttttttgcgttattatggtattgtttcacatgctcagatgcaagctttgttaatgacagcttaaatctcacatacggtaactgtacaggtttagattgctggttctgtttatgtgtttgggtgtcagctttaaatatttttttcaaaggaaggcttcctatcagtgttgtccttttctgtgtgaactgcttttggtttgggctgctggtggtgatggtggtggatgg

SEQ ID NO: 125546 - DNA, 1011 bp, Homo sapiens
tgtgtgtgtgtgtgtgtgtgtgtgtgtgtgtgtgtgtgtgtgtgtatatctcacttatgcagttctttttgatggttttatttttaacaaataggtatttgactgggcttgtgatatatatctatttatttggcttttgcgagaaaatgtgctcattttaatttattttgtgcctaaaaaacttgtaattttaaaagcagaccaagttcaaaatgtacagttaataccatttctttctttgctctgattatttttttctgctacttttctagattaaaatccaggatattttggttagctgaatactatgtcaccttcatatctaaatatcatatgtctatctatgtgtaggtagaaaaggtctaacttttaaaaaagtttacttaaaattctgtagaaaaaattaaacatacagaagtagacagaacacccaacatccaggtttgagaactaccaactcatatctcatcttgtattttctatatttcatctatttcctctcccacatatgatctcatccatatttctcacacagaaatacttctgtatgaatccctaaaccataatgactccaaaaatcctcagaccccaccaaaacccgcacagcagtattatcacacttaaatgaatgtataacagttcactaatatcaaatatcctgtcagtgtttacattttaagaggcccaacttttgtagggaagccgtaaatacatttgtcagattaaaaacacacaatgggaaatagaaatcatcatatatgtctggttctttggcaaaaggtagttttgttggctgtgtgctatcacattgtgtccatgctggatggtcagaacatatgtgttagtgattgttaaattaaaacctctggtggtccactctattcagtctggaagatttattgaactatcaccaagaaatgtgagggcttattgggaacaggcaactaaactatgagcttggacaaaaatgtgtgttgggggagtgtttgtaaaagttaagaattattatag

SEQ ID NO: 125547 - DNA, 1487 bp, Homo sapiens
taaagccagcacctatgaaataattttgaaacaggtacttgaatgcctgatatcaactaagcgccataggcttttagagacaggctagtgagataggctgaagtgttccagaaggcttcatgggtggggaatgggacctagaagggtgaagtgatttggatatatggggaaggagttggagctagggagagcattctaaaggaataatgaaggcacaggaacaagatgctacatggttaggacttgggggcaaggaaaggctggtggaaatgagtacaaaggtggtaagtaaagagtgcttgttagtggggcaggagacctgtggagacccacatgccaggcttggcctgcctaactagtgtggcctttgaaagttaactttctaaaagcatcatttcctttatccattagtggagaggtttaaactagtttagagtaaagcttctcaagctggaagggaacatagctttacaggatgttcataaattgttttttagtctgaaacagagtgatctaccgccaaatagtttctgaaacttgatgggctagacaaaattaaatggatgccatgttctgtcagaattaaaagtctattgtgtgaatgtgaattttgaatatcagagaaggcaatgtgttgtgcctaatttcctaaatctattttgaccacagagcacttttattctctgcattgtaatctataatccagtatgggaaatactagaaaggatccaaaaaagtccctccagatcttggaatctggtgatctctgagtctggggtgagtgggctgatggtagacgacttggaaaaccaggcacagaagcttgtagtcggtgcgtgggagctgcttcttaagcaggagtggcaaggggagtgaaagtgaggaagatgtaaacagtgagggagactagtccatgtcttttcctgctcccctttcctgcctgacatctgcctttttactgattgttaccaaccccaccaggaggtgaatattggtgagtggttctcattaatagctctttcagtgtgatgatactagcccaattctgatgccaccaagctgcccttcagccaatgttttatcctctttgtcccttctggtttcatatattgctgctctttggcaacctgtaaaaaaaggttggttgggaaaggaggttgacattgatgttaaaacaacgatttcaaattatctgcctttggcttgctgtatatgaagtggtagttcaaaaaagggtcagaaccgctcttttgctgttacatagccaggaaaagctgtggaactgtgtttctgttgcatttttcactttcttttttggaaaatttggccatgggactgtaaaataaatgggtcagttccagcatttgacttctgaaagtatgcatagctttaggatctgagaagggatgagagaatttggaggaaaggaagggtgtgaatagtgtgtgtggttatgaattcaagtattttactgtacttactgagtt

SEQ ID NO: 125548 - DNA, 1487 bp, Homo sapiens
atgattcaaggagtgttgagggtgatagattctgagactcttctacaccacagttttatgtattatcaaagataaatggtgattatttagttttaaagaatgttaggattagaaatgaggtccccagatggacacaacaatagttgaggctagctattaggaataatttaggtctaagagctacgagatttggaagcctttggacgagaaggtctgtggcatttcgggtgtttgtgtatgtgtgcacgcacctgtgtgcacgcaaagggtgaaggatggtgggttagtggctttacattttattttattttacccctatcctgtatagtagtcataatatactaaatgcagcctaactttgtaaaagtgtttcatgctgtttttttcctcctcaagaagcaacttttttttttctttcagaattaggattaaacccaatatgctgcagatgtaggataaagaacctagtaatgggagagcaactgttaattttagaaagttctgaaaagattcaggtagatttgaaaacttagatcattgaagtttagaagagcaatatgataatgaatttggtaaaacttgagacaggagaagatcaaaaataattagtgagctggggcagaactgttttctcttatataatcagaacctgttccatgaatgtagacttttttcccctctgggaggtgaagaggacatagaatttaagactggtgagaccctaagtgtgtcttctttcttccaaatctgagctgtgttctccttcgtttcttctaacacaatagcagagtaatgatagtttctattatagctttgcatctgttggtatgcaattaatacatactgtgaggtcacaaagaataggccctttttatgctattagtatgaggaggggaggagtgagttttctagaatttgactgcccctgcttgtttaggaagaaactagacaagtacaggcttctgtgtcttagtcctgttcaggtctctgattccatccattgcaaggggctctggaccctgaaatcatatgaattggtgccttctttgaaggtgtttatttcatatattagtgtatgtggctctcttagggtccagttagattccccgctcacctgctgcccacctccctcctttcctccctttctctctccttcatatccttcttctttctctctcttcctttactgaggtagagctatcaaaattatgaatgctgttaataaaaggtaatgcatttaggacattgtgtatgaaacgcagaaattcaaaaatttttaaatttcattatttgaactgtgacaatctgcttgaggaactctaatttagctctctaaaggtgaattgcttgccacagttttcttggccattacagctcacttttctaatttctcagcttatgtctgaattctagttagtttgtttgccagagcaaaccttataaatgatcaactacatacaaatatttttaaaatgacttaactgtca

SEQ ID NO: 125549 - DNA, 1049 bp, Homo sapiens
ctgtgacactatgggcttcatgtttactttgggatctggtgggaagttcaagtgctattaatttttccttggtctgttttatgctttgtaatggctttctgtgtgttttttgggagttaagactagaaccttggaaaagagagagccagagttttctccctatatttctattttaaaacttttttttttttagacatgttctcgctctgttgcccaggctggagtacagtggcgcagtcatggctcactgcagcctcgacctcctgggctgaagtgatcttctcacctcagcctcctgagtagctgggaccacaggcgcgtctcaccacgcctggctaatttattatttgtagagacggagtcttcctatgttgcttaggctggtcttgacctcctgggcttaagcgatcctcccatcttggcctctcaaaagtgctgggattataggcatgagccactgcgcagcattttatttcttatgtattgttattctctctgtattctctgcctaaatgtaacccctgcactctttctgtatatatccttctggggatatttgaggctttcagaactgtttctttcttcactcagtaatctatgcatagtaggtactcagtcattgcttatttacagttgacaacaattccatgaaaagaaatttttgaagagggagctgctatttactattcgccttgtgccaggcattgtgctagcaattttgcattcgttatcccattgacgcaccccatgaaaaaaagaataataatctctgtttgatagttgaagaaactgaagcacagagccgttaaatcaacttggccaggatcagtataagagaggcaagaaatgtagcagtttttgcctgacttgaaagcttgggctccttatccctttactcattttcatacagatgcattttgtgaaagatggccacatggtctctagtagaccacatttgttcattgttgtgctgaaaattgttacaaaggattttctaggtataataataggatttagggaggggagagtacttattgtccaggtcttta

SEQ ID NO: 125550 - DNA, 1080 bp, Homo sapiens
attgtcaaaggcaaggattcaggctgatgatatagagggttattgtatgtcagtgtctgttctaaacccttgcactcatttatctcactgaattctaaaagtagctctctggaacacaaatgtaaaattggaatgaggactagcatgccctcacagattactgtgcatataagcttatattctgctatagattctgaagtattttgtcttgtctgcttttaaactgttctaggaagcagcacttgtcttgagaatctatttcacaataaaagagaccttgttttgagggctaggtgtatttttttaaaatctattaggaactctattctttctggtaaaagaccacactaaatagctctttttgcttttcttgatatctgtatcttgaagataccaggtgacaaatagtccattgatttcctctgtcattgtttcctttcattattctaagcagatttgcaaattgttctctcccatttcccattccaccctgttaaggtttgtttatgctacaaagagtatgctaatgaatataactgttagatttacttcttaaggaaatcccaactgcatttagagtactgtacatttttgagaaggctcctcctcatttcccctcggctaagatgggcctcctcacaggtcattctctgggacttcacgattcagaactggtccattaccattcatttacaaggaatgggggttagtataaagatacacacacagaataccctcactgggcctgaattttctaaagatttctagatgaatatgaagatcagtcaagttacacacttctctcaagagtcactctccgtctctttctttctttctttctttctttctttctttctttctttctttctttctttttttaagagatgggatctcactctgtttcccaggctggagtgcagcagtaatcatagctcactgcatcctgaaactcctggcctcaagcgatcctcctgctgcagcctcctgaggacctgttggtgtgtgtcaccatgcctggctaattttttaatttttttttgtagagacagggtcttgctgtgttgcccaggcattctcaaa

SEQ ID NO: 125551 - DNA, 1014 bp, Homo sapiens
ctattcatgtcctgtgcagaattcttttctaggatgctccctcaacctctgtttttctgaatgtgagcccaaagcaggctaagccaggaattattttatttgggggtcatttagatataaaaagagactaagtggtggagtcaagaaagtaccaggtggctgccatgttgcccaaatatttcctcccttgtacagcatctatctccacatgggtctcaagtccacctcccttcttcctttcccctcttagaagcaatgggattattgcagcctagaggctcagtggtaggtcctagaggccgagggaccatgtgatagagcctggaaagagaccaccccctgaatcctgccctttgtagttggatgttttttccccccacaactagataggtttactatctggctgtaaatattctagggatgcaacagttgtgggacatggtatgatttgaattttcagggtcctttttgtagttgccagtgaatagtaagtgaaatcgcagaatggaacatcattcatcaaatttaatatttcttctttggagtttaacagaaataatgtggatttggggactttcagagtgataagggactttggagatcctcatgggcagtggttttgggtacctcagggtacgctgagtcatttgaggggagatcctgactttattaaatcagaactccacctttacctgtcttctatatttatacttatgtattaggattacattctctttgagaagaaaaaagtgtctggatttgtttattctttcattcaaaaaaaatttattgacagcttctgtgtgctaggcaggcagtactccaggcacaggaagtaccatagtaaattagaaaaaatagatatctattttaatggagtttatattctaacaaaggatggggggacatactgtaaataaacaaatatataatatgttgggaggtgacaggggattttataaagcagggtaaagcaagagtgagaacttagcacagcaggtcctcaaataacat

SEQ ID NO: 125552 - DNA, 1005 bp, Homo sapiens
ctgtaccctctttcagaagtgctatcaattatgtgttatgtgtggcctgattatcctctgtgggccttggctccatgcagcacctccatccccgtctgcccactcattcattcaacaaatagttgctgagtttctcttctctatgccaggttctgttctaggcacttgggataaaaacagtgaactaaacaaagcttctgccctcaaggaatgacattctggggatgtgggggagaggtgggtgagtgggtggtgttacattctggtgtcgcattgttttttgatgtgtctaacacagaaaaagatgtgtaactgtaatcctcctttagaaagctctaggggagccatttggcaggtagggaagtgttttgcctaatttggcttaaattatgattttttgattctgaggattttgattacaaatgccttcatgaatctacttcttcaagagaaattaagtgctgagacattaaagcttccagggaccttttgaattggttggattttattagcagcttaaaatgagcatgacatacagtaaggttcaagcttaggggagatgctgaagaaataaggatacttgattttctttccacttgaagtggaatccactaatccatctgtgctcataaatttgagagaaggagggcggaaaacgaaagtttatttctagggctctctactgggcaaggctatcaggttaccttcattgaaaagacttaatcagaagtgaaacttaaatctgttacagtcttccacagctgtccagggaattgggcactgatgaataccgtcagatggacccctgaatagagggaatgccttagaggtcatgtttggagttagtcaataaaatggatctcgagaagaaaatagaaagtttgagggaaaaaaattactggaaaagaaatcttaaagcttttgggttagatgttagatggatgacgaaaacagtgggtgatatgatttcctttctggattaccatcttcatcagatattgttgt

SEQ ID NO: 125553 - DNA, 1071 bp, Homo sapiens
ataatgaaaatagggaaaggctcctagactgtgctgtggaaaaacacatgttcagattttactgaagacccagaatcccatgtggccacagataatttgatttcacagtttctatttctagatatacaggatggggttgccagcagaagttacatagtgataataacatatcagcttcctttttagggaagatattgtaattgtgagaaaaatattcagaaaagccttggccaaatattgtttgtagttggtaagagaatactcagttattaaagcttctgcgaaccttttccaaataattacactttttccctaaaggaatcctcccacctcagcctcctaagtagttgggaccacaggtgctcattaccacacctggatgggtggatggatggagatatatatatatttgtagagacggagtctccttatgttgcctaggctgtgttacattttttgtcacacatgttgggtatggagaatttggagtaggtagtttcagatttgcacatcacaagttcttgccttgtgcagtggtttctaaaccgagttgcatatctatactccatggtaacttggtaaacatactgattcctggaccctgtgtctgatctactaaacattaatccctgctctgtggctctggaacattagtgttttgttttctttttggggtttgtgacagggggacaaggtctcgttctgtcacccaggctggaatgtagtgggacagtcatgactcactgcagtctcaaactcctgggctcaagcagttctcctgccttagcctcccaaaaagctgggactaccaccaccacgcccagcaatttttttttttttttttttttttttgcaggggtagagacagggtttcaccatgttgcccaggctggtcttgaactcctgggctcaaggaatctagctgcctgggcctctcacagtgctgggattatgggtgtgagacactgtgcctggcctggaacattagggttttttgtttgtttgtttgtttgtttttaacatcaagttccagtatagaagtttcagaaacactatttcttaaaatatttt

SEQ ID NO: 125554 - DNA, 1091 bp, Homo sapiens
caatgaatgatccaatgaatgatcacaaagtgaatacccaggtaaccagtactcaggtaaagaaatagaacattgccccctccccacaaaaaatgatttttattagattcctcaaattttcttttctattcctcctcaaatcccaagaaattagagatataagtaaaggttgatgaaacaatataataaggtgtaagtgaaaaaagcattgtcttttggtaggtggtgtttcttaattactcttttcagtaagtttttggtgatgttaagtttgtgttgtttatctatgttttgattcagccttaagccagttcttgacagtgactgtctattaatgctcacagctgatattaagattacgttctaagatctatcttttctgcaatctgtttcactgaaaatattctcatgatagttttgaaaatgcgtaaggacagattatcttctgactctaataaacaagtgagtcttgtcattactgtccaggtaacttaggaaacctgtctcagtagccaggtatctttatctggtacatgataaaatgtggtttcttagttttttttaaaaaaagttccttcctcctctctatccacccagaataatctctcctccattccaacccaatcagaacatttaaagccctgatggtttttcttttttccactgaagaatcattcaattcttagtgagagaaggtctagctgtattaaatagcaagcttgcccattttctttggaaagggatgctcatggtaaaaggacctcaagcaaaccctgcacttaagctgtgtgcaagtggagggagagagctgtctgcagccacctgccagcagctacacatctgtgctctgctagcaagcatgtgggctctgtggatgtgagagctgctccctttcccctctctgcctcatgctcccccatcttagtgatcgccactatcaactaaacaggtgacaagactccaatcaccctgctctgaatggctctccatcttcccaaaagtataccagaggcctgttttgtttcagtacattgattaaataaatattcctgtgtgcacaaaggaactgaaatctgttatggcactctgca

SEQ ID NO: 125555 - DNA, 2553 bp, Homo sapiens
agtgttatttgggctgcgcacggtggctcatacctgtaatcccaatactttgggaggctgaggctggaggatcccttgagtccaggggtttgagaccagcctgggaaaaacagtgagaccctgttctataaaaaatttaaaaattagctggatgtggtggcttacaatggtagtcctgtctactcgggaggctgaggcagtaggatcacctgagcccaggagattgaagctgcagtaagctgggattgcccactgtactccaacccgggtgccagagtggggctctgtctcaaagaagaaaagaaaagaaaaagacagggaagggaaagggaaggagaagaaagaatgacaatggaacataggaaattagggttgtagagaagactctatgaacattattgtggtgtgaaggaatggcatgcagagataagtgtgatggaagggaggtgttgaaatgtttacagctcctaacatctaccaccaaggagggggcacccctttgacagaaacgagagggtgttcctgagtagttgtgacattaaaaaaaattgcagggaaccttgtagctgcatggatggcagagacacataagtagggaaaaatgttggaataggtaaagtgaaatctcttagtgtgtgtgtcttccaactgactgtgggtaattagttggaaatgacattaacctgagcttaattgtaattttgcatagtaacaacataccagctgttcactgtattctttcctggaggtgcgatttaattattattatttttttttgctatcttttaagctccaattttctgttatgttttacttaaaccccgcctggttgccgtgtccacagtccccacagtttagcagtaatgtcatttttgttgctttcatgcccactgtgtgctgagggcttgggatgctcttgattttgctaatgacttggatttataaagggccacattggaaggtcactgagaagcatgggtgattggaaaccttgtgttttgggctcttccacaaggttttagtttattatataaatcatatgcataattctaggcctatcagaggtgctcaaagtatcaagtgaacaagctgaaagagaagttaattactgaacagtgattgttctgatataaccaattattggatcattaaatgtttattaccttttatatgctcctttcccccataagggcagtttcttttttaagtcattaaaacagaaatgggatcttaaaaaaattctgcttaaaaaatttccacgagactgaagtattaaaaaggtcttgtgtgatctgacagctaaatagcctgtttttctttggtctgttgaattagtaattaatgaaatgtattgcctgagcagagaaaataagattagttttgtttaggaagaaaacaaaagcaaaacattaacccccaaatgcaggttaatattaaagtgcagtataagaaatagaaataaaacagtcttcttgaatgataagatgcctaatggtaacatttgtttcattcattcattcgtcactttcttgagcaccaacattatgtttagaaggaatgggtttatgtaaatacagaggaggcaaggtgccctgtccccaaagacacatgggttagcagagcagttaaaccagacactttaggcggccaggcacagtggctcacacctgtaatcccagcactttgggaggctaaggtgggcggatccctgaggttgggagttgaaaaccagcctggccaacatggagaaaccctgtctctattaaaaatacaaaattagccaggcgtggtggcacatgcttgtaatcccagctacttgggaggccgaggcaggagaaacacttgaacccaggaggcggaggttgcggtgaactgagatcacgccattgcactccaacctggacaacaagagtgaaacgccgtctcaaaaaaaccccaaaaaaacaaacaaaaaaaaacaataaaaaaactcagacactttagtagctactgttgcaatgtagaaagtggtaggataataggtacaggggcatttctttggggaggagtggttatgaagacaggttacttctggaggctgaggcatcctgtggattaagagtaggggagagcatggttatgaagatgaatcttgctttttgaggtcacggtgtcctgtggattgagtagaagccccattacttgggttcacagcccagctttgccactacctagctgtgtgaccatttatctcagtttccttgtgtataaaatggaataatagtaatgcaaccctcacaggtttgaggattaaatgagttattatatgtgaagtgcatataacagtttacagcacataatgaacattataatcttaggttgtggttatgtcatttttgtgggataatgtgatagaacttcttaggggagattgcatttgattgaatgatgaggagcggaaagatgtttcaggcatttcttgtattgtcccatgtagccacatacctaatttataatgcctgcagtaatgtgtcggtaatgtgtgcttatgtagtgccattgtcaaaagattac

SEQ ID NO: 125556 - DNA, 1790 bp, Homo sapiens
atttttaaaatttcagttttgtgggacagaggaaattgaggcactgaatcaggcaggttatgcccagtctctgtggtcaccaggccttaaaattgggcataatttatacccttgaagatgttgcatggcaataccttctggtgggtggatcacctgaggtcaggagttcgagaccagcctggccaacatggaggggaaaccctgtctctactaaaatacaaaaattagccaggcgtagtggtgcacacctataatcccatctactctggaggctgagacaggagaatggcttgaactctggaggcggaggttgcagtgagccgagatcgtgccacttcactccagcctaggtgacagagcaagactctgtctcaaaacaaaaaccaaaaaacatatttctattgtgaaacaaaattttatccatgtcaggaatttcctctgaactagagtatgttcattcctcttttgtgatttgagtctgtgggagtcggaacttgtcaggaagacttagtgtagctgtgcttctaaggatgtgctattctcacaggcagccgtgctaaccatcttgctgtaaactagccacgagtaaacgtctggttgtgaatcacagcgtgacctttcagggaaaacaaaacaagcaaaccaccaaacacatgaatcagattttctttagtatcaggattgtaaagtctggtatttaacagtttgtcaggcccacttggagcagttgagacaacttcctttctctgtttttgtttgttcaagatgtggaagtgtatatccttctttagcaacatattaggataaaaactttaaagttttcttccactgagttaaactatattagttttcctaactgtcatggactttaaacaattaaagattcctggttaccactcaagacctactgaatcagtctcttggagtgggacccagaaatctattctgaagagcaccctaagtgattctatggttaatcagatttggaagccactgagatacagaatgataatattgtattttctatccacccatttattcttttttttttccttctctgtggtccgaatatccatttgttcttactcatttatccacgtcttgagtagattagaattgattacctatagggcattggtcattttaagaactaggcgtagaaacaagaggtagaacacaatgcctgccccatggggttcacaggtggtctcagaagtttttaactttgggttgagtgttaaaggattcacatacttcccaaaagccaggagcagaagattttgtgtacacacttttttttttttgttttaagctttcatcagattctccaaggggtcagtgacccataaaaggttaagaaccaaggtcttgtgcttgcacagctgttctggaaaaagtagaagagggcagtgtttctgttgccacttaagatgtttttgaccttttgagaggcaacagcggtttgaggactgtacctgttttctgtcctacttaaaatatttaaaaagaagaaaaaatagtttaacatctgggtcagggtcagaacaagaccaagggatatggaaaatagttatttcgtgaactgcatcacatttaatgttaaagagctgctgacagccaaacagcctggtggttagcgtgatggaggaacttcttaagctggatagcataggcaaggttcattccagttttcttacagtatataattagccaaattatggataacaattttcaccccatggatatacataaagactaattgtcttatttttgttccattttagccccag

SEQ ID NO: 125557 - DNA, 1031 bp, Homo sapiens
gggaattcaaactgggtattggtgacctttgagggctctccctcccaaagagactatgagtgtgtgatttttcagggcaaaatgttctaagtaaatcaagtcatggttcaaagtctagatccgctccttgtaattttttttttttctttttaaagaactcagtcttgggtgctgtttacttcatatttaagcccatggtccccatgtgtattgaactggcacaaactaaacttgtctgctcctctaggtctcttctcatagtctgagttcttaaaattaaggtcagttaaaagaagcaccttggcattttccttattggagtttgctgtgtgtttgcaaatcaaaatgggaattgattcagtcatttgggctatacaggttttcatctcaagtcacttaagtgaaatccataaggaaagatgttcatgctttacctaccatagggctcactcacctcttttcttaaatacaaaacaaaaagcacctgccagttttaagggactgaaaaggtgttttatgatggctgaaaatacatctgagaataataatatagttatacctagactggtgatacatcattacagtatctgcggggaaaagtagagggtggaagtctgtatgtggggtcagtcttaacaaggaaagctgacatgaatgctctagccctgcagtaccagagggcacctggattaatgttctgggccctaattcagcgtcctgtctctcagacacttggcactgatttgctcatctcagagctgaagtcttaaggactaagaggagagaggaacacatcattttctctgccagaggaggtacttaaactgggaaaggaggaggagaccttaacaaatcaagccttggcaaggaaatctgtcatgaatcagcaatgccttggaaagcctctttcgctgtattttacaaagctaaacacttgtcgctactgacatttctctattgcttaccttgaggatcagctttaggtagcactatgaatggaatgaatccttttttgtgtgtgcccattttga

SEQ ID NO: 125558 - DNA, 1420 bp, Homo sapiens
tcttaaacttgcatttcttttttccttactttctttctttctataatattttcacctatcctatttcattcacagtggaggttttaatttacttcaagcagtattgccatctggatgtcaaaagacattgaattgacttcttatctgtagatcccaataaaggtctcacctgcctagaaacaaaagatttagtcaggaattgaggaggagcaaagcaaaggcttcaccagaggcccaggtgctacctatctgcccacttgttctttgattgacagtggggcacagaggtgccttgtgtttctctaggaagtagcttttgcatacagtgtttgtttggaacttttcaatttgctagtgctgaataatgtctgcagtaaaagttggtttagggtaaacccggagaaaggaattaaagagaagttttaacatttctattgtttttcttctgtgactttagcctttcccccttcttagtgaattattatagagttttattaaaatgtaagttctggaaattagacaccatggtatttagaccagcatgggatactgtactcttaggttccataatatttcatagtacatctctttattgtatgttaaatgatagcgaagtataataaaatgcacctagagagtacttatctattttatgtcctgtaacattcagtacttgatgcaaatgtagcagatctcgattcaaacaggagcaaaactggttataactcaagagaaaggggataggctcatcttgatggaaagttccctgttggtggcataagttcagcaaaaccatagaatttgaggctctaagggacctttgtaacatctactccaatcttttattttgcagatggggaaagaattagccactggttcagtgtcactcagcaggttaaagaaagacctgtgggcagaacctagaacttaacgcctgctctgctgtgtcttttcattttctgatcacaattgaagcatgtggtctaccctgtctttaaaagagcataccatttgatgtttgttagcttgaaacctgttgtgcccaagggcacctaaaggcttccgtcttgctcccttttcctggatgcccaggtcattctgtgcctctgagggtgggtttggatatggctgaaatgaaagctgtgttgtggcagtgcttagagaattgtctctgatgataggactcttttaagaaagcagtgaaaaagcagtaaggagactgttacttcataaaacaattggctctggacttggagaagacccaggtggcggatggttacatcccttggcagcagctgtctttgctatatctcttacagtcttagagatctgggagtctttggctcttaattttaacctagattcactgtatgatcttggtcaaacgcctcacctcttgggcctcagttaccttgtagta

SEQ ID NO: 125559 - DNA, 1051 bp, Homo sapiens
acacctgtgtcataggccttatcataatctgctttgtatgtgaattacttgagggcaggatagagttgtctttgtccctgtatctctggggcctgcagttacagcatggactgcatattcgctgctttgtttagacttggagcaagttattggactgtgaaagctactcactttaagtaaattcagtaaataaaattatgttttatggaagacagattggacaggtggtggtattattagcattttctctcaatgcttaaatatgatttacatttcaagatttcagttacattttttaaggaattcaacaattctgcatcatgaagtattctttcacacaaatgttccatagtcattagtttttacagaacccttttcttatattctgcatttcatctggaatactataagcacaagttcagtttggcattctgttctccactagtgattgagtttgaagcccaaggtcaggatattgattgatgacatttccctttaaagtatttgtatccatttgcaatttggggacagagtgattcccagtatggtgcaggaaataactaaactggaagtcagcctgactcagttttgtagttaattttctttgtgaccttgggcaagtcacttaaccttccaataactgagggagttggcccagaactagcacagtcttctaatgcagacattccacgattctctagggaggattcacttccatagaggtttaaaagtggatacatttttaggttaaatggctttgttcatttagtttttttctccttaacccattttggagcaataagactgtcatggagtaaaaccaaattacctggaactctcaaaaggctgcagttcttatcctattttttttatttttaagggaagggaaaaaaatggcaacaaacaaatttatatccatgagtcaggacaaatccatcccagttttctaacatacacagtgtacataaacatattcaatgaagcactgcagattcttaaccgaaaatggaatatttggtttgacttaccatcctaaatgtgggaagaactg

SEQ ID NO: 125560 - DNA, 1218 bp, Homo sapiens
caagatgttgtcctgggctggggtctcacttacacgcttgactatggaagcataagctactgagcccactgtgattgttggtggaacttatttccttgcagctggaggactagagggacttaatgtttttgctggctaggggctgccctttgctccttgaggccacccacatatccttgtaatgtgtgcttccctaacatggctgctggccccctcagaagcagcaagggagagaacaaggcagtgctgcagtcttttggaatgtaatcacataatcatgtatacataatcatgtatgtccatcatctttgctctactctggttaaaagcaagtcacaggtccctcccacgctcaaggtgagatgatcacacaagggcattgacaaccaggaggcaagggtcatgggggccgtctgaagcatctgtcagccacaccatatttcaggttttttttttttctgtatcttcctttggatctgtgaataagtatctcacttcatactaaagcctcaataaacactgattgacagaaagtctttgtgctcatttaaaacttctcagctccacagagtatttgtaccatgcccttgttttatggagtccccagatactgatgagggcagggtttgagtttgagggctgttcattcttctgcccgccaaccccccaccccgcccccagcacagaactgccagtgttaggtgctcattaagtgtttgtcaaaggattataactgttgttccaattgcagcagtaagtaaatttgaagaagctccctgatattgagtgaattgtattctccaccccccaaattcgtatgttgaagctctaacctccaatgtgatggtagtcccagctaccagagaggctgaggtgagaagattgcttgaagccctggagatgaggctgcagtgagccttgattgtgccactgcactcaacctgggcaacagagtgagaccctgtctgtaaataaatatgtgtgtacagacatacataaggttcacaattcaatttaaaaaagagaaagtgaccatctacaagccaggaagagagcccccaccagaaccctatcatgctggcaccctgatcttggatttccagcctccagaactgtgagaaaatcaggttcgcctgtttaagtcacccagtctttggtatttcgttatggtggcctgagctaagacaggccctgtgttctctgtgtagcaagaggcag

SEQ ID NO: 125561 - DNA, 1041 bp, Homo sapiens
tttttttttctccttcttcccctacctccttcctgggcttagaaatgctggaaggaagaaggagggaccattagttgaactaagaggtatgttgtttatactgttgttgtggttgtccctgggtggtctgaaattttggaggagggggtagggaaaggccccctaaaccttttttaaactagtataatacaacctgactgctacctgcagtttcccaattacccaattataacacaaatttgcacatttttttaaaaaagcaggctgctactgtttctccttatacaaggattttagtcactgtacatcttgtgtctttaaataatgtattaggaacattttcaagtctgtaagtgcttttttaatgagagtgtgaagattttaatgggactagattgcttttcatgacatttcagagtgacttaattgtaacaatgttgagaggctgtattttaaagtttgctaagtatgtctgtgtggattatagtcagacacttaaaaggacggatggttggatagtggaatcagatagcttttccttactactttctccaaatattagctctttgcaaatatggttataccaaaccaggcacaggtcaggattctcttaaaccttttaattttcagataggaacagaggctaataacagaccaatgtgggtaattttagagacaatttccttaaaacttagttggactgcaatattggtcctaaggcctctcctctctccttttgtagacccaggaggccaggctgtctttgtgtatacttcctgttagtccctgaactctcttccctgtttgctttaaaaacatagtgaccttgaccgggtgcggtggctcacgcctgtaatcccagcatcttgggagggcgaggcaggcggatcacgagatcaggagatcgagaccatcctggctaacacggtgaaaccccgtctctactaaaaaaatacaaaaaattagccgcgcgtagtggcgggcgcctgtagtcccagctgctcgggaagctgaggcaggagaatggcgtgaacccgggag

SEQ ID NO: 125562 - DNA, 1027 bp, Homo sapiens
gttgtaagtctttgagttggccacggaaaggaggatgaggtgactctgctcacagcgccaaaggccaaaaaaaaaagcatacagtgagactctgacaaagcagcaaacaaaggaggcacaactggaccacgggttgttggcaactgtttcgtatgtccactctttaagagttaaggaacagtatcatccactggaacacaaagctgtatgtaacaggcaaaaggaggtagtttggaacccagctcattggactacagaaacacagtgtaccaaaagccaatgcagtttgctggatgcctcttgctccccaagtacctagactgtaagacaaactccgtttttgttttgttttggctgttgttagggtttccagcttactcaggaaaaccagagaggtccaaggtatctacaggtccgagacaaagtgtagtgaaaaactggctgattttctaacagcaccatgtacacacgtacaagaagagacattaatccacagctccgctcagcaaatgccatggaaaatgactggtctccagtcttgttcatttattcctccatgggttccagcctaaatgttgctcctacctacttacttaaccatcttggagtgattaaaccctctccccagccatccaacttaaatagcactaagttcttaattaaaacacactataaaaaatgatgaacaaccaaattcaggtgctgcataatttatttacatttatgtaacagtttcccccaaggaactcaaggcattttgcaaacttaaacctatctggcagatattaatcttcacaaaatcccacaagaaaggcaagaatgtaagacgtataatcaataacaggtcccttcacacatacacatcctccccctacatgactgtgcatcactctaagtctctctgggtcagagatctaaattaatttggaaaattataccaagtacaggtgagatttctcaagaaacctcacaaaaagaagaggagccaaagactgttctactacactatgaaaaaagttactacatc

SEQ ID NO: 125563 - DNA, 2149 bp, Homo sapiens
ctgtgtgctttgagggcccggatctgctcttcctcatctttatattccctgcccttagctgaggctctgccttggtcttctgttaagtgtgctgaaagggatacttttttaacctgaatcttttcttaaaacctaattaggttataggccattgggaatgcagatttggttcagagtgaggagttggaggctgtgttgccctagtagtgtcgtgaggactgcctgggcgtgactggtctgagacagtgtgaggaacggggtgtgaaacaaacttatgacatctctggcaagtagtgcatactctgctgttgacacctttgatagctgctaccctctgataaccagtgtttttttttctggatctctcattgaactctgagtttctgggaacagcagatttttctgagccacaggttcagatgtgttagcagaacctgaggaaatgtttcttgcaccaggaaggtggccattttactccgtggctaatatttggaactagtcatttctggattgtttgaactagcgtgttctggggaattccccaaagctggacgcacttgttaaatgaggttatggctctgtggggtgagaaatagacccgcctactatacttaaaaggactgactgtgtttctgccttcaggtaaccagaggtagttatgaatttgggtgaaacctcttcatctcatgatagactagcaactagaggttcagagaagttacacagaatattcaaggttgattcagatagtgactgaattgggactagaatccatggtttctattctgtggattttgagtaagatcactaatcaacatgtgaaatcttccttgtgtcattcaattagaatttaagtgtcaaatggatggtaaaatcatttcttagcttatgtagatcataaagattagcaaatcaaggcagaaaaagacccccacacatatttgttgccaggtctgcactaatttctggataaaggttagtatatatttggtctacagggtgtgatttgagtgtaagttttttctttagtttttagattattgttcaaagtccccactgacagaatgcagggagacagccttgattagattaggccagattagattaaatcgaatggttaaggcctttggagcctccagcttgtaggagacaccataatggccttcatagcgtccttaaatcctattaggtaagttaatcttattgaagatttcaggtctgcataaagcagtattgctcttatactctctatggtgggctctgcttgttaaggtgagcaggcattttaactttccgggaataagttggttttattggtttggggcaagttaatctaaataacttgaaagtagacacctgtgcctgatagagaggccattccatgtagcaaaataggctgtctcctggcttcccctttgcttggtggctgttagtacctgtgacagggattttttttctttgccctgatttggggaaagagagtcaggtgagatgtgtaataataatgtacggagacagtagtatggttatgacactgaggcactactagatattgagaataaagcactttggaacttaggagctggaagcattcttagctgtcattttttgagtgtttatagttttattataggtgctagttggctcttgcctgtttctacaggtgcagtgaccatttttctgaagcaaaatattcttgttgtcacaggcttttcctcaatttgtgaatttatggacctgcaaagttttacaaacacatgaattatgtcaaattttgtaatgtcttttgaaaaaaagggggaaaagtgtaagaaatttagaccatgtaggtctgaaagtatgcttactacatcgatagtgggggctggaggaactgtgaaaaaagtaatagtaaatttccttttttagatctttgccaaaggtagttttgttagatataaacaacttcaagacccacaagtgactactacacactggattggccttcagagatactgggattttctttccaagtatctttaaaaatgaggttcgtagtgctttagctaggaggctgagtgcccactattaagatcctgtgagttaattggtttggttcacaaactaactcatattgcagtgtatctggctgttttgtggctgggagaag

SEQ ID NO: 125564 - DNA, 1048 bp, Homo sapiens
ttatttaacttttctaatggggcagctctgcatctgtgtcctgtccccaaagactaaagagaaatttcaggtgtgggccagattatggagcctgaagaacagttttatgattgattaatggttttgatttgcttttaggaagaaaagtgcaactagcccattggatgaagatagtatctctctccagcactcctgtatcaagtgtacagtgttctcttcctgtatagcacttgtattttcaagagctagggtcattgagagaacacttctcactcatgagtttcagagcgtagcagagtacacacacctgaagcaagaaatgtaattttctctaagtgtactaagaattactttaattctctgtatgtgcatgcatgtgcccacataatggtggtgggtttggttttttttttttttcatgctccttgaggagaaataacccgttttttgcttttattgattcacgattacctacttttcagggttacctttgttaggaagcagctgctggaagaatgtgtgctcattttgtacttgtgtcctttacttctatgtcctctctgacctgaggctcaccctgcctgccacctcctctgcatcagcccagctttgttcttctgggcctgttgtttccactctatgaagagacctccttacttctctctgtctctacttagtatccatttctgctgaggcagatccagatgggcagaggttggggagggaatttgaatgaggggaaaaattggatcagttaggggaaatttataaaacttctgtattctgtgctaatagttctcagatgctttggaatcataagacgggatgttggtctggcgacctttgagagctgctcttaaccagccagtggacagctatgcttgctttttcttcctgtcaccatctctgcttttcttgcccaatttgccaggaagagtccaccaattcttcataagcccactttttattctctcttttgaagtcatcttgattcacttcctacacctgcagcccccagtcttgcttgatctagctcctaatcttctgc

SEQ ID NO: 125565 - DNA, 1006 bp, Homo sapiens
cccaccccagacctactgaaccagaaattctggcagtgcggggcacagtaatttgtttttacaagtcctccaggtgattctgatggactttaaagtttgagaaacactgagggtgtgggaagggtaatttgggggaagggaagtggagtcccctcttggccccacccagagatgagcttctctgtctagtggtgggatagttggcttgagatgtgatattgagaatatatgaaggctccctactgggtcaggaagttgggggagtgtctcaggggagggccgtgccttcctggggacctgtttaggagaagggtcctgggcagtagcttgttactagcctttcgggaacaatttcaatgtttcagtcaccctctgggctgttgtactattgcagtcagccctgctaggcccacaagttgtatggggcagaggagaagaggcatggggacagaaaccttatatcccaggcaaagccttagcaatgctgctgatgtcatatgctcatcgttgtcaagaattgaaaattaagatagtgatgaggtggtggcaggacaaatttcttcttttcactgtatgtcccctttctcttctggatctcatttccctgcctccagctatcttggcagatgggattatttaataattttcttggggcctgttggcaaatggcccctctgccccttccccagtgtgtggtgaccacaacagtgacatagcttcatttcacagccattaggaatcttgacgcagctgacccctagatctcctggaaaggcctcttgggaaatataagcttgccaccagagtgaagtgaattctcgagtggtattaccacagaggctcaggttcctgatgctccttggagtgctaggttaacagtctctctgttggggaaaaacttgatacaaatagaagatttgctaattttgctcacatttcaaaattgtttaatttgcttactttttttttctctttcagactattgggttttatctatcattccttt

SEQ ID NO: 125566 - DNA, 1049 bp, Homo sapiens
atgcagataaaacctagtgctgattagaggtgaccctctaataaacctgatttgattaggcagaaccagcgaggtgcaggcaaatatttgagactctggccaagctgatattccattgacctttcacttaggggaaaaaacctgtttgatttttttcctatcccagagtacttgaaaattattacctatggcagctaaagcactagggcgaaataaacaggtgagacctgtggacttgcccttaagagtcgcagtcagctaccacctgggttgtgcttgcttcctggcagatcagtggagaatggattttgccggaggtcctggcctggaatgataattaaaaaggatgtttcagaacacacccaggtgcgttctgataaagcctgagcagatgtgggtggtgaaggattttttttttaaagtcaaactttgtttataaaggtaacttctaacaatttattatagaaaagtcaaactagaattgcattagtttgtttatatcaagacctcattagaaattaaggagaaatttccttaattgctccatctctggctcctgtaacagtgggcatacttctcttcttagcatttatcacattgttctgtaattgttggtttaccttcccttttgtcttaaaaagcagggaaattgtataattattcttgatgttgctcaaatgcttggcacctgggccaggtacagggattggcaaagtttggtccacaggccaaaccaggccactacctgtttttatgcggtcatgagctaagaacagtttttgcctttttaaatgattgaaaacaaatcaaaggatatatatttcatgccacgtgaaaattatgtggaatttgaatttcagtgttcataaataaagttttattggaatacagccatgctcattcatttacgttattgcctttggcatcattttgcactacaacagcagaattgagtagttgcagcagaaaccatatggcctgaatagcctaaaatatttgctatctggcacttcacagaagtagtttgttgatccctttcctattatata

SEQ ID NO: 125567 - DNA, 2999 bp, Homo sapiens
acgctgacaatcaaagcagctaaacaagaagcaactcaggaattatgacattggcggcaagtcttttgcccctcttcagaggtaacactactagatctggagagagttctgtacattcagggaatcttcctgatctctaaaaaatttgagaggactagagaggagtaaagactggaacctggatagattgatttgtgagggacaaagattcagagaagacattttcttgaaggtgatgaacctgctttaccaaaatgttgtaaaaattctaaagaaaagttaattggatcaagttgacaataaatgttagaagggaaaaatcttaaagggtaaaatttgaaagtagaaagtttgtcctgtccacagtgtttgccatttcatagaccaaggtggttgggggaggtggggcaaaattactgtagtttccagtgatcattgccttctctcggtcctataaatgcaggcactatttagcactgaaaccatctggtgttggtggttgtttcttatgtcgtatgacctgcctctataaatacattgtgtataagcttaactgggacagtaattggtgtgatccttttctttttctgatctctaaggtctgaggcccatgaccaagggaaagagaagtgctttttaaaaaaacggacacttttgttgttttggtctcatggtttcactgaggtagtgttccacagtgtaagacaggttaggattgtatgttccagaattatgaacaagagtatccttgggaatgataaaaaccatgctgcagtgttgcatgtgtatttgtgtgttccatgtggaagaccttctgggctgtgtctgtctttgctatttatttatcacctgaaatggtgctgctcaaccactctgtgacagtgttattttaacttgaaatagcatgagggttaggagaaaatacctcatgaatgtgaagggggattctcctgggcgtatgtaattgcaatgatttgaaatgctttcacaggtttgtaggagagggtaatttttcttctttatttgctccttttatcttgttctaaagccagtattacctcctctcccaccgcccatgtatacttcttattcccttctccttccccctccctttctcccactctccatgtaaagaaactctttcctaataagaatcataggtattcagagctttttttttttttttaattaacagttgatttgactttttagtactgtgtaggagatgggaaaagtcagggccatttgatagtaattgcttcctggaagagccgaccaacttattataagggtgaggagtgtttggaggcattattttctggttccaggtgtgttttgagtattgctggtggtgctcagcactcttgacatttggggctggattactgcatgttgcaggagtatcttgtgtattgtaggatgtttagcagcatccctggactctacacaccagataccagtagcacccctcaagtgtgacaaccaaaaatgtctccataggttgccaagtgagggacaggatcactctggttgagaatttctgccttagaaagaggaaaatggattccctggaagcagaggttagccattaaccttatagggctggagccttcatttaaatgctttggtatattgaaagcaccactcaagtatcagtggtgagggcacatttagcttgttgaaattcctgtgtaattcataaatatcatattagctcttggcttcaatttcctaacactagaaatgtagatttttccccttattttcaaaatgaggaggattgtagtaaaatatagtaatctctgaggtcgctcccaacccttacattttatgattttagttataacagacatcttatggaattacacaatataagagttgaaaatgtatttgtgatcatttagccagccctcttctgttagttctatcccgtgtgatttccacaaatagatcagaccagaagaaaatagttgctttttacaagtggatgttattaaatgctcatatttagaatatttatcagaacagacttatattacagtgtttacttttctaactgattgagattcaggtgacttaactgcctaagcttcaactgtctgttgtttggaattaggcttttaaaagttggtctttatattaatattcctatgcctaagctggtactcttattgtcaaatagctttatgctctgttacattaatgagggaaactttgactttccagagtgccttggctgatatattggtgttaaattggtaagctttctatcccaactgctttatttatgctttaaacataaatgaaagcagagaatttttttttttggcctgagaggtagttaagagggaaatctaataccttttatgggtttatatgcttcatatgtgatgtgcccaaccagaaataataagatacaccccagatgtgaaggtaccagctaatataattatgctggagatcattttcaccttttgagggctgaattacattgaattcatttcttcaactctaacaggatttggtatagttacttaaatttgaattgggagctgagatgaagtcccaacacttgtgcttttactggaaggattgggttgtgtataccttttgtatttctgaagcttgataaactataaagccttgagtattcaggttcatggcaaggtttagatggatggggaggtatactctagtagaatctaacagcttagtatgctttctgtgggctcttgcctggaaacccaatctgaaggtatagtgatcagacacaatgctattcttaagccttcttggaaataacaggtgtcttagcctgtggtaaaaaggtaattttgcatgtattaaatattcaaccaagggcatgatctgtgcttattttggcaaacaaatagatcccaaaatgaatcaaacaaattgtaatgcagaacaaatttaaatacttgaggatttgttttagacatttaaactcatattttatcctctgtgtcttcatagta

SEQ ID NO: 125568 - DNA, 1077 bp, Homo sapiens
cactagactgagcttaccttttaggttgtatgacacttgatataagctgtccttacaggtttaaagctgtaggagtctggaatgcaaaactgaaccacagaagtatattggccttgcacttacatagtcaggatcatacggcattgtgatctatccagatttccagctgcagtcctgatgtggtctcttcattactttgtccagctgtttcttcccagacggtgctctgtgttagccttcccttctgtataatcattctcttccctaaatttttctgtttaacttgttaagcaccagattctgaataaattattcatataatcagtatttttgaagtagttaataatcagagtataataataaattttatgattgtacaggttgccatatttgccagaaatcagctttacacaagtgatttttgagataaatgctttattgggcatgttgctatctgttcatttcttcaggctctcttgatttctattattgtgtgaagttaggccattagaaatgcgcatacctggaccatattatttaggctcttcagagaactgccatcacggagttagagtgctatgtccttggtaaatggaaagtaagagccctcaatttaataatacagtattttatagtcaaataatacatctggcttttgtaaaaccttaaaagtaatctggtatcttaatgtttcattatacatatgcatatatgtgtgtgtatactcacatgcatatatacagacatacatatgtgtacatatatttacacatatacgtacacacagtcatacacatataaaaagcttctctaagaatttggagcgaggaaaaaatgtctgtcttctgaccaacatgtatacattcttctaactctcatgtgtttgtttagtgaatgaatgaatactatgtaattaggtaagagaactattgccttaccctggaaattcgaatcgtaattcagtaaacaattttaggtacccatcctaagtacttgttgatcaaatactattactcttttgcttggtgagtattatttttcatctacttttaacaggttcttctttggttaaaaact

SEQ ID NO: 125569 - DNA, 1035 bp, Homo sapiens
ttattacctttctgaatgtgctctctgctcccctggggcccattcccaatccagtagcggcaattaccattgggataaacctcctacctctgaggcccacagttttcctgaccatctctctacagcctcacttccacctctacctctccataaaacaatgtgtatacttctgttcatcagctaaatcactatacctatcttacttgtttttctgatgcaacaagcagccttccaaaaataccaccaagtctaataatccttttgctgtttagtacatcttttgtttgaggcttactgtcacatgacagatgatgacaggcaacaaatgactgtttaaatggtcaacagatgtgcccatccaggtgactctcctaatagttgacacacagtgggtggagggattgggttgttccagatattccctgttgttgggctagcttgctcttggtgattatagtttgacttattttgcttttattcagtttttgtggttctgttttgctacttggttttgatacatgtaggtagtgtgggttccattttggtatgtgaaatttcatatcatgaagaaagttatgattataatgtagcgttagtaattcccagtggtcattcccaaaaaatattttctgagaatgccaggtgtatataaaagttatttttgaaagtacacatgtagtgtgccacaccctctatcaaaacaggcccacattactgaaagaaggagggaaactacccatccactattactttacagtacttaaaatatgcagacaaatacattttagcacgtggtgatctttgtgaggatatcctgtcaatcaagagagtaaatatcttttctctttcccatgaacctagcaaccaatttgcttatagttccttcaaagctgttgttaagattattttgtggctggttatgtcacttggctagaaaaatggtactggaattaagtcagctttagccctatgctgcccatctttcttaacttatggtcagccatatgtttagaccagatgaggtaggaggtatga

SEQ ID NO: 125570 - DNA, 1065 bp, Homo sapiens
ataagggctgagaatctaatcagttatttttaatttattgggcaaaaatgaatcaaataaccgtggcaggcataatgaaattgaggtattcagtgtgtggtgaggatgaactgttttatcacagttcctctggtgtggcctgtgtgctttgattgcaggtcagatggctagggaaaagagtagtcaagctgaatgctctgtggtgaggctgtgagagggacaagaaacgtgggtcaggacagaaggcgtactgcaggaacagattccgaagtgtgtgcacagcatcctataatttgggctcctgtgtattttctttagttggttgcatttgttaatatgttagtctggtgtctttaaccctgtgactgacagttgacaatggtgtagctctttaaaagaggtgaaactggtctgaccacagtttacccttgatagtgctttcactttggcaacaagacagagggagaaagtccctgcttctctgctctgggaatcttaccaaatcaataaggagtctctggtagcactaacctcttttaaatagcctaagtgtgagatcctgacctttttttctgtatgtggcctacttccttgatgagaagctggcttttatattagaacttttttagacgtacatgaaacttgaatcttgctatttgtttccattgttgcttttaaaaaataattttacaaatttattctaataatatactaacgtattttgtctccaggactagtgaaactttttaagatttttaacagattcatctagacacctaaatctctctaggacttgatccttctccacccagcagaatactgtactgtgctgtgatcatttctcagggtggttttggctgagggtttttttttttttttttttttgagatggagtcttgctctgtatcccaggctggagtgcagtggtgtggtctcatctctgcaacctctgcctcccgggttcaagacattcacctgccttagcctcccaagaaactgggattacaggtgtgcgccaccacacctggctaatttttgtatttttagtggagacggggtttctct

SEQ ID NO: 125571 - DNA, 1012 bp, Homo sapiens
ttcacatctgaggactgacatcatttcgcagaccgggaaactaagtgtgaggagtacattttaaaataatttttacattatatattggcagatcatccatgtgcttgtagaaggtattatattggtaagctgcaggtagacaggaagactgaaagagaaggtagaacctgcttggatcccagtctgtgcatacctaaggagttgagttggcaattcctgaaccaaaggttctggtgttcagaaatatctccagttattcagaaggatggcatgacattctaaaaataagaaattatttgtagtcacatcagtgtgtaatataccttacagaatattagaagggagatgaagcatttggggattcaaaggaactagttgtagacccttaggtatggccctgagactacctagggtggcttttgtagcaatctaaacctgtatcctgggatgttagcatctctgaacaaaccttttctctcccctccattgagatcactttctttaaagtctttatgcatttagagagttgctgaggcaaggccatgtcctggtttgctctttttaaaatgcagatgtttctagaaatgactataaactgagtcctgagccacctcttgtaacttttcaggtcttggtctgggggaagataaagaaatggaggtcttatgcttcacaatttggtttaagtcaactatggcaaggtatcttgacttaaataagtgtgacttaagtaagtctgacaatttaaatattagaatggtaagacatttttgtgcctctatagccatatgtccatcttggggaggaaaaactgaaaataaacgatgattacttttcagtattctgtggaaatcttacttctctttttagttaatttttcagtggataggctccctacctgccagccctaaattcttatttattcctgaaactctggtttttttcttttttcttttttttttttaaagtattctgaaactgttttctgaccatgcttcatatattgaagtag

SEQ ID NO: 125572 - DNA, 3644 bp, Homo sapiens
gttgttatgccaaagcaagctcttggggtaaggttggcagtgatgctgctgataaattacttttaagatgcttggggctgaaggacaatgattttgtaatagtgttttaagttctcaggctgacctatgaaatctggaagtgctcatctgaaaggccagtattctttctgacaggcacaggaaaaactcgtcccctgcttgatcctcatgcaagcatttcttggaggaagccaggcctgtgggtcttgggggccagaacagagacactgagagcaacactactggcattttgaatttctgctgaggctgcaaaaacatttcaagggaaatctgaagttatcccttcactgtctacagcctcttgaattgacttctgggtgttacagatgggaccagcgtgtgtaaaagcagaatttatattctatttggatatcagaatcaagtttctctttttaaaataattttatggtaagtcgtggtttctctgatatgatttctgttgtgagcggaacaaaaatcatggcgaaatggtgttattacttaaccaaattgcctcgtgtacagacaggctgaactggtgctttgcctagagttggcctggagttttcagaaactcaattgtggcctttataaggctgtgcctggggttgtatttccaatctctctcaacttttgttcttgtggaagggaggaagtagagctgtgacagatatattgccagatagcacacaatagcacacaaaacgagaaagacacggcgtgagccattcatggagacagatttacgctctgtgctgccctcaaaccatagatccatctatttcagagaaacaacttgcccactgtattatatttcagacagggacatggcttagaagagagatgctgactccttctgtttagcttttgccgataatgctgcacgttttgctgtagaattacttttgtggggatgggaaagtatgtttggcaaaggaaggcctgtctctagattggaagtggaagaagggagatatcaggagagtaattggccatgctgtcgccatagtgaagtatatgtgtatatttttgctgggttttgtttccagccaactatattatcaggtgttggattttttaaacttacttcacaataagaaaaacaaagctagagagattgtgactggccaaggccagaatgtttggcattcgtagtttctctttagttctctctgtaggaccatttcctggagttacagaagaattgaccagtgtgtcagtgtctttcatgtacattaatgggcgatagtattggtagtggttaatataatagcatgggttctggaaccagtctgccaggatttacattcaggctcaacaatgccttagctacatgcctcagttatcttacctataaaatggggattccaggtcttaccttataaggcagctctgagaattgtttagttaatattgaggcagttataactaagtgttcagtaaacttagctattgcattttaaaatttgtgttgattttatggaaataaatgatgatgtgtgatacctggtagattgttcggcagacatttcaaatgtaaaaaaataactctgtctgcattgaaatctttctagattgatagttttaaataatgaaaaaaatacttctgggaatgatctacatttggaagaaatcaggaaagagaagactgtgtgtacttttgcatttctatgttttgggcttgtaagatatgtgattgtatatttcatgtcagtaataatttattttggggagtagaagcaaatgtcagttacatacatcatctatggaatagatttttagttttatttattttaactggatgaaatggttgagtgttgccttacttggttgaatttagacatttgagaaaatttttttttaacttttgtgacacacaaggacctttgaatgaaatcagtccccttttcttcctttaaaaaaacttataagaattaccatttcttgactaaacagttgttttcttttaacattatatacttgtctctacatagatactacattttttagttagatgtgttttggaagagcattgactttttttcctgttacattggaaaaatttaatggcacgtgtatgttattcttatcatgaagtgggtttaggcatgctgccttatactaaatagaaatcctatagtagttgtttttcagaagtaatccattgattcaagtcattcattgattcatttatgaatacttaagtatggttacataggtagggattgtcagaattggcttttgagcattttgtttagcagttataatccaggtggcaaatatactgtctgattcaattacttgcatgaaatcactttaaacagctacttaagatgagttgtccctaggcctgtctttatctacttattgtgcatgtgtgctagcatacacgcattatcattgttgttttttattgtgttaaaaaaatattacaaagtgtaccatcttaaccattttaaagtgtagatacttcagtagtgttaagtatagtcatttcattgtgaaacagagctccagaaatttttcatcttgtgaatatgaaactctataccccttaaacaacaactcccctcccttgttccctccagcccctggtaagcaccattctcatttctctttctatgaatctgagtattttattttattttttattttttgagacgggctctctgtgttgctcaggctggagtgcagtggtatggtttcggctcactgcagcatccatcccccaggttcaagtgattctcctgcctcaccctcctgagtagctgggattacgggctcgcgccaccatacccagctaatttttgtatttttagtagagacagggtttcaccatattggccaggctggccttgaactcctgacctcaagtaatccgccagcctcagcctcccaaagtgctgggattacaggcatgaaccaccacacccagctgaatttgagtattttagatacctcatctaaatggaattacatagtatttgtctttttgtgactgacttatttcacttagcacaatgtcttcaaagttcatgtaccatatgacagaattttctttcttaagactgaatactgttccattgaatgtatataccacatttgtttatctccttatcctgtgatggacatttgagttgttttcacctcttggctattgtgaattagtgcttctatgaacacgagtgtgcaaatttctcttcaagatcctgctatcacttcttctgcatatgtacctggaagtgtgggattgctggatcatatggcagttttatttttaatttttgaggaacctctgtactgctttctataggagtcataccattttgcagtgtcaccaacagtgcacatgttccccagtcttttaaacagccccttccagactgacagagtggctacatacagaacagggcagctttgaagattagggtggcctgttccaagcttcttcagactcctcgggactggctaattatttttgttaaggtcatactgctggaccagggcctataggttggcactgacttacgcatagaatgttggcctgggtgttgatagacttaggctgcaattgctatgagtgatcttaggcaagttacctccac

SEQ ID NO: 125573 - DNA, 1025 bp, Homo sapiens
tttctccatctgtgaaatggaaataataatacgtttgtgagacttaggtgagttaatgcctgtaaagtgctttgcatgtgtctagcccatagtaagcactcattaaactcttaattatcatataatatgctaattatgatggtggtaaatgagtgaggtcatcttccattttggtcatactccacatttgggtagctttagactttctgaagatactatttcctgtaatgtttctttgtaggtggggaggatatacctattacacagttagaaaaactgaacagtagagattatgctttatatggctgggattaaaacttcagtgtcgtgtttagagcctagtacttcctggcctggcatgttgtcctacacttaatgactgtggggcctgagtgggttctaatgttagaatctggtaagaactcttcctgacctctttgcccatttataaacagccttccagggtgacctgagtaagatcattttctagctgtgtaatcctggtggtatgaaaacactggatgtctatagttttttagaactgtgacttagtactaatactagcctcttcaatactcatactcttaaggcttaatatttgtctctttattgatttacatatttgaaacctagacagtcttttcaaaggtgagtagatattttatatgtctgccttctggtcggtagcagcagttgtgcagttactcagctgttggcagttctgttacttaatacagaggcagagagcgaaagacttattcagaaacaaaacctctgcttgaaaagttctcaaggccagccatggtggttcggcctgcagtcccaagctggtgtggcctgcagtcccagcactttgggaggctgaggtgggaggatcacttgatcccaagagtttgaggctgtagtgagccattgatatggctccgttgtctggagaaacacccagggtctctggtctcgtgctgagaaaatcagcaacatagatacacatggagtggtttaaggagcggaaagtttaataggca

SEQ ID NO: 125574 - DNA, 2023 bp, Homo sapiens
aaaataatcatttgtaaattgtgagtgaaccagacatttggccctgactgtagggaaatggcgcctctgagccgggtgtagcttgcagccagtacatcagagctccagtattcccagaccagtgatgaatttacatgaagttccttttcagcatgttaatgactgttacagctgagtaactagcgaaaaataatagcaaatgggaagagtaaatatttaatgcttttatatcttttagcttactgtggaatatgtattttgatttaggaaggacatgagagtcttagagacattagagacaatgttagtgtgtctgagcctcattccttgtttccttttctttctttgcacttaattaaattaaaaggataaagtgagttgttgtgagatggattttactaggggagtggtttttctgtaagttttaggtcacaagatgcgtctttcctggcagttaaaatctgtatgttcagactacctcattgattacgtgcctggtgtgtacagggactcatattgtttctaaaattcagctttcatcattttactctcctgcttaaaaactttagtgactccacaccgcttctgggctgaaagatatactcagtagcctggcttttaagggagggcctctgtgctgtgagtccagcctcttttcaggctctctccctaaggcagctccatgtggctacattgctcaagccacagtggttgactccctgttcctgtaacttgctggaggcttcctcacctttgcacctctgctcagatcattttggggcatgaaatgatcttgtctttttctctatctaaagcctgcttttcctccaaggctcagttctagacgtttctgtgactactctgactggataggagcctgttcattttggaatatagagaaaattgaaagtaggtcacagttctctattccttccagtttgccacctctctaccacagacaattaataatgaaccctacttttccccacttcctgtttggccaccatctagtcttagacaaactaagctatttgtccaggtaaacaagtagttgtggactacagaaatttctgaagattagaattgaagttagtagggaaacaggcctcaaggatagtgccatattttctgagagcagatgattttcagacaaaaggttttaccaacagcattcatataaagtactgctttagtctgagtttgcaatggtagaagtagagtatctaaagaaaggatccatgccctttttttttttttttttaaatagagacaatgtctcactatgttgctcaggctggtctggaattcctgagctcaagtgatcctcctaaagtgctagaattacaggcatgagccaccacacatggccaatccatgcctttttactctgttgtagagactgtcttggagtgttgagttcagacccagataaaacaataatctttagaggaaatgaccaagatgaccagaggtaggtctgaaaacatgaaggccgtgtgggtaagagagaacaagggagtccatgccttctgttttcaaatatttaggaggctactgtcaggaaggagggatattagacttcatgtatggaaccatggagtgagaacaaagattgctgggtgtaggttataccaaagataaattttatgccaatataagaaataattttctcatagtgctgtgataaaatgaatttccccaggagatagtttcccaagtaggaagggatatgaacaacaggagctgatatttgaatcgtgaatatacgtggccttatagtaaaaggaccacagatactcgaatgtcagacctttaggaacaagtcattttctactgtaggattttggagggttcataatagaaagtaacacatctccttgtgtctaaaaataggaataaatcctaatatgaaccaaaaaatatattaggtacagttttctgagttgatattgaaatgatgaaaaagaaagagatctgggactgggggttcttaacacactgggtttagggacctcaagaatat

SEQ ID NO: 125575 - DNA, 1050 bp, Homo sapiens
aagtatcccataagctttaaaaatgtaattttgtcatacttaccttggtatagtagattgtaagttatttagagactataaagtcacagatgaatgtttacaagtactctttttggagttgggcttattctatctatgtcttctttagcagtggggatttggattattcttaaccataacacatacaagtctcattattggaaaattacaggacagaaacaaatgctgtaaatatgcaccactgcgcatcatgagattaaacagacaattttcaaaaagtcaaatttctaatgataaaattaaagtaagtaatttatatttaaaaagcaggaatagcagcaatgcaaactgtgattgacttaagaccacagtgaggttacagtgataataaatcattcttctggagaattgtgagaattttctaactgttggtgtgtgtaagtgcaaggtaggcactttgcataattgtatagtagctgacattcttgatatgccagtttcaagtcctttatatactttgctaacttgctgatattaatttattaatacaggtttttaggactcccctctcttatctaaggtaactagcttattaaagctcatattaaagaaaacaagtatctgtggaaatgttcttgtgggtaccagtgattctagagccttacgttaagaaacactagtctaatggatcaatgtataggtaaatgatattagacattttgagtaggattaagatccaggagactatctgaataatgacctttctctctctttctttttaaaatatggtcatcctaacgcgtatgataacccagatactctttctttttaaatacccttttatttaccaaccctcttaaacctggccctgaagttaagatcaacagctatgtgtgaataatttttttccttctcctttgctttgcttttcctatcaaattgaaataccctgccactttcttccctctctgaaaacacaaaagaggattaagccatataatggactatttatgtgtcaaattaaacgttttactctgaggctgtttctga

SEQ ID NO: 125576 - DNA, 1680 bp, Homo sapiens
ctgctgcagcatgggccgctgctgccatcatcagtgggacccaaggcaggaagtgttttttcctgtagggaggatagatttttttttgtctcttacaggtagcatctggcaggcatgtagaagttagacatgaagcctccacccatggatctgagccaagtagactgacctgtgtaagcttcagatgcctcagtcttggtctccttagctccctgtttttgtcaactgtgccatccagctgagcaccttagagcttgaagctgagagcttcagcggggccagtgcctacaagggctgtgtgtatatgctttagaggtgggagaattgtgctgccagtgggcgtttggcccactaaggagaacacctgtgacctctgcaatcttccctacccctggcattccaagtgccattccaagtctgtagagataatagaacaaacgtaattttttgtgtggttggcaacgaagactggaggagaataaccacacctttggaagacttcggtggtcctttgaaatgaggagtttttatagaaacacttatcattttaaagacctaccatttttaaggtcactcttctgctagggctgtgaaatacagacatatgaaatgttttccagtgttgctctggtacttacgtgtgtgatgattttattggagaaatggatgaatatgaggttggagagtctttacatgtatgaactatcaaatatacagttcagtagcctgaaaacattaacaaatagcttttatttattgtatccttatgtctttcaatttggttcttatctgttgtctcttcagttgatgcaaatttgtgctcaacttttcctgaggggaaatggagagatactttcttggattagcttatgatcttgaacttgactattttaaagagtcatggtatataccaatctggattgtgtttaggatggggcttgggggatggtttctttgttctcttttggcccacgtcttctaacaacccatttgtttagggggttttatgctgcttagagtgagctgagaatgtgctcaagcacataattttagcctgtttttcaggtttacatgaaaaatgtaacaggcttctgaaacccctctaggttccagctttcaagaggctggtcaggaatgcactgaccgagagacttccctcaaaattaatttataaacacgctagaactttcctcaccttaattttgagaaaaagatctctctcatggcattttcaagtgttatggtagatggaaataatgaggaaactgtggcaccttgaacagagtgagaggtttagagttgtatagaccttagtacaaattttgactctgtcattaattacctgttctgtcatgagtgagttacttaacattccctgagcctcagtttcagcatctgtacagtgaggattctatttatttcatactgttgtggagacttgagcaacagagtgtgaaaacatctgtcagcgcctggtgtattttggacattctgtaaatcttagcagcccatttccccattctgggggtaaagccacaggacttttttggcaaatagttgagatacttggtgccaaaaggaaatttaactcatgccatgacaagtttttttgtataaggatgggattctggaaacatgataattttttctcttggccatatggattagcaaaggctttag

SEQ ID NO: 125577 - DNA, 1045 bp, Homo sapiens
ccgtattcctttttatagctgcttaatatttcattgtatagctgtaccataatttacttaacctgtctgacactttggttatttacaatcttttgctcttacaagtgatgctgcagtgataatgttttttttttttttttttttttcccgagacagaatctcactcttgcccaggctggggtgcagtggcacaatctcggctcactgcaacctctgcctctcaggttcaagcaattcttctgcctcagcctcctgaatagctggaattacaggtgcccgccgccacacctggctaatttttgtatatttagtaaagacggggtttcgccatgttgtccaggcttgtctcagactcctgacctcaagtgatctgcccgcctcggcctcccaaagtgctgggattacaggcatacagtgaataatcttgatcatatggcatttcatcctgggtgtgtgttcagttgtaggataaattcccagaagtgaaattgttacagtgaatgtgcatttgtaattttgatagtcactgctaaatccctctgtagaggtcgtactaatttatattcccatctgtttaagagtagagatttccccgcagtcttgtcaacagggtggtggtgttaaacttttgaatttttgccaatctgataggagaaaattggtatctcaaagtggtttcaatttgcatttcttattatgagtaatgttgagcattatttactatgtccaagatctgatagtatttccttttgtgtcatcaacagtctggttatatttctttcctgttttttctatttgattattgctatttttttttaatttttaaaataagctattttggaatacttatagacttaccaaaaagttgcaaagattacggggattttttttttcttttcttatgccctcattagctcgttaattgggttagatggtttgaggaaggacaggtctcctggaattctgtggcttgtcataggtttgtcagcccaaataaggatgcacatccaattcacgactcctggctgcctctggggattttcca

SEQ ID NO: 125578 - DNA, 1157 bp, Homo sapiens
ttctgtagcattttgcagtttgggaaacattttatgtattttattttatctcagtctcataaaagagcttgaggtattattatctccagtttacgactgaagagatggggagtcaaataggttatctgattctcccaatgccatacagctccttggtggtggagttggggtttgagtccaggtctcctgactctgaatctccacgtgcttccctctggtctcttgagtgaaataacccgtactagcaagaaagagaagagtatgtcggcaaaagagaaacctggaatagttgccaattgtccctaggttcagatcacatacttctagggcatcagagctagaaggaacatgagatcagtgcatcctctttatttgactaatgaaaacattgatgtgcttgtgagggacttcgagaggtcaatgtggtgctggaagcagctcaatggagagggtagacagttccccttggatgctcatgtgtggtcttctggggattgattagttgctggtaaggaaggagctcattttggggaaagtaggtacatagattcatagagggaaaacctttattcagaagcaggcagtttttctgcaatatcttcctgggaaacacaaataaaagggctgtagtttagtattcagatgtggttctggttgtgcaaggataaggagaaaaggcagaggcagggtgagaaggaaggaaaatgaatgactgatttgaaaggtcagtgagaagtctgtgaaaggtacatacttagggtctgtagggcagtcatttgaaatccaggatacttagtatatatataggaggacttcgtagtagttctctgactggaagaggactgggctgccttgtgtgtgtgagctttcatcatgggggcagtggttactacatgctatttctaagaattgcacttgtggggtgatttctactttgggtaggaggttattctaggtagagctagtgtggatcagcaacatcagcaccacctgggatcttgttagaaatgcagatttggggactcctaccctagacttactgaatcagaatctccagtgggtgcagttcaagaatgtgtattttaacaagatctccaagtcattggtctgcatgttcaatgtttggaagcattgctctagtgcagaggctctccaag

SEQ ID NO: 125579 - DNA, 1018 bp, Homo sapiens
ttttaaccccatttgggctttgcagagtaggtcttagagaaagcccttctccatacttgttcgttcagtcgtgtatcatgtacagccatccattttatggttttggctgttgtaaataaaatggctagagcctgtgcatctggagttgtggtgactcttagtcttgggatgcgtgcctcttcctctcggtcgttgctttataggctgtctctgaggttccagaaggggctcagagaatgagctccaactgacatgtttgagcctttgagtctcttcatgaaagctcagtttgttcaagtaaaatctgaatggctcagagaggacactgtggtgtttagcttaccaagcccagtgtgatatcactggtttgttaatatctacagaaacacacacaggaaaaatattctagagcatcatattgctcacctcctctaaattcttttttcatggatgatcgaaagaaaaacctttttgagtctctctcttcttttttgtgaatgactaatagaaagaagacgacactggtaactttcagaagcattgtgatagcattctgatggtgggattatgatgttcagacatgggagggtattagcaaccaaacatcatttcctttaggggactggaggtagtggtcatctgtgagtctagagctgtcttcgagggaagtgagcagtggctcttccaaggacacagagatgtcaggcacctctctcatgcatgcaagtgctacatattatgtccacagtatctggagtatttaaaccaggaataacacgtagtctttattattggaagaaataaattaggtcagagttagtatgccatcgtgtgatgccagtttgtattctttattttctgtacttgcttctagagagggagtaaatactatgagataatgaagaaagacatgtttttgtgacttttctgatttaggacactttatgttgtggaggttttttgaaggatttggaatttggttgcttattgagaacctcttgagaaaatcagattatct

SEQ ID NO: 125580 - DNA, 1042 bp, Homo sapiens
attgttgcagtgagcagacttagcggaactgcacaaggctggctagaggccaggtttagactaccttggaagaattggcttaagggcagaggagaggtttagaaaactcctttcttcctctttggtggcattaatctttgcgaaaccaggctcagactccttttgcacctttcccaggaatggggtagcatagatcttcttcctatgtgaatcacagaaagggactttgtgtgggtgctgtgtgttcattgtaaaccactggtgctgctatctaggtggagttaaagttgataccagcagagtaagttagcctgagcaggaggatggagttctgcagtacagccggaaattttcacttcatagtgtttctactgtaacttctcaccctgtgttgaaaaaggcacacctggccattcgcatagtttggatacgttttaacccataagagtgctgtccttaaagatgatgaaaagagacattttagctccttggaaataagcacatttctgaaaccacccgtctgagtgcacacttgtgcagataaacaggtacttttgtttatgctctgactcaagtggaaagggcaaaataagagattttccttctcctgagtcttttcactgtgaggattttgtcctttaaataaaataaaccggaactgtaacctttattatgggaggagtgtggaggagttaggaatgaggcaaaatgccctccctgtttctcagataactcttgctaccgtctgagcagtgtttatttaacagatttaatgcattgcctcaatagcatcacacgaaacatgtcaccccccctttttagtttcttcccttcaaaaattttcttaaaaatgccagaaccttaccaagtcacttaaataaatcagtccaagtatgaaatgatctctgaagtgacttaacacaaatgattctgactttactacttgggagactcttttttgatggccagccctctaaattgtaggaagatcattttctagctccctattgtcaaaaaacaaagcaaaatcaaattaaataag

SEQ ID NO: 125581 - DNA, 1887 bp, Homo sapiens
ccagccacttagttttgtacaatcccagtgttcaaggaagctagagatcctcttagccagcccgcccgcaggggttttgcacacacattgttacatctcttcaaaatggctgtcccacctttgcttacatgaaatggcctgccttggcaaataaacctctttgaacagttctgtttttgttagatagttcctgctttaatttaggggaaaatatttctctttgtgggtttgtagaacctattggttcttgttttactctctggggtcatattgaataaatctaatttcttctttcacacttgaagcccttgagattttttttaaagacagttctcatatcccccaagtatcagacttaaaaatctcaatttcttcaactgggtctcacataaaactgtcttgagacttctctccatcctgttccttctcctgagtatgatacaacatgaagaaggggaggctgaaggaagatttaataggaggctttaaatgctggggggaattgtcatacagaaaaagctggtaaggtctttacatttaccatggaaacaagaaatcacaggctcatattgtggctaaggagatttaattagcaggaaacctgtcttaaccttatggatttggtgtcaggaaacctgtcttaaccttgtggatcatgcaatggactgcctgctatgggaagttgagggatcttttgccttagtgtaagacaagtcttcaagctcagaattcgtatattttgtgtaagagacgttgcttttagttaaatgttttgcttaaagtattcttgtcattgcttgtcatctatgcctgatgcctgaatttccctcttgtgttggttcattggatgtaaggcatcatcatgactgctgttaatcatagggggaaggaatatggttcagggctttatgaaggaagggaaacagtggcatagcacaggataattaatagcaagtggagtgacagtttgattccctggtagggaccctggcattgttgaaggaaaaaaaaatcactttattctttcatagagagaggcagctgtaattctggttggatggaatccaattaaaaggaactgacatgcaaattgatgatgagacagtgtgagcatagaagtagtccaagaagagttttgtaagaaatggcagagaagagtgtaagtaatttggcatggtaatgtgtgtaagaaaatggaaagctgatgggttggctacctgaacaattatgtctggaatctcagccagcagagaacaggagactggttggtttggtagagttgttaacaaaactttctggtgttttgagttttggtctacattttaggaattatagcctttcataatagaatgaatataaatcaacccttgagggttataggctttcaaattggtggtggttaaatataatattctcaagattctatgatgggagtcccagcctggctcttggaaagaagatctcattgtacaggtgtacttcacctgacctaatgatgtgttctcaaagatttgtgtgagaattggctcctaaatttaggatgaaataggagagcttgccatttctagtaatgctattatgaatcattttctaatgtaaaaaatccttttataaccacagtcatgcccaatttatcttttaagtaaattcataagtccacatattagatttgtttaaaccaaaggtatttttctttgaaatgaaataattgtaggggcacataacagttaagctttagagtaacagaggaaaaattgggtaagattttataagtcagtatattgctttttagggaggaaattctgcctaagaagtcagacagcttctgctgttattacgggaaaaggagaaggctgcccaacgtatttcagggagatttactaggat

SEQ ID NO: 125582 - DNA, 1088 bp, Homo sapiens
ttattctgaagaaagccaaagaaggtggaatggagttcatcttgagaaagcggtagaagattgagaagctaagaaaagacttacacagcagcaaaaagaagaagagactggagtagtgggcagagttttcagttagcaagagagcaccatccaattgttatgctggtcagcagcaaggaacattaatgaaggagatgaagaatgaccagggtcagtttttgttcatccaggtttgagcagggtgttgcttatgatgctccatgcagttttgcctcccacaatctctctctgatctttgcctcctgatctgctcaagtactgcagcagcaatgcattctctactgaaggctgtcacgtttacttttcactgtgcctagaatgctcttaccctcaagcctccctccttcacttgattcaggttgctgctagaagctcccttatcagagagacctttagtgaccattctgtctgaaggaggcagacactcttcccttattccgcttttcttcatagcactcattatcacctcacacatggttgtttaatgtttccccaattttctctgctagaagtaagttctttgagagttcagcttcagtttcttttgcccatcagtgtattcccagtacctaatttatataaaaatttgtggaatggatttttagggtatctcttgcctatcacagtgagaagagctgagaatgaagaatacaggactcagtccttgtcctgtgttatgcaatgtattacatagttatagtaagtataacagcctgagcacagagtgctgtgagctttgagaaataagctagagatggtcatcacagaactggatcttgaatgataaagaggagttttgttctgtggtggagacaaggaatgatcttctaggctatcaaagcagggtgagtgaagttggagagatgtagaaatgagttttgtgtttggatgtcattgagtgattttgatttggctgctagagcacaggtacatgggaaagcatgacaaaggggcctgagaggtagggttggggaggacatgtgaaacatatgttgagatctgattggtaaagttattgataggcgttt

SEQ ID NO: 125583 - DNA, 1031 bp, Homo sapiens
aactgttcctttttttctcacaatagtagttaagctgtgtcattgggatacaaagggaaggagaaggctatttccattcttagaatagaaaaattggaaaatgccttggcaaatggaggtattcttattctacattttttttttttttttgagaccaagtctcgctttgtcacccaggctggagtgtagtggagccatgtgagctcactgcaacctccgccttctgggctcaaacgctaccacacccagctaatttttttatttttgttttttaagagctggaaatttgctatgttgcccaggctggtcttgaactcctgggctcgagtgatccgcctgccttgtccccgcaaagtgctgggattacaggtgtgcaccactgtgcctggccataccttacaggttaagcagctatgtggccttgtgcatttcatttaactgtgtttcatttgtcctttcatggagatagactttgttgatatcctttcatcgttgatgtgcagaacaaagtatgctgcttgggaaattataaacatactttcatttgaaatattgggtaatatcaggagtcctttgctttaatagaagtagatctggaattgcttttttttttttcttggaatatggtaacaccaaagcatctgagctactcacacccatttccagaggaaaacatgatcatttccaggagatggcctgcagttttaaagctttttgctgcttgttttctacatgtcaaaacacatcccatttcagcagttggtgagcgctaccatagaactgttcagaagcaagagggaggattgagtcatgttgtacgtgcagctgcatattaacctgcaggtcatagcagtccctgatccaaaggactgtctgacactttatccccgttcttactgccttcatcattcacagcagccagtgtaggactctcccactttagccttgatcatttggagtagcagaatcgtggtcttgtgtatatatagagtgttatataggccatgtgattctcggagacctttttagga

SEQ ID NO: 125584 - DNA, 1010 bp, Homo sapiens
agagtattggtattaatttatttgaaaaattagcaggagtatatcaaacacttactgtatgccaggacttaccatgataaataagaggtggacccctgtccttatggagcccacttgaatcaaaaagtaaacatatgagcatgcaaatagatggctgtaagaatgtgatgggcatgccattttttctagcaggttgcctaccacatagtctatatgtgttagagatacacattaggtacacagaagagggtccatttgtggcatagagagagattagaggaatcttcatgaaggaagtgacatgatgatgatgttttgaatgacaggaaggagtatgcaaaaaaaggcagggttgacattccagacagaaagactagtatggaccaagacatgtggacatggaaatggtttgctccttttggggtcctgaaggtaataagtgcaatgaggctggagaactgggtttgtcttaaggggctatgggaaatgagggtcagagtgtaggctcttatgaaggctgtctggtcagacttgaggggaaggtatgctggtaaattgcactgagaatagttcctagctgtcccatatttcagcatctcctgaaatagatgtgtactgtgatgtacaagttccaggatacaatcagttcatgagtatccagttaatgtacctgcaggatttgggcagcaatatatgtagggtgttgtgtgaaaatattggatatgaacaattacaatcttggcttgcacaagaaatcattgtgatgcaggagggaagggtagaaaagttagattattttttttcccctctaatgcagtgcctctcaactttgttacaaattagaattacctggggatcttttttttaggatattgtttacatgcagtgaaatgcacagatcttaagtgtacacatcaatgaattttggcaaatatacatacccatgtagcacacttacccatcaagttatagaccatagtcagaacctgaaaaagttttttagtttccgg

SEQ ID NO: 125585 - DNA, 1128 bp, Homo sapiens
ttttattttagtttttcattacaaagcagtttatgaagttttttatattttcttctgttgccttaagatgaacaaacttgtcatcccttctgagatctaacatcaattctgtccccacctgccccccaatatttcctgtggtttaattaaaagcaatttttaaaatccatctgagtttctgtcgatacatatgccctctccttacctgctgtgctatgaggaaaggtgggctaaatcaggagctcgtgttattcatatcttgggagaggaatagaaacagccagtactccaatctcagcttcctgtaatgtctacaagtcagtgtttgctcatctataaagctgggatgagaataacaaatgtacagagaatttttttaatgcacttaagccttctcttaagcactgttaagaacttcagttgaaagtgtttaaaataccaaatagctgtaacctttgattgttaatatgtgtgcaccatcatttcttggatttttctcaatagctagagaccacatgggatctttggtgttttccaaaatgaaccaccatgctattacctgcagacattaagggtctgattatacaaagaaactgagagttgaggatgtccatcagaaatacactgtttcaaagtcagatctgagtacttggtgaagactttggggactacttaatagtaatgattactagaaaaataaacactggcaatatagatagtggttaaaaaacatgggctttgggctgggcatagttgctcatgcctgtaatcctggcactttgggaggccaaggtgggaggatcacttgaacccgtttgagaccagcctgggcaacatgccgaaaccctgtctgtataaaaaatacaaaaattagccaggtgtggtggtatgcaccttaagttctagctatctggggaactgaggtagaaggatcgcttgagcctgggaggtcgaggctgcagtgagccatgatcatgacactgcactctagcctggaagacatagcccaaccctgtctcaaaaacaaaacaaaacaaataaacaaaaaacgtgggctttgacagagagacttgtttaacttaattaaacaagtgccacttaagtgatttggggtgagtaattttagct

SEQ ID NO: 125586 - DNA, 1164 bp, Homo sapiens
cagtggagtttggatcactgggattgagggggatgaggaagggctagatagatagtatgaaacctattggattcatactatggctgcagaagtctgggctttacacattaggttgctaccaagctggatattttgaaatatatatatgtatatgcctgtaatgttttagcatttgcttgttgggttttttttttccccataatggtaggttcttaactgactttttcaaatgcaaggtaaaactttcttttccttttcttgtctccagagtactgatgtgtaaccacttagtaccactaatgccaggattcatttctgtgctacagatggtcagtgagattataaaagctctgaaaaggtttttatataatttgaggtcttctcagttgagagtttgtgtctgacatattaattccttcccatccaccccctgccccattctcaatgtaaaccatatgggacatgtattaaaaaacaaatttcagacattttctggagattttaattcagtagttctggaataggttgcaggaatctgactcttaacgatcaagcacatttgatattcagacaactctattgcatcctccagaagctccaggattctgtatataatttgtaggatatacttgcctcttctatgtcaagtctcttacccagtctgattatgtgagatgtcttaaacagagcgttttttcataaacctttatgtaggataatactactcctaaaacactttattacatagtttttggattggtaatggcaaaagaatgagaaagcacctgaggaggcaccattgtgagtgatgaaactggggtatcagacctggttatgaaaggagatgataacccttgtactgttttcagacagttgcagagttatcctatgaaggaggaaccataattctggtggccctgcagagcagaccggggactgatgaatggatgctgtgggggctgaacataaagagaacaggtttaacagaagggaccaacatcctttgagagatactactttttaccttctaattatttaacccatgaaactattattttctcccaaagacacctgtttttagactatcagttaataaaaagaatggggctacttaggtggaagctggctgaggggcacaaacagattaagccccttttctcccca

SEQ ID NO: 125587 - DNA, 1048 bp, Homo sapiens
ttccagtacgtagactagcacctgacattagtgggcactcagtgaatatttgttgaatacatgcatttgttgaaaaaagtgaaaattgtttaaagtggtactttgtgaacctttttttctcttttttctgtcatcctggagacttctcatttaacccccagtctgtctcgtgatccatgccccatccttccttcatgcctcacaccacctccttctcaatctatacttggcaaagaggaataaagacgctaaggatattgtggtaaaccaaagtcatctcagaaacacagtgaaattccctaggcatctgaattgggaaacctattggctgatttgctttgacttgggtatttcctgtgattttcagccgggatgtgctcctgtgctcagaagtgaggatctgttgtaggtttatggcctagattaattgggatattttgtgaagtctctgaagtgttatcacttcatctttatccttgcctgctattcctcatgaaaagcatttgaattattttagagaagatataaatttgcttgtgttatccagtgtcagcttaaagctgattagcattttgcatcacctttgcaactcataaatcatccacttaccctctcagtaagcaggctgtaagtcagcatggaagcacctgctgcagcttcttgtcctgtgatttagaggacactccagattctctgcagacccttctgtggtgttattctctggtaaggcttcacctatatgggaaatgagtaaagacttttggtgacttttttttccctagggagttcttaagggttaccctggacgagagacttctcagaaatatagtctttaataaacctggtccaggcacaggtttggttcatttggcatatttgttgttttaaaaattttggaggtacttttcaacatttaaagtccaggacatttcacatttaaaaaaatccagatttagggttattccgggaaaatcagaacacctggcagtgtcaggccatgctgcatgcctggcttcatttgttattgagagcaggagtgctctaggaa

SEQ ID NO: 125588 - DNA, 3390 bp, Homo sapiens
gcatcagttgcaaaagtagatgacagtaacacactccctaagtccccagtctgctcctgggaggagcagcctgccttgttcatggcagtcatagccacagggggatgtttgaaagacagccccttatacagtgtctattgattttcttcaccctcttgttttgctcatccatcctgttgttctaggatgcttatttgtcatgcataaaagccttgttacagtgaacccaaacaagtcattgacatttaaaattaaattgcaacaggtattgtcaatagctaaactgctcattgacagtgcattgctaattgcattgagagaacatcctaactgggtatattctgccaaatcaaatcggaaacattggctgtctaccagcaaattcattttgacttgcacagagtttggggatccacagatccctcaccaatctcaaaatactgtgtttatggaaacgctaattattatttttttttttgctgaggttctttgcagagaaggggaattctgatcatcttcactgactgctaagccaggagtcagaaactgtgcctttggaagggagagaactacagatttggggtggagtaaagttcaatgcaagggggtcatttggggaggtgggccatcaggttctttatctgtaaatctaagccatatccttggatccattttttttttccttctctcctttttcatccccttctctctcttctataggtacatgggagggggacaagggtggagacacttaatttttattaagcactgttcgtggtattttatgtgaattaatttgtttacttcccacaatgaccctggggagcagatatgctatcaggtaaaaaaactaaggcacagagagggtaaaactcttcgaaagagtcttgtggttagtcagcttctgtgagagtgagagtgggctgccctgaggccatctgttccctctccccagctgatatttttgtgctctcagggtaaacatttaagcctgtgagttaaactcagccttggactagctgagttcctctggaggccttgcaagtagcagtttggttggcagggcaattaagtatgctaggtgcactgtgctgaaccccaggagggagggaaggaatggaatctagtctttgcttgcgttatacatgcttattggtttgtggcaggcgtgattgatgccagaatcaaaatgacttaaagcagcttcccttgagaagcactactctaacggttttttttcctctttgttgccctaggtcccttgtgaataggatttagctctgattcagctgctgctgttcttttggtaatcagtgtggaggaaggagatgagggctgctattaatggcttcttattttgcattctcctaatcagatatcctgcagttattagtgtgaatgcaagatgttcggtggtgtccctgggtggttttcttaggtgtactggactgttagctttctaagatggaatgttttattaggttctggcctagggggttggttagatgggtggaggttgttaaaaagcactaaagaaaaggaataggatataaaaccaatcttcagggggtgggaataacaacccaccaccttcacttccctcccctcctgccctgaaaaccttatcttgctaatacccttcagatattaaaagtgaaataacagagctatttactaggcagctaaatgcaaattctctcccccattagttttaattaggatgaaatcatacatttaaataaccacttctattactaataactgaacttctgattcactctgaacccaggcaaatgcctcttctggtatgaatggcccacctctgagtcattccgcacctgcatattgacacagccaggctcctgatgtgggtacacacatctgggatttaagggcatgactggcatgttgaatcttgggtataaagctttctgcactataccctggggacaaacaggatagctcaactggagaataaagagcttgcaagctcaaaagaaaacaacaaccaaaaatacctcaaccaaattctgctcttgcttctatcctactgtttctttaggtgtttaaagggctgtagttttaaaaatctcccacccacctcatctttttaagtaaatgtcacaacagtactatgtcaatacagttgaaaataagtatttgagttgaaagaattggctctttgaggctttaactatcagatttgtgctaattctttactgtttccttgacatagtatatgcagtctgtgctaagagagtatggatgttgtcgtcggtgtatagaatggtggctgttgtaaacttctgtatgttggggaaggattgaacctgctgtctggagaattagaaaccagcagcttgacttaaatccctcagtgtcacaaccagctaatgaaggagaggactgctaaactcccagtggtctttgtggctacgaggacttactcaagtttgagactatctttagtgggccaatgacgtaggaacacaatcagcagaggacatgtagtttacagcagcctgtaatgtgccagagacatgactagctgcctctttggccctggggaagtgtgtctggccctgcttgcatcctctgtgagtgggaattgtgccagacaccagctagacatgaccagctgcttcttcgatgttctgtggacatgattggctgtagcttttgatcaggacagtgttcctaatgaagtgtgaccagcgtcatttagacaggaaagaatgacagctgatgtgcaagaatttttcttgattggcagcatttggaactagtaaccagagaaggtaggtggggggaggagaagccagctctgattgacaagagcttatctttatttaatctacttctgaggcactgaagttgaaatcttaggcaagtgaaagaaaggaagacacaattgtgaaacataattaaagattcttgacaaaaacatacttaaatcagaaatgtcttttttttttcttttttgagatggaggtttgctcttgttgcccaggctggagtgcaatggtgtgatcttggctcactgcaacctccacctcccgggttcaaggaattctcctgcctcagcctcccaaggagctgggattacaggcgcctgccaccatgcctggctaatttttttgtatttttaatagagacggactttcaccatgttaggctggtctcaaacccctgaccttaggtaatctgcccgcctcggcctcccaaggtgctgggattataggcatgagccactgcgcccggccagaaatgtctttcaataggagagcaatgcagagtttaggtgtgaggttatcactgctccttcggctatgagaaagagcttttgcccagggattgttaatttttaggcaaaatttaaagtggcgatgg

SEQ ID NO: 125589 - DNA, 1034 bp, Homo sapiens
ggcctccctctgtcactcaggttgaagttcagtggtgcgatattggctcactgcagcctcaacttcacaggcttaagtgatcctccccacttagcctcctaagtattaggcatgaagcaccacgcttggctaatttaaaaaatttctatttttgtagagacagggtctccctatgttgcccaggctggtgttgaattcctgggctaaagtgatcctttccacctcagcctctgaaagtgctgggattataggcataagccactggtgcccagcctattttacctttttttttttttttttttgaggggggagggcagatggtcttttagatttacctatgtatttgacaatttgtttgttcatatttctttcttgtgtctcagaccttccttcaggtttgacttttctttagaatttccttgagcgagtgcctattggtagtaaatgctcttttttgtttatcatagatgtctttcttttgcccttcatctcaaaaggtagttagctggatacacagttctagggggaaagattttcttctctttgagtcttgtaggtttgttgtgaagattacctgggttcatatctaaagcccttagcactatgcttggcatgtttgctctgtaaataacagtggctgttacattctcagaaaaatactggaacagttggaggcaatgcaggcttggttgggatgtccatactttgactaactttttacattattttcttaaaactttgatttcattgagattggggtgggagtacatttaagcatcaaaactaactttgaagatagatttgattgaactgtgagttctatcactcgctagttgtatatacctttggtagattatcttacctgtcctaagaatcagtttcttcatctatacagtgatcattgtaatacttcctatttctctgagttgctgggaaggttgcatgagaacacatttaaagctcttctccaagcctcacatagtaggtggctagttgtggtaattatttgttgcctgtaaaccacttttatgact

SEQ ID NO: 125590 - DNA, 1063 bp, Homo sapiens
tggacacagatacttgattagaagcagaatcaccttagatatctctgcgccccagcttctctgtctataaattgggaataatacctgaagaggtcattgtcaggattgaatgagatgatgtaagcagtgcaccttgcccagggcttaataaatagtgatgagactggtagatttctctgtgagggggcttcaggatatacctcccttatacagacttctattcctttgagtccaccgccccccacaacatctttatgaactgtaatgtatctcatactgtacaagtcacccatttaaagtgtacacttcagtggcttttagatttacagagttgtgcaaccactaccacagtcagttttagaaaatgttcatctcctcgaaaagaaatctgtaccctttagttatcattactttattccctcatcctcttcctcatcagatgttgtaggcaccacctttcttcccttccttcccttatcttcttttcagctgtggactgtgctgatttgcctgttgctggatcatgtgattgaaattctttgaatttttctgtaaatagccaatttagctttttcccttccagagtatttgtttctttgggtgtggaagcagctgctgcagccagtgcaagggctcaccattttgcgctttgcggctgttcatatggcaactttattcaaaaccgctcctgcactgcttaagttatttgttttatacaaaaacagttctcgctggcttgcggcttctctgctgccatgttgacaaatgttgcttctagtgaaatacacaaaaataaataacagcaagggagaggggagcacagagctaagtgaattcattttgcctcttgagtgccattctcatttgttttaaaaaccaccctggcacagacagaaaaggagaaggcagagaaccgcaggaaaagaaaaggccacatttgattctttgaattgggctgtaggggctggctgaacagacaacttgagaagtatctggaatgtaggccctggggatgaggaaaagtttacaaggaatctgaataacctgcagatattcatattgc

SEQ ID NO: 125591 - DNA, 1943 bp, Homo sapiens
acagtgcccctgtactgactaaggagcctttcttttgagttcactggtctggcactggctcctagaagtgctgttttccagtgacagcaggatatttggaccactgggagagtcagtgggctggggtgggcccttgctctctgcagaggtgttctttctcccagtgggaggaaacaccacttgtcagaacacagctttggcttgcccaggttcctgttgtgcagatggggcctagagtctctctgggccccttgtcatggatccaagccaaggctgtcgcttgctgagccaggaataatataggaattagtctttttcttctttatactaagcactaatcaatctacagttaactctgtatctaatttctgaaccagatgccgtgaataactgcccctgaatgtgtttttgccaataaaaggataagtttaaggcttttaatcaatgccgcttgcactcagtatttaaggtcagaatcttgtgtgcgacttattttgatcaggataattgttgggttaaaaaatgaacggtttttgaaattgtgacactcgcggttgactcgtgggtgaattaatctttgagaggatggaaaattgtcgagttcataagagttctcttgctctctagttgtctttcaggtcacttatggaaaaatatgacttttaggaggaaggcattctttttcaatgggaaaggagataagagactaatagaaatttctaaggagtcagtgatggaggctcaggggaaattggaaatgaagctgggtgttttggatctgcggtgagctgagggactggaacagcagctgtgtatgttctaggtaatattaacttgttgtaattttatgtctccagcatacctttttcaaaggaactcatgtttcctgaccaacgactgtgtactgtctagaatgaagcatagtgtttagaaacatctggggtttagatattggcttcactgaatggcctagggcaagtcactgagcctctgtgccctcagtttttataattataaaatgggatggtaatagctacctcgcagttggaaaacttaaatgtgatcatgtatgtgagaatgtgaagtgcagtgcctggcacacaagaggtgctgaaaggagcatctccttttacttctttgtggagtttgtttggctggtctgctggtctgtcatacatttgtctggtgtgcctctagatacacgtaatgtggaaatttccctaccttgtaacagtgagttggaaattgttcctgttgatctgtttttttttttcttttgtgcttagggaaaggcatgagaaaaatgagtcaggatgccctccatttctggagaagcttggtggtaattctgttccccagtggctcacaagcctgggcagttcagagaatatgagaattggtagatcatggagaactaggctctgcccctttggctatgcgggagttacttagtcttcctgaagtttcctgtccatgaaaaggggatgtgtgagggtgcaatatgggtaatgtttgtgaacaacctttgttagtgtcaggaaagtccaaaactatgtggtgtggtattttcatcatcttgagttgacaacagtgcttatccaaaagtcaattttggtattttgtcaaatgttaaaggctcaggaaataacttccaactcaaggaagatttgtatccactctggagctggaggagcttatattaagaatgtaagatacttgggctcccaggatttctggaagagctggcagtctccctgaggttcaggttctcagaccagcaggccatgcatgggggcttgtgattaagctggtgccgaacattgctgaattatataggtctttctgtgctacaggttggttttctgctgttcacatgtagtctaacagtggcctgttttcctttgcctcaactgtgacatcccctcgaagtgacctttatgaag

SEQ ID NO: 125592 - DNA, 1134 bp, Homo sapiens
ggcaatacacaatgtgtttctgctgaatattttgctatgatgttgacacagtaatgtacactttattttgattttagtgtgttttatttaaacattccattattcagaaattgttaccccctccttgttattactgtttgcctgcagttatttagaaagcagtttaattaatgttcttttaccgccccctgcttcagtatgagtttcaacacttttaatacaaagtgttcatatcactgtatgaacttactaaaacccaggacagtgatattcattcattcattgctttatccagcaaatgtgcaatacaaaaaaagatacatgcttcctctctacacatttcagtctaatatgaactgtttggttgaaatacagaaacataacatgcaattctctgggataaacgtttcactaaataaacagcagtgagaattctgaagatacacttaactaggtcagcctaggcttatcagagaaggcttcacagcataggcgatctttgatctggttcttgaagggtaaggatgtgttttccccccagggaccagttgagaaatagctagaattaattagttctgctgtaatcattgaggtgctgatcctagagtgtggcttccactgcagtactggatgtggggatgatgatctcattgcaaacacagcctgggtgggtgtttttggttttgttttaaggattctgaagcagcatatacacaaggttgacctcaggacctctttagttggttgctgctgctgttcacaatagatttagattggatagggcttcagttttcttactgttgcattccagcattttggatcagtcactttattacatcatttactttctggcttaggcttagttgttattaagtgaatcagggataaaccttaggctactctcctgcttcctttttcaaatgatccggagtaaataaaacaactacatctctttcgtcactgtgtttcgttcccatctcagaacgggtaaaatggccaatattttcagtgaaaatgtattgaaatgcatttcactgaaagaaatgttcacattcagtgaaatgtatctaaactctaaaaagagtctagaaaagctcattgacacatttgttacttgctgaaagccccagtgaa

SEQ ID NO: 125593 - DNA, 1018 bp, Homo sapiens
tgttttgagattcacaaaactcaatttacgaatctctggttgtagttatttgacttaatatataagacacttaccagaggagatggttgcaaacagatttgatgacaggtaaatttttctaaaggtctgctaacttcttattcagtcatggccaaccactgatacaatgctgagagttgctttctcctttcccctctactagcttggggtccacagaccaaaaaaatctataacttgcaaggctaataaatgcatgcttcagctgcctggaaatgctgttggactggcaatttgctgccccgctctaatagagactgcctcagatctggtctttaacctggattagctggataaagagaatcctctgggatcctgtgtgccatcacctgttagtgtgtttgctgtataaatgtaacatccactaactttgtcagatgatgtctggcctggctgctgtggctgtgattggaattgaaacatacagcttgttattaaggtagtgactggctgtgggggacaccgacgtctgttgtttttcattgttgatctagtgagttagaatgcctttcctgggctgttaatgttaaatagttcagtcctgttagtcgttttgtgagatcatctttctgtgtgatttgtgtgtatttccttgatctagtggggtgcagggtcagggactgaggggaaggtataattgtttacagaaaatgtgacaggacatggatttgaaatcagataggaagttaaggaatgccgggctcctctgaatattaaggaaaatctttaagcccctaattaacttcagaaaatccccttgctctcacagatgggaatttggctgggtaagctaataactggaatgaaggctaggagttgtgggttaagtttctccctggcaaataccaatatttcaggattacttcgactcttgtcctgctgcctcccactggatctttacaaactctgtgcagtagagattatcttgataaagattttggatgcatgttgggcctttatt

SEQ ID NO: 125594 - DNA, 1076 bp, Homo sapiens
tgcagctctggacctatataagctgtcaggtgtagaagagtgagcaggaaaaccttgtgggggtaactgattccttgtacaaaagaaccagatttcagttagtgatgaaaatggaggaagtgaagaatccaagtcgaatgatagaaaaggttatgtgtcgttgggcaagggttcaaaagacctagttgtcttgattagagaggaggggagctgagggaaaatgagtcacagaggaggaaataatgaagatgaagtggccagagaagacgggctcctgcaaggaggggcctgggttttagatagcctccaagaaggacaggaagtgtggcctgatgggattagctagtctcaagacaccaggtagaatgcaggccatctttgtagactgggccttggggtgtccaaaccatgaaatgcatggcagagtgtggacacacttgtttgtttatactctttctcccatcctgtacaatgaggcagaacatgaaggaaaaattaacaaacaccccaagtctcctgacacagggatcaaaacatattgatgatgtcttgcaaatctgataatttcattgaaccatgtgaagcttaaaattgatacataggcatacccttaacattaagtgctgctgtcagtctgacatagctggataaaccaatgttgaataatctattaaatatgtcagacttgaacaaagaacgtaaatcatattatattatttcagctgtaattaggtgggagataaaatcacaaatagatgagtttagtgaatatttcttagtgtgtacacagtgtcactggaatttctttccttgctctatgggaagaaagaaattgactgccttccaagtattgactgctgtccaggaagtgggaggttgaagggtgacttatgtaatgttcacagagtgggtttcatttataaattcaatgagattagctacaatcttcctgaagttaatggtgatggaaatgcaccattctgcatttagctggaaatagctagctatccaacttggagacttaattgttcctcagattatgatatgtttgcatttatatctccctcccctccttt

SEQ ID NO: 125595 - DNA, 1140 bp, Homo sapiens
tatttatttattttaaacaacaaaaataggaaatctcagcaagaatttatgggcctaccatgagggaaatttttgaggtgatagaaatatatatcttggcattgtggcttatgcatttgtcagactcaacaaatagtgtacttagagcaggtacttttaattttctgagtaaagtatacttcagtaaagttgatttacaaatcagggattttcatccctgaagattctggttcagtaggtctaggatagagtccaataattttttttttaattaatgccccaggtggttcttgggaactcctgatatctccagaggaacctaggctagttgagaattcttcagaatattaatctgttagcaatctgtgtaaatagaaactaggtctggtaaattatgaattaaccagataactacttgcagaataaacagaatacataattagaaatcattaagtgtgttatcaccacatggaaataattttttgtattttttttattgggtagtgttgtgaagaatattacatggtatccttagaagctgtaaattgtgatgctgggttataaaaaaactgtattgtggtatgtttttgcctctctcacttaaccccacccttcactccattccttctcaggacacttatcttcttggtggctaatggcagggtggattccacatttgggaactgctgttgcctgggcagtcatggttttcatcagtgtgtcccagggcgtggtgctttctgtcaacatcctgctctccatagaggctgagaatgatccctgatgcagtcatcacggcttttaggcctctcccattggcctcactttaacctgatgactatcatatttccatctaggctgcatttttaaatcttgtcaaggaagcccagggactctcctcactgataagccatttccaatccaggcctggggttgagtcaggtcaccttatgttcttactctttcccttgacttagattggtctggctggtccacccagataaagtgtagcagtgtctgaagctggatgtgaggggtcgggaagttgttgatggggatgccttcattccgcagcacacatttcaaggcaagcagatcattttcctatagcagtactggtcagagctggattcaggggaa

SEQ ID NO: 125596 - DNA, 1039 bp, Homo sapiens
tgcacatgatatctatctctacatcctatatggactgtgctttctaggagggattagttaggtttttcctttcctagtatagaaccaggactagtaggggaaggcatagaggaaaatactatggttctgtttcagagagagcattcttgcaggggtttcccaaatgtaaatttttttgttttttagagatagtgtctcagtctgatactcaggttagagtacagtggtttgattacagctcactgcaaccttgaactcctgggctccggtgagcccctcgcctcagcttcccaagttagtgagactacaggtgcacgccaccacacccagctaattaaataaaaatattttgtagaaatggggtcttgctatgtttcccaggctggtcttgaactcctggcctcaagtagtccttctgcctcagcctcccaaagtgctgggattacaggcatgacccaccatgcctagtcaaaaatgtaaatattaggtcttatgttactgaaggtattccaggaatgtttggatgtggtacagaagatgtgggtattgggaaacctctaagaatatttccaaattttatcttctgttgttctttaaaaaaaatataagctgtgaatacaaccgtggaaccacaagtaatataagaggagctgatttcttggtgcctgcactgctgactaaagatccagtctggttgcttattcagtaaacctttgagttagtgcagggagtcactctctgttttctcagggagcccttatttgagtaactgtcattacctctttccctaacccactacctttaattgtccttctgtggttagaaaaacttagtgtttgaaaggcatagtatctcaagggaactttagaagtatatcttacctttgctcttgggcatttccagatgaccctggcagtgtggccacaagcaaactggagaaggctgccagtatgtgcacgttttaataaatggaggatatctagcacctcctaacccttaccttctcctccatctcatcccattttctgattgaacagtc

SEQ ID NO: 125597 - DNA, 2196 bp, Homo sapiens
ctgccctcagcagcctgttggcagaggactagaataattgtttgtttaaaagttttactagctaattatactgcaccgaattgacaggcatctctattagagtctttccagtctcttgaaggctcttctccacattacttgtaatcttgcctcagtgtagactgcagtggctgatttttgtttgtttgttcttctctcctttcccttcccacttgttgcaaaggccacacaccaagtctggagagagagctgcctgtgggctgggaattggctgccttcatctggtcagccatatgtggctactggaaaaagtgcctttgggtcattcattctcaggtcaccaggccctagagtaaagccctaaacatgggctctctagcagaaagacttattaattccccttctcttaagtggaggcaaggaggtgtttctgaaccttcagaataacccgagggaacttgaaagtacagattcccggatgctatctcctggatgtgggttcaggttcagtaggtctgaaatgggaccaggttttagaatcttcttcgcggcccggctcacacctgtaattgcagcagtttgggaggctgaggtgggcagatagcttgagttcaggagtttgataccagcctgggcagcatagtgagaccttgtctctactaaaaagagagatcagctgggcgtggtggtgtgtgcctgttgtcccagctacttgggaggctgaggtggcaggatcacttgagcctgggagatcgaggctggagtgagctgtgatggtattactgcaggtggggtgacagagtgagaccccatctctctctcttgttttttttttttttgtttctttttaaaagaaccttcattacattaattgacttccaaggtctcatccagtcatgatggtttttgcatggtccctaccagtagaagatggatttcagaccacagggaatttatttgtagctacagtcaattttcaaattatttgccttacaaatgttttcaatcccagagacctttttcccagctggttcctgggttatattgccaaagtccctggttggtatgcactcgagaactgaaagataattttcttcttgattttaagaaaagataattaaggagggaaatctaccattaaaaaaaaaatcagacattacaaccaagtataacttttagagcagatcctctattgggaaggagcaatatgttatgttaccttgtatttgagcagttaattagggtcagatgtagttagttctcatgctttggccttgcaaaagtaatcccctttttggaaaggctttgttgagtccctaggaattattttaatggtctctaagtatgtttaactcagtcataatattctagttgtttggatttgttgtgtattgacattgacttagatattctcccctgctctgggctttacctcttactcgtacccaaatccatggtccacatgctgtggtgtcccctgggcatgcccagccttgccatgtgtgcaaggtaatccctttgaccctctcaagagggtgctgctcatcttttttttttttttttttttttttggcttcacttatcccacttgacattgccaaacgtgctttgacttgaagcaccgctgctcctgtggctgtctcctttgcttctcctcttcggctcattgagaatctgtttgagatacttgtcatcctttggagattagaactcactttagagggaggaatgattttacactgggactgttaggatcagtttaggaggaaacaggcccacgatgattttaggaggggtttctactgtggtccttgtaaccacatagtttgtactgagctggacactggccatttgagtagatgcttgttctccagttatagaatggttcccagctggcagatttcccactgggattcagtttccttggccgctgctgtttgttgtgctcacactgatttttgcggcatctttccaggcccttgagtcttttccaagcagaagaaatagcagaatgccttgccctccccttctcttctccttttgggtattccatggctattagggaaggacttcctgtgaaataaaatgagggcaaaggaaagtagcatgcctgtggcataaaaatgctgttagcaagcttgaggcatatcagagagattggtcctaagagtaacatttactgcctttctgcttttg

SEQ ID NO: 125598 - DNA, 1028 bp, Homo sapiens
gatacctgcctgttaggattgttttgaagattgagattgttcgtaaaatacttagaaaagtgccttggcacatagcaagtactatttaagtgtttatcagagcatagtctcaacttgtcccattaagaatattataaaactgtaaggtccagatgatgctttattctgtaaaggccattaatggagatgcttgaacatctctaaattacctttccctttgcttgctcaggaagtttgctaatctaaattcttcatgctgtgctgctgagtgtcatgtgtgattgcttgtgcaaggagacccaactgggttctatccgcacttaactgaaactcaagttattccctctctagccttaattcctgtcttctaactctccaatcgatttcttggctccactaattgaaacctaccccagttttctcatgctgttgagcagggatcttcttgagactgattatgatgggagaatgacctcatagtttctgatgccatcttccaatttatgtaactcagccccaagcatgctttttaaaaataatggccctaaattgctgacatcttgtcatctgctcagactcctaaatctttttgtgttccctcgactgaatgggattcactggagcaagatgcctttgtgcagtctgcatttagtgcacttggcgagtgacctccaatagagctgtgtgttcccttcgagcaacatgggtaatgattacagcgacaatgctgctattgtgtccagaggtttggggctgtaatttcataatgaaattgaaaaacatgagattaaaaacctgaatatagcacagtaattatatttaagtatcacaaatcatctccctgtatttagttaggtgtttgagatttggcctctttgtggagtgcagtcacgtcgtttcatacatctgcaaaatggaaggcttctaatttatggctaaaatgtgggaattgctttctcttaatgggaaggtgaggagaatggtattgaatttgaaggagctggtttgcttcattgactagagtcaag

SEQ ID NO: 125599 - DNA, 1023 bp, Homo sapiens
aacatttatggtcatacctctccaaattgaacaattgtgggaatatgtacagacagatttgcagggtagctgaaaagaaatgcagttctgttatttttttgttatagagtggtaacttgagtgaggattatgaaacattgcctagcagaactgtttttttaattgaccttcatgtataattaagaatatcaattattaatgttaaatatattggaattttaaaaattgtgattatttctttgtaatctgatttgtgctatttgccctgattatcagagtgttgtttgagattaaagtggtctagcttgggttcagtttgcaccaggagttttgaattaactaggctccatctgaatgtggaagattttcgtcgtgaggatgcaatggaatcgtaagtgtaaagggcctagtatagtgggtagtaatttattttactcctttttttccactttaaatgaagagtggctaaacttcaacttttgggacattggtctctacctgcacctccagaatgtaacctcttggggaagatatttggagacctggggacttttgcaggtgggtagtattacgcagagcccagatacccctgccttcttgtctggaaatcagtgattctcaaactgctttgtgcttgagtattacctggggggacatgttccgttttcagctccccaagccatagagttaagattcaatagacttgaggagctgctctcagtccaggattatgtgcagatcccgaatctgatcttgggctgctgtgcttttccagtgcccactcagtatttctggggctgcaaggaaggcagtggttccccttcacaggtacgtgaagctcttaactccatttttgtccttttaaattcacattaaagagagttttagatatgcaggaaaatgagaagggaaattgaccttgcctgtctctgggtcttgtgaatagaaaggaagagcctgcgcttggaggccactgggaatttgtggtgttccagaagacctctgctctcatgtgggctcttg

SEQ ID NO: 125600 - DNA, 1043 bp, Homo sapiens
acgcctggctaatttttttgatgagctagactctgttaccctcatttgctagttcatgaaattgaggcagagagagaaagtaagcaatctggccaaggccacacagctagcaaatgggatttaatccctagcattttcattccagagccttgcctttagccatcacactctactgtttctcttccatagtcgtcttctttcttgtgattccaagttaaagaattgtcatggatgagctttttccaggagtaaaggtacttgttggactcttcatcagatttggtcgcgggaaaagaggttgttgctcttccttagagacctgttctttctgcatttaaaatctgagtgtaaatttttttttagctggaaattttaaacgtgtagcaagtgtggccagcttgctcttgtaatgtttagtttcctggacctcatgttgcctccctaaaacttaaatggggttgtggttgcacaacagtatcatggaaatgaaatgaatcttaagcctaatgagtttgaataagatgagcacaatctaattttgtttccagtcgtttttcctcctttaaacaaagaatatcatgccaaattggaaacattggattgtgtcactgtgggtatttattttttactacatgtcaccaagatccagatttgttgagtgtattagttacatatggggtaaaattctgattttttaggtgtattagttatgtatggggtacaaaattaccacaaaacttaccatcttaaaacagcaaacttttactatcttagtttatgtgggtcaggaatttctgagtgacttatctgggtagttcttgcttgacttctcttttgagattccaggagtaaaggtacttgtcagactcttcatcagatttggtcccgggaaaagaggtcattgctcttccttagagacctgttcttgttgcatttaaattcttagtgtaaatttttttttagctggaaattttcaacctgtgtagcaagtgtggccagcttgctcttttaatgtttagtttcctggacctgcagccgaaatg

SEQ ID NO: 125601 - DNA, 1232 bp, Homo sapiens
atagtacattggaggaaatgctctgttgttttgcatcttctccaggcctctttatgactactttttttttgagatggagtctcactctgtcgccagactggagtgcagtggcatgatctcagctcactgcaacctccgcctcccaggttcaagtgattctcctgcctcagcctcccaagtagctgagactacaggcacatgccaccatgcccagctaatttttgtatttttagtagagacagggtttcaccatgttggccaggctggtctcgaacccttgacctcgtgatccacctgccttggcctcccaaagtgctgggattacaggtgtgactacttttttaaatgcttcaatgaaacttaacatgatgacctacacatttcagctgcgcatatgttctacctgttaatggtgagatacaacagagccatctttgactacttcacgctgtttactctaagaggcctgtatcattagatgacttcctgttggaagcagtaatttgtgtttggacttgggtgactgtcagtatgaatctagccaagaaaggtcatgtcacctgctacacagtttgctagagggaatacaggccaagccttttgcctctgaaatcaaagtactgtagaaggtgtaatagaaatgatgcctaggtttgtgtattcagggcctgagtttctgattaaagctgttaacaatgggggcaagctttccccgtgggagacaggcttcttggatctaaacctttctgacatctcaaagctttatttcctgatgatttctaaaagggaaggagccagccccttgaaattaaaatatcgacttacattccgttctccccagacggaagaatattagcagattgaatcagttggggttagtactttcttttatgtgttaaactcagttattctggctaagatcagatttttgtctaggacggagctgaaacacatgcggaatcttgttggttgagggctggaaacgaaggttggcttcacacaggttgcttctccaaaccgtaggtaagctcttcggccccgtgcacagcattcacagctgctgtctgctgcgctttcttgctccatcctgtctagtctcagaagtttcatggtactaatatcttggatccttacaaaggactgacttttgacccagttgactgataactatagagtactttacagtttaccaagagctttccttcatgtttgctctttacatcaaaattaca

SEQ ID NO: 125602 - DNA, 1022 bp, Homo sapiens
aaaagagaagaaaagaaaaccctggctaatgaggagctgggttccttttctccattgatgacagcttcctttctgatctgatggtccgtcagaaactaaggtggtgtgtgactgtggggttatgtccccgctgaagccgtcttttcctcagagttgtaattgatggggagacctgtcacttgttatgctgatgctgtgcagatttttgtgcagctgccagccaagagagttgtaggacagcatctgattgggtgcaggttgtggcaaaaatgataataaatagagagctggtgagggtagattttgattgacccgagattgtatattattaaactggagtctgcatgtacatgtcagtttatgaagaaccagacccataatccaactttaggactgtggcagttcgggtttattaaatgtgctttatatcactattaatattgaggagcaaagaggaatatctgtaatcttttaatctatgcaataatggtttggagggagattaccagatacattggactattgtttgtctataattgtattcagaactctccgaagcattgatttgtttctggcatgctgatttggctcagcagtctcataaagctcttttatagtcctctttgctttgtgttttccaaaaataattggagaataataataatgtggctggcgataaagaagagagagtaaggttgaaagcaaatttctagccgagtggatagccataaacatcttctatgctcataaacacctgggtctgtgacctttgtgtttataagatatttatcgcctcatgggctctctgtttgggggttaccacttcagtgccttgtaaaatttgattgtgtttagtaagtagattctgaatttttgctgagtagggaaaaagtgcccctcacctttgttttctttggaacaaccaatctgccaagaggggcagatctcaccaaggacaggagcagagagcttgggtgtgcctgagttttgtggaaatggtacagtgggacccagtaagggta

SEQ ID NO: 125603 - DNA, 1009 bp, Homo sapiens
gcagtgatgaaaagatgcctaaacatgtgtcccacagcagctacagtccatcagcattggacacattggtagatcacccctgctgttaacacaggtcttttcagcttactcgtttgtgtacttaactgttgagtgctcttttaattaggggcgactaacatcaaagtactatagttgtgccgggcctgctaatcaacaggtttcacttatactggggatcacttcagctttacaccaccattatcatgacattgatttttctgtgcacataaaaggaagcacttactgaatacaggaaaaaatcatgattgctaggtggaaaaaaaaacaaaaaaccagcaagaggaactcagttacccagggaaaatgtaaacgtttcatatgaacattgacagtgaaatggatttgatgagttttgaggtgattttgttagatactttgagagaaattgagaattctgtattccgaagagacagccggacttgaaactctagaggtatgattttgaccaagacctgaacttctctttgcctcagttttttcatctataaaatagggttagtaataataccaacctcactgagatattgtgaggattttgtgagatattgtgagattgaatgattagcttagtcactggatgtaagtactcaaattatagctattaataagtgtgatacggctgggcacggtggctcacgtctgtaatcccagcactgtgggaggccgaggtgggcgtatcacaaagtcaggagttcgagaccatcctggctaacacggtgaaaccccatctctactaaaaatacaaaaaattagtcgggcatggtggcacctgttgtcccagctactcaggaggctgaggcaggagaatggcgtgaacctgggaggcggagcttgcagtgagccgagatcgcgccaccgcactccagcctgggtgacagcgcgagattctgtctcaaaaaaaaaaaaataagtgtgatacttaatgtcataaatcattgttattatt

SEQ ID NO: 125604 - DNA, 1023 bp, Homo sapiens
tgtacccaggctatctggatccatcaaaacctttgctatctgtgtatcactacactgtagcttgtccagagttacaaagctgggcaggaatagtccaggacccaaatcccagtcttttgttggctgaactatatttgttatttaaagattcttttagcagtggaactcttctttaaatggagatattactagatagcacaaccaaataaaaaaagtggaaacttagctgctgtggtttaagtgggataggccaggcattgaccatgcattccctttattcagcccttgctgtggcttctgagaaagccacatggagcatagttttattttatttattttaatttttagtccctacaacaagactcacagtagggatatgattttaaaccctggctctagttagggatatgagctccagattgctctcttttgggtcacaattaaaatcctaaccggcaacagatatttttggtcagatctggtcattctctctgcctccgtacccattgggggcaaactatgaagcttttgtagctgcattattgtagatttgcaggatttctgttcgtaatcagaatcgggtatgtgttagaaaaaggccttcctgagtgtatgaacccctttgcctgctgacagtctctgggctggagttaacattaacatctgcatgcccagaggacagtgaattgctaacttttcactggctttctttttgcttggacattttacagtgctccagggtcatcattctgggcagtacttaccttgtaagtacctgattttggctcttttctcactcactagtctgtgatctagtcttctctctgtgtctgcagagttcagtcccatttctggagcaaagcagtagctcagtaaatgtcagtggagttttttgaatcactttttattattccagattataggcatatatgtatagatcaagtaggctgaatatgacttaatccccaagtttcttctataataggaccttattttatctctccaagtaatggaataaaggga

SEQ ID NO: 125605 - DNA, 1061 bp, Homo sapiens
gttcaaaaggccggtgcccctggaatgaggacctacaagcttacttttatactagaaaataaaagactagaagaatcaagcctttgctcagatcatactttgtgaggtgggcaagagtagaaagccgaacacttgaacgtgagagcgaggagggagccacagatgaaggttgaggacagagaaagggaagctggagggctctaaacttgcagaggcctgacctggcacttcatctgtcgcctctgaaaacagctctgctcttgctcttgctctattctcatccaagtactaggcgatcctccttttatcacttcccagtttcttcctttagtttcctctaaggtcattcctcctttgcactggatttactttggagtaacagttgttggtgggaggttctgattctgcagagagagaaactgaggcatgggatagagaacagccatctgtactttgtcctgtaagtcattagagactggcagagccttgtcatagatcccgtggtttgctgtaagccacaggtggccctcataccctcataggaatagggaccttcttccttccttaacatgattggattttgtttttacctgaaaatacgagctacttctaacagaaggaaagacgattgcagcctgtactgcattgcccctatctgtaaccccattaagaggttgtaaatagtactataatgatatctcagtcatttgttttgatgtatccaggcttttaataaatcagccgcagcttgcttaataggaatatgagagcagagcacgttgctgccagcagctgctagtaaattataaagcattcatctgttttacaagggaattaaatgtttgttctctttaaagggttttgactaaacaagggtgtgtgcgtgtgtgtttgtgtgtgtgtgcacacacacagtggcttcctgcccatgccctcccaggtacagtagcaacctcaggttcctggggaacacctgtaaccaaagccatatgaattagagtgcccccaggtaaaccctgtcattattggtctctgctctgcgtgcatctctaaagcaatat

SEQ ID NO: 125606 - DNA, 1035 bp, Homo sapiens
acatgtacagacttttgtccttctcattattccctaaacaatatagtataacaaccatttacataccatttaaattatattaggtattatgtaagtaatgtacagatgatttaaaacatatgggaggatgtgagtaggttatatgcaaattttacaaagggacttgagcattcgtggattttaggatcttgggggatgctggaaccaatcccccacagatacagcgggacaactgtattcatataaatatataggccagagattggctttaggggagtctgcaaagttccataattatatgcatttttcttaggcagtattgtgtctgtcagattctcatagtctccaaaagttttatgattcttcaaaagtttaagaactgcttacagaaaccatgcccccagtaattattctgaatctatgtgttaccacgtgtatgacttagaagaagtctagatgaaggttccacctaattacagaatccactgctgtagccacagctggattgagttatgtggcagccctgccccagagctggggaggctgcgtgtgtgcccctccacacctgagtacatcctgggtgtgctgaaatgaagcccagggagatacaaagcaccataatgccattaaggccagcacccgttgggtaggggagaggctgaccatacagacttctgacttctgcgtttcattccctgctctgaaacctgtccgtctctcaggcttgcaatctgccttcctgtctctctgacagacctgtgacttgggctatggttctgataccaggaaataatgcaggggtgggagtcttagtcccaagcaaaataaatcactgctcccattagacattacaatgtttaaacccaagtacatctgtctgccttcaaaaccaagatttagagcatgtcaagcaggtgccatgcctccaataacacatactttgttccaacatttagtagattactgtgagattttaaattcaaattctcagacattcactttgtttaggaaataactgcaataaagcaaattgtc

SEQ ID NO: 125607 - DNA, 1020 bp, Homo sapiens
tcatgtacacaactcttgtgactgttgataagatgattagtttatgatcagtctttgtctttgattcttaatgcttataatggatagtttttgtcatttttctccaagacagtctgaaaaaattaaatagttattttactttataaatggtaagcagtcagtacctgtttatagagggaatgaacaaagagtggtctggtttattcaggatttgtaccaaaaaatctatatagtaatttataaataaaggtagatctttgaaaaaaataaagataatctctagtctctgaaaatataaacctgttacataataaaaagttgttatagactcttcatttcttcttacctcttaagccaccacctctagacacactttgatcctctctctctcttcttccccccccccgagtggaaaatctcaatattaattggagctaagatgattgtactactgctgctaagacttcagcaggtctcttacaagctaatgtcacggcatggggtccatttgctctgtgtagctattctgcagtgcagtgagaattccttgattaatatgctacatgaaaataaaatggatttggaaaaaattatagcatactctcataaatattaattcacatttgtatggaattacacataattttcaatatactttggaagcaccttcagtatgaaagatttggtctccaaagagaatggcataatttttttaaaagcacagtggatacattattaagcatcatttgtttattaatctgatcctctacatgcatatgatgcagggcagtaggtgggttgtgtgacaaagaaaggagctttataccctgtggggagtttttatattacacttagaagtggtacaatttaatcacattatatagaagcagcccatgatggaactcacctggctccctctgctagtgttgccattattcctgagtgtctctttatggcagctattttggttaaatgtgagactaaacacagaacatttttgagctgagcagatgcctggca

SEQ ID NO: 125608 - DNA, 1088 bp, Homo sapiens
ctagatacctttgtaaccaccacttccctttccttctcttcttttctacagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacaggtgaggaagcttgggttcgctctttcctgtggcggcaaaatcccttccttaggtgcttcctccactgtggtttttcgtaacaggtggagaagatatccttggtgggatgctgaagtggttgtccaacaaagctgtgtgcgtgcctttaaaagaatctaaaacccaatctcagctctttctatgaggatttgaaacttcagcatggtgccctttcagtcagatgtgctttatgcaacaaagcttgatgctaagtggtactggtatttagggcagacctgtcttaacagttgtcaagatggactggcttgcaggggagagatctttgcaattaggataaatggaacaggtggatttcatcacatacattgtgcatctcatggttctaaggtgctaaaatgattgcctgtgtgtgagaaatgccttgctaagatttatattttccggggaagctcagatattgtggcatctgggagggcaatggcaaaaaatgaatttgccttttggtgtcttagttgttctccataggctataattcaagactatctttgtgatctgttgattgtatgaacgtctgataatgaggcttactggcctgttaataattaggtttcaatgatccacaagaaagtatggctcttggcatttgggaagcctttctgcctgtggaaatccccacatgagatggattaataatgagatatgaagctgtttatagcagtttttctgcacaaatccagaggcttcagtgcctgtcaagttagttacctgtgtcctgggtgtgttttatttatttttggcaggaccattgggtaggattgactatc

SEQ ID NO: 125609 - DNA, 1044 bp, Homo sapiens
agggaggggagtggtccattgtgtgtcagtccagacaactgccatctgttatgtgatcattggtaaaaggtgacacatgagtgtttaatgaccatagtagatgttcaaaaagcttgtctgaagaatactcgtgattgctttcctatcatcctagatgcctgtaaatatcacaattactttatcgcctgcgtttgcctcttatcaggtaaagaaactgaatctgaccatcttagctgggaggggaccttgagatgagagtgagctttgaggagcatttctacattaatggattgtcatttagtgcctgttattgagaactacagatgaaatagggaagaggcgagaacttagtctttatttctgacttggttagaatgaattaggtttgcatcttattaggaaatggtacttcctgagcagacaacttaatgcacagctttcctgtaattatgggaagatgttactccttagtagagaggaaagaataggatttttttttctgagactccgttgaaggcaactgatctttttactcggagggtgcaattataatacttttataggaaagatgtatagttctaaaaccaaactgcttattctttcacttgcctggttgtaaaacccaagttcttgtgatgtttttccatactaccaaaagaaagcttttaaactgacacttatttgttggattatgtttttaagtataaatacatactgccttagaagatgctgaggtggcacctgtcttggcaaatggttgcactttttgatatgagaaatttgaatacttttcttacttcccaaaggggttaaaattatgaagaaatcaataaattacctcttatacaactcttatacaaaatagcgcatgtctttctgacctctgtaaatgaactatttgttcatgatgtaagcacttagacatgatataaaaaaagttttatcatttacttacaaggacatggtactttttttttctcaatggagatttgggggtgggaaaagcaaaagaggttgcacatggcctctccttaaggagcttta

SEQ ID NO: 125610 - DNA, 1040 bp, Homo sapiens
gaactctgcatggttgcatctgcttcatgtattgacattgtaccttggtcttccttggagtaagtgatagtggtgctatagacttaagagcccaggtgactgagccaccctctcttcccacctgtcctgatggaacagtctatcccagcccatgctctttcctgttgagagtgtttgctaccagaggctggtcccttatttcagcacgacttagacttactgcttttgtctgaagagctttctctaaatttgttactagtagaaattaacttgcaaaggaggatttataatggaaaactttgattaaacggatccagttcaagtctcgtttctgaagatctgctaattagttttggatggaaatctaggccaaaaatcacacaggtatttatccagcttgactctagagcctacaggtttctggaaatcagagcatttgagacacgaatgtaatttgggattttactgtcataatgaaaagacatgaactttgctatgtgctctttcatacatacttttgttataatatttagatgtctgctggtaccttgaactagtattaagaatgtcagttaaaccgtttctacctcatacttcaaaatttcaagtttaccatgttaattgggatttcatttgctttcgaaaaattttgtagtcatgtgaaggttacaagctaaggtatcaaataaaattctttatatttttttcctttttatgaatttaagttgcatactactttttccccttgcctaaagtatagaaataagaaaaactgtaaggaaagatggagggaataaaagattggcttatgatctctctttggaatattgattgacttgaataagagtgagatgctagttttaacatcaggtaattgaagaaccccaatctaggcttgtctgtgttcaggaattactcacgtattgtattggaagtattggtttgtaactgggattggtaaacctgacactaatataataatgagttatatgaaaggtgttttgcttttgttttatcttgagcatttggaaacaggttta

SEQ ID NO: 125611 - DNA, 1150 bp, Homo sapiens
agatccattctgacccacctattgtgaagagttcatggagagctcttaacaacaagtgaggctgaggctggcagattaaatgcagttcaaagggagacaaggttgaacatctcctagagagggaataccttcagagatacatattaaagttctttaaaattgtttctttcttattgtgccatttttgttgacctcccttctgtccttttaagaaacttttgagaaaaatgcattattctaccgaaagcatcggcaaatgttggaaatagtattttgtgtatcagttttcttggctgcttatttttaaaaataaaggcttaaataaggttcgcacatttttcactcaggtgcaatttactgggaattacctggcgcattggttttatgcttaatatttacagattattaaaatctcagtggctttcaaactgcatggaccaagaaaataggtgtattttctagaaatggttttgcttatggacactgacccactttgaaacgacttactcttggaactcttagtacaggaaagtcttatgtttctgtctagaggtggaactgtttatgataaatagaaatagctttccttttctatcatttctgttttcttggaagtagattatttttgatgcaagtagaccttcagaatttgaatagaaatttttatttatttatttatttattgagacggagtctcactctatcaccaaggctggtgtgcagtggtgtgatcttggctcactgtaccctctgccccccgggcttaagtgatccttccacctcagcctcctgagtagctgggactacaggcgcacaccaccacacctagctaattttttgaagagatggggttttgccgtggtgcccaggctggtctcgagctcttgagctcaagcaattctcttgccttggcctcccaaagtgctgggattacaggcgtgagccaccgtgcctggccttttgaataaaaatttagacttcagatttatatagtgagtatactgatgggagattgaacaattacgtgatctcaggagtagattatagagctgtttctaatttactatcaagttatttttttcccaaaagataatttataaactgcttttttgtttgtggaaatcctgtttgttaggaagtgttacaaatg

SEQ ID NO: 125612 - DNA, 1173 bp, Homo sapiens
taagcagctggtactacaggtatgcaccaccatgcccggctgtttttgtattttcgggggaggcagggtttttccatgtttcccaggcttgtctcaaactcctgagctcagagaatctacctgccatggcctcccaaagtgcttggattacaggtgtaagccactgtacctggcctgcttttcagtttttcagtaagtaaattgtgaggcatatatgttgattcttctggctttggaaaatccttccctataccctatttatgtagactgaatgaaattgataagatacagtattttcttcctagactgttcaacactggcgtgaaatggttcttgtgtaggactccttgccctcttccaggtagctctctttattcagtacatgttttacatgcattctctgtgtttcaaacctgagagatgtcagaggaatataagagatggtccctattttccagggcttcacctctgggttaattactttgggacagtttaaagtaaataaactgtaaaaaaatactcttggaaaagttggtgaatgatacgtgcttaatttttcactaatctccctcgtggtttttataatgccatgtgtttttcttgggagggtttccttacagctgtatttgtgatcttgggctagaatttatgagctgccaccatgaaggtctgcctctggctttggcatcagagatggcgagttgtgtggtttgttttcttattgttaatgtgagaatttttcctaatcaaaataaatgcctatgtgtttttcctgactttcttgttggattgactaaggaagttgtgtgaattataaaaatttcttcctgaaatgaaggacaaaatttccaaagcaggatgcattgagattgtctgaagaaatgtatgtcttctggttttagtatttagacttgaagtttttttttttttttttttttttttaaccgtaataactaggaaaagtagaaaagttaaaagaaacaaaaaacatcacggtgggaaatagaaggagaaaaccagacatttatgaaaaccattctggatctcacagatgctattaagattagtaaacgttggccgagcatggtggctcacgcctgtaattccagcactttgagaggcagaggcaggcagatcacctgaggtcagaagtttgagaccagcctggccaac

SEQ ID NO: 125613 - DNA, 1051 bp, Homo sapiens
ctttgttgtcttttgttgctgaaaaatccagctctcggccttctttctttgagtagagcatcccagctggtatacaagtatagattggatttcagatttagcaatgcattgtgttttgacaaagcttattgaagatggaagtcatttttcaggagcgctctaagaggtgagaaaatggcaagggagggtggggaggaaagggagaaaatgcagaagaggcagacacaattgcaacattgatttggtaaatagaaagttaatgtagctacaggtattgacagtaaactttggctaagatattggagaattgcagattggaaggctagagctatttcagaatttccagggccattttattggattatacaccttagaaccttaacacacagcttctgttgattagtacagtttggcctccagtgtgagtttggctttgaacactcagtgtgactttggctagggcttggcacctgtggacttcagcttctactttagtaaaatgaatgagttagaacaaataattgttacattcaaatccagatttatgagtgtacgatagtggcttcacattatttgttttaagttaccgttgagaatttggttctcagtaatctagagctactattttagcagaattatacatgggatgcagaatagaagcttttaagcaacagtcaaccagattggtctataataactccaggataaatacaagaagaatttctggacacattttgccccagtgaagtaaaattatttacattcaaggatggatttggaaatgcaggtatttttctgttgatctgcacgttggttacactggtgtgttcagtgtgtaattacacttccatgcagttatttttgtttttgtgttagatttcaataaactattattttttctaacagatcttaaactttaatgcttctttagagtactaatcaaagtactgttacataagtaatggctcatgtgtgcgcacaggtgtctgctctgtgaagtagtccatttcaaattataccacattaaattgtgtctgctttaaagggttaa

SEQ ID NO: 125614 - DNA, 1042 bp, Homo sapiens
catcttggcgagaaaagccactgatcgtctcagtgtaaggatttggaatttcaaaatcctaaatgattactaaatgacaagtaaaatcttgattgagatagatcgttgctaacgtccaaagagattatctaaaagcattgatttttattttgttggctgtggaaataccgtggaattcatttattaaaagtagtatgtctaagtttctacttattttagatactgtaatataaaattataaacaaggcccaattgttgttacccactaggcagatttttttattatccaagtttctgtttcgggccatgaaacaagttaaaatcaaaactttcgctggttgccattttaaagataaatttgttatataggctttctaagcttggttgccttgctccacaaagacaaaacattaataatagcttacatgtattgagcagtgaatctgtgctaggctttgtgttaaccactgtatatttggattatctcattgatctaaggtaggtacggttgttattcccttcttataggttaggaaactgaggctcagagagattaagtaacttgcccaatgttacacagcttgtaagtggcatttctgtttaaagcttcccattttataaagttttgtgtttttaaatatgctttagaattttaagtttttactctgttattatttcgcgaagtcctatgtctacatacacatcaaagcaattctgtggttcttagggaattatttaataaatgaaatagccatagactgtaattacattatgagtggcatcttttagctgtgcccagcggtagcccagttgctaatctttatcccttgagtagtcaagtagataagaagtggataagcaagtggagtggtggccactcaagcaggcctccaccagaataattccaaataacttcacacagtgaattgcaacccactcaatccacttcactggatagcattgctcaaaagatattcttttactcttttatctaccttgttggcaagcatccccaagaggtcttatgcctgtggcctacaga

SEQ ID NO: 125615 - DNA, 1196 bp, Homo sapiens
tttgtaatttttagtagagattgggtttcaccatgttggccaggctggtctcgagctcctgaccttaagtaatccgcctgccttggcctcccaaaatgctagaattacagacatgagccaccacgcccagcctatttcttgatttttattagtcacctagccttattgtaatttgcacttatctaccattagaacatcataaacccaagtgatgaacagaatggatgtaacttagtgcgtgtatgtaatgcatatgatgtaacatacataaagacaaatggaaaatgcctgcaagatagtttccctgttgtctcatgcctcagcagtaatgaaacatatactgagtgcttattgtgggtcagttactgtgttaaatgtttgtcacgaatcatcccatccagttctcacaatcaacctgtcatgtaggtgctatttttgtccacatttttatagataaggtggctgagacttagaaaaagctaacaccacttgcctgtggtcatagagctagcaattagcaaagccattgcttctaaccagtgtgcattttgccttgcacaataaactacattaaaagatttactttagtttttctacctcccaattgaagccactatcagatatatagtctaaacttagatttgattctgtttagaaacacttaatgttcctaatgttatcaggaaatttgctgttcattttttcaagatctgagtagaatgtcacattctccatgaactttccatgatgctcttcttccaaatgtttctgtagcacctggttgtagcctggctcttaggattcccctgtctgtgctctggacttctttagaagcaccttgtctggttcagttactgcctttgtttgtattgctggcacattcctttgtgcttggtgcatagtagataattaatagatatttgttaaattgaactggatgcttaataaatgtttggatctaattatgatcttaactctggtgtgtacttcaggtacttcaggaaggtcattgcagcattagatgactatggagaccctcagtgttttagactgagatgacttgccattcctacaagagatcaattgaatgaataattggggctgatttttccctaagtattgcttagaacatatactgttttttttctcctcaaaaattgccagttatattgccatactggacaaaataaaactgt

SEQ ID NO: 125616 - DNA, 2592 bp, Homo sapiens
aaccaagcttcctaggtctttgacctcctctccagtatccctcaccttcacctgctaagtatccattctcattttggatctcggactttgttatcacctaggattcgcccaggatttcactttctcggatcatgaccttccacatcatactgtcactgcatctcaggagtctgtttcttggaaaagctttacgtctcttatcctttttcttttccaacagaaatacctttctgaactatttctctctcttaaacctcttttaaaatctgcacacttcatactaaattgtattgattatgcttctagttccctagtacataataacctttggaaaaattgttttgtcttactaattgtttctatagaactctgtactgcacctggtgtatagaaggcactccataaataatggtttaactgagctagagaatatatggccagggtctgagtccgagtctgtcttgcttcacagtatggctgctatagtcaggtctgccacagctctaggcctatttttttttaatctgtctggatgaagaaggaattgtttagtaggtgatgtcatttgtgggatgctttgtctatttctgcgtatccagcatgcttttagtgatttttcattttgtcagactgcattttctcttttcaactagagttcaaacaaaataattttagataacatcctaagaacatttggaaacatgacatttcaggtctattttccctctttgccttaaaaaagtatatacagctataattactaattgctgcgctctaagtagagacagatgatacatatgtttgtgacaattttccagagggagagctaagtaaccaggctcatttttccataatgtgaatgttattcacaaactattaccataattgatgcaccaaaccactgtagagtaaataatgtgttgtgtgtgggaagcaagctagtagtcaatgaatattaaagaacaaaacctcattttaaaagagaaactgtaattaaaatcattctgaattcatgctgcacaaccagttaaaataacttggctgccatttatctgtgtaattctgtgtataaagggagtaggtatatgatttgttatatagaagtaagtatttacatgcacatttttatgaaaagacacaatatcgaacttcagaatcagtcgttttccaaaaacatttgttggagagatgaacatgcagagttaatcagtgaaatatatattgacaggaaagatcaccatttccgttatcttatcttttgcttttctaggtgttttatgtctacctggaatgtcgtgtccctttccgtggacctaatcagcttctgtattttctccaaagcttccttttcatcagaagttgttcttgtccacttttaatccctcttactgctttctaggtgctcatcaacttctgtgtgtggtatattgatttgcacttttgggatttgttgttttataagaggaggtcataagtcatttcttgtgtgtatcattagtcttctcaacgagactgcctaggatttcagtctcagattattctatgtgtgtgttgggcgtgtatgtatgtgtatcattccttccggtgtaccttgtggagaatggtttgctgtccatgtgttcgctaactcctcagtatgtattgttggttacctgttttcatgcaccagatactgcattatttttgtaaaatctttacattttgtgtttggctaccagtgtctccacagagtcttgaatgtaactggtaaggatcagatctgttggtgtagagtttttgatggaacactcaatcagcaatctgtagtatggcttatgtaaaatgtataactccctctatctctgataagttctgaagtctaaggggaaagtgcttccctgtctcttgaatttgagtgttttgggtgagtccattttatagatagacaaggtgattgtatcagagcttacttttatattttaaaatggatcatagtgtacctattcttaggaaccttttaggaaaatctctttaacattgatcctgttgttagttgtaatctcagtatattctgataatttcctttgaatatgtaactgttcctttcatactgtgggcatctgttgtcttctctttttatagcaatgaaagtatgaacagattccaatgtgggttcttagctcaaaattctctggctctaatgtcaggccaatttatttagctagtttatacaactggacatatttctataatagaaaaatgactaaatgtttcttaacatattgtttacagagatagagcccatgttgtaaggctatgtaactcttcctctcaaaagaagattattggttttagcatgttttcctccctttaatttaatcttaagcaggtgaacctttttgagggctttttggaaagctctgaggaaaaaaaataagaaaactcatacaacctcaaggaattctaagtatcaaggagcacctctgtgaaggtgattggttcaagcattgaacactattttctatccttccacacatggcagggcattattcatgtatccagctctgtgatagcttgtttttgcttgccctgatgatacgtatggcaagggag

SEQ ID NO: 125617 - DNA, 2020 bp, Homo sapiens
attcttagcagaagaaaagcacgtacaaagggtggaagacgtacggtttttgacagatgaatgaatccttctaaaggttttgtaagagctgtgaccagctctgtttgctgagaaaagggaaagtccttgagcacccatcatacctcttcagactctcttaaaaagcattcagatgttctgccagaggaaatgatgtgttccaactacagctgcagtggagggttctttttgtgcagctgaagcaattcctccacatagattgtcccattttaacagtaaactgtctgtttaaaacaaaacaaaaaaggtgggtgggaaatggaaggagaaggagtttatgccaggaaatgaaaataagttgctgcagaagcctgttttggttgtggtttcagagttaaggataagttattaataataataataagagcccacttgatagtttgttatatctctgtgtgtgtttttatgaacttttaattttccagaaaacattaaagataaattagagaacacactcctgttggaggaggtgaccatcttgcagctaccaaaccatagaatctttcaccacttaacaccttccaaggaaccgggtagacttctggtgtcctctctggtcctcttcccttccttataggatgtcaggctttggacttaatcagaggataattaaggctctatcatagcaggtgaagtttctgagtggaagtctaagaagtgatgtttctataagtgtctttagctgactgagctactaagcagaggttaggaggttgtgatgtaatttaaagtgacattgtggttaccttttatcaagctcaattgtgagcctggagctatgttaactgcttcacagctatgagcctatttaattcttacaggaatcctcattttaagataggtttgattaccctccgtttacagatggggaacttgaggtagagagataagtggttagtttgcaattacacccagcatttggcatggctgggattggaaccaggggccttcagtcttcaaagctcttacatgtaaccactgagtgatgcattgtactctctcctgtaaagtagccttttctccctgctgccactggttcatttccttttccttttttaagatgctttaaaaagaacaaaaaccaataacgtacctcctaaattgaggttgatctccctccttcctatccaataagtaatgttctagactcatgcaaatattagatatttgggagaaaaaatgaatagaacatgtccctcctctctttagctctaagaaaatttgtgtgttcttattaattcctactgttccactatcctaccatattacctgatacatataatacagttacagtcttctcagggagactcttctatgcagtggcatgctggagccaggaaagcttgtaaacccagctcagacatggaccagctgtgagaccttggtgaagtcactttaccctccgggctttacttcttttatcactgtagtgtttgatccaggtcagttcgcagcctggaaggcacagccttttccaggacactaaatagggcacatgtgctacccatttgcgtgcacactatccttaggcatttgttgaagagatggttaataaaatataaactcattaaaaagcattactaaattcttacattttgtgtttctttgatcagtgaatgactgctaaaatttagtacgttatcaatggggaatttgttatctctttttgcataaaaggggtcctcggttttcgtgaagtttaaagtccctccccaggtagaatatccataaagcctatgaatgagtcttaactacttgattacccagattctagctttttggaatctttcattaccttacttttttcccttctcggtgagcttttggacttaggacaaacggggaacgatcacaaggaaatggattgacatctctactctttcacaatctttcctgaagacatgatttttttttgctatcatgtctctaagtacagttggtcagttgtcactctgtcacc

SEQ ID NO: 125618 - DNA, 2025 bp, Homo sapiens
cccctttctctctgtttctttcatctcgtaaactgagtgctgatgccatttcacactttttcttggaagtttaatgagttagtagtagtataacaaaaataaaaatattttctttacgtttctgaaaagaaatatgtctataaagcgtcaatcatttttccaagctgttagttcctgctgctgagtactaggagctgttctgtcagcaagaccacgtaagggggaatagtaagagaaagctgtcccaattttctttctctggtacaaaaggttagaagatgttgtttcagctggagaacttaagatggattcttattcactatttgctaaagagactggactgtttttagtgtgataattttctgtaggcgtggagaaaggtcacctcctgatcttgttttggagatcatggggttaaatctgtggcagtgtccttttcctagacacagcctcttgtcaaaataatgtttggccaggtgttaatctgtgtcctgaggggagtgctggaattcattattcatcccgtgggagtaggggtcagaggagaaggttgtccttctgggaggtaccaggggacatagcctgcctcctgcctttactgacatgtgccatttgtgaggagggcagttgaagtccatttgaggaattctcttgtcagccggccaacacagaaacacagagggagtgggagggagggagaggcaggcagcttggcaaggcagtcctggagtgcagtttccggagcaagatcacacacagtgttttaggagctcagggaaggtgtgcaggaacataaaggggaagggggccaggtttgaaagagtggatttttcctattttttccaccttttattcctcctgtctttgaatacttgtcatcctttggaaaactcagcatcggaaagaagcctttgctgacacactgctttttctccagcgctatattgtgggttttttgtttttgctcttttcatttttcttttcctctgagggcaggaggtgagacaatgatcaagtcaagctggttctatgttaagttcaagtatgcagagaaggtaagtcaatatggtttcttttcccaggggaaacctgccacctccctccagtcttgtcatgttgatgggctcctctggccacttggggaagtgaatgaagctgagaagttgtatttgtgaatgtatttcctttggcttaatgatccttggatgaagcacaagctctttgcttgcaatctgacgttgccgctgaccaagtggaagcaatcttcagactctgttccggaggcatgatttagagtttaaagaggggaaataatgaaactacaataacaggaaaggcaggatattctgctttagattgaatagagaattttcaaggtattatttgttacaaaggtagatatatttttggttctgaaacaaattgacagtcacttcctattacctgttggcttagaatttttttcctctttcagttaactaactgcttactcatttgtagtcttacttggttgtagaaagaatccccataaggttgtctgaccatatatgagatgatctctttactgtctgtcaggggattatattttatgaatgaattttggttgtacctaaaattttgatgttaaacagttccactgtattttaacataccatttctggacttttaggggaaaagtgtactttctaatacatcttcacttaccggggctgtttgacatctttttggttccacatccatatgtgtcacttactctgttgggaatttacaggattagaaatgaggtttccaggagaggatatagctcagaggtagagcattggactgcagatcaagaaatgagatttccaggaggatcctaacgtgtgcctcccttttgaaatcttccctccttgatttgattgttgaaaacgttggcatattgattgtagagttaagctgaggctctatagaatggaactgtgatgtggcaagatggaaaattgtgcgactgtctttatactccttatgattatatgcataagc

SEQ ID NO: 125619 - DNA, 1029 bp, Homo sapiens
atcagaattgccgctgctggccttctggaccattagagttctttctggttgttatccacttttcattccttctcaacccatagaattccaggtggtgagtcagtttttctgtatgatcatgcttgacaccccaaaatctacctgaaagtttgacagatgcatggaagccaggagcattttaggaagctgtactgctcttctgagattttctgcctacttactgtctgagcattcaacctgtctctctcaaattttctctttctctaaggtgggtccagtaatgcgagtcggcagcccactttgctgttcttggaagcgaagtactttccaatagaagtcagttttaatcttctttcaccgtgaggaatgaatgaccattttaataaataattcattcctacagttcactccgtaaggagcttctaagctccctccatgatggtttctgatcctgccagggtactgctattttatctgtcaaatgtgggttgttagaggtactgtgtcataagaggcagtgcagttcggaaccctggaacccccttcataaatttgcaaaacacagtgcatggggcctgctatggcaaggtatgctacatggagcctcagctgtctgctccctctcttctgtcagcacagctagcagtcagagacaaatggctaaccctctttgagtctcttggagtaaagcctggttgtgttctgcgtggattgcatcctgtgcagattgtggatagcaagggcttccttgcaggcctgttgggagcattgattgagatcatgggtgtagaaagcctggactatagccagagtcaataattattagttctttatcttgagacaaagggaagtgttaaaatatttttatatcaaggaatctcctacaaacactgtcctccccactgcccactgccagtatttacatgaattaattttctccttatcttcttactctcgcccacccgcttccctttccttccgttccaaagttatactacacttattcaggatagaaatttcctttataaa

SEQ ID NO: 125620 - DNA, 1073 bp, Homo sapiens
gttttttgaaaattggttttatatgtttagcatatggggcaattctaaattagtatatttgattaacgttgtatgctagtcctttgaaattctgcagttggattgtgtatatattgtgtataatgttacctcttttccgacttcatgaacctaacatttaaagtggaaacaaatgcacgcatgtgttagtgtttagtgcagcaagaaagcacggcccaccacttccaagaagtgagtcgttgcatagggtgccccgtcctcagaacattgctcattgttcattttttattcctcagctccttagttctactcaaagtctaatattagtttaactaccaaatggcagaaaccagagtacgttgtacatttttcttgaaggatacaactggaaaaaattttgcagaggctcatgtgatgctattttccttccgtggtgacacttagaattcgtttcacattgcctttgagagaaacgaggaggggggagaagcctgtatttgatagttttgtatgttcctctaaagaaagagagtgcttgaaaaaagaaaggcaggctttcagatgttgtctgaacaaagctacggaaatgtgagacgagagcagcatctggagattttcaaacactggaacatgggctgcacgtttcttttgctgttggaggagtgaaaagctgtttcctgtcatttcccatcttgtcacttccagaaccaacatcttgctacttcttgcaccagctgctgctgctgttgttttttttaccccctccacagacagatggtaaaagagctttgataatcctcgcccaacttccccagttctaaagaagtttgcggtgtggtacctttatacaatgatcacatgccctgatacctactgtagcctgttaatagagttgggaacagagcagaaggatgtgctgcagacttttaatgtctatggcattctttgtcatgtctcatgggaaatgctgtgcacaagccccatctctgtggatgcttcgatttagcttctgaggttatatttagaaaagaggaagttgtggggagtacctttgcttccataagaatttgaga

SEQ ID NO: 125621 - DNA, 1033 bp, Homo sapiens
ctcacatcagttctataaagtaaggattatttatttttattttagacatgagaaaagtgaggctgagaaacatcaagtaattttcccaaggtcacacagtgcgcaataggtgaagctgggatttgaacccagatagtctgtcttcaaagctcatgctgtttgtcatttgctcatctatgtttaaaaggtctgaatattttttaaattattgatacatatagcctaagattttctatttattcagacttttcagtcatgagagtacttactgcgctctcaccatcttcacatatcatcaaatatgttttacctttataggtgtttggggtgaatgattgctcagtttttacattggcctttcttgattactagattgattgggcattttccatgtgttattgatcatttttatttaatctataaattgtttatgttctgtgtggctgcttttgttcaacagttaatttttttgtatacaaaatcatcatgtgttaagtatattaactctatgttgtgtttgtttaaaacatgtctccttctgttaacttgcttccttatatttgaagaaaattgtatgaatgttttaaatatgtacatattcatattttttctttataattctctcccacaaatcagttatttagcctatgttttcctttattttatggtttttactatttataacaatttttaaaatcaaatctgaaatttattttaatatatagcatgctatgagactttgaatttattttattgatgggtaatactttttgtttttgttttgctacttcctttaaaaaatattatgcattatatattccactcttctgtggtggcattctttattatatatttgtttattttgtctaccagcgtctcttcaagcaatctttctgtgtcagtggcctgtgtatgggtatgcctacagacattttatggatagtaaatttgtaaaatgtgcaagaagttttttgtcttaaaagcacccagactcagcatcagaaggcccatatccaaacctcagtataacctc

SEQ ID NO: 125622 - DNA, 1028 bp, Homo sapiens
aaacagataagtactattcaaatacaaggctttatctttcttactgcctggggtaagatacctgtcttccctgtcccaagttatatgatgcttatttaaaaagttacctgtgagccttgcttattaaagtatgcctcagctatgtcatgaggatatttttttttaattaattttttttgagacagggtctcattctgttgcccaaactggagtgcagtagtgtggtcacagctcactgcagccctgacctcctgggctcaagtgatcctcccacctcagcctcccaagtggctagtactacagtcgtgtgccaccacatccagataactttctatttttggtagagactggggtctcactcttttgtccaagttgatctcaaactcctggtcttaagcaatcctcctgcttcggcctcccaaagtgctgggattgtcagcataaggcactacgcctggctgaggacatttttaaaggtgtatacttcaccatattctcttttcctctacatgaagtttagcaatgttcaagatggtggccactccatcccccttgatgactgagtgactgtgatgagccgagcacctgctgactcacaacagccatagagacataagagtgtgaacaagaaataagcctttgttatttttagccatggagattttgcagttgatactacagcattatgtagcctatcctgaatgaggtaggatcataataatatgtttgttatgcatcacacaagtttttgggttgtttcaatctaaagatctgaaattatacccaaactagatattctccagtatcaccaaacaggatctatccattctacagtgctcaccagattgcttctgtcatacttcacctggacatctgtggattctggatattagaaattggaaggaaaagcttgtaaggggatctcagtgcccagggtcaaagcttcattgttgggcagccaaggaagagatttgcttgacttacttgagtaatttttgacacatacttgatttggtcatcaggcataa

SEQ ID NO: 125623 - DNA, 1122 bp, Homo sapiens
caaagtcaggaattttttagtttcttttgtcttcacttcttgttattctctcacttgctttacttcttccagccttttccttttccacctcatctcctgcttcttatttcctcatctctttttccttaccattttttcctcttccatttctcccttgatcttttcattatattcaattcatttcattcattgaatggtgttagaagaggctttgtctttgcagtcagaaggctcaggtgaagcttcatatttcaaagcacactatgctgacactaagaaaacatcttgcccgggcacttcagttgaagaaaactatatgatgtgatcagtatgtgatgatggcttttcagatcagatagctgggttgtatttataatttatttctcttatcagtgaaaaagataaatgataatgtagtaacaggattttctagagtttgggttgtagagaaataagtgctcatgaataggaccgcatatgtgtgcatgtatgtgtgttttgggggtatggagaaagaggaggaaaagaatattttatagagaaaatttccatatggttaccttttataggatctagcacatttcaatgaaaacacactttgctggaagaattcaattctctgtaaagtttggtgcagcaaggggtgaaaatgtggggacacagctggaaacttatttgtgctgcaggcttgcagctgtacctacctgtgatgcgatgaatactatttgattgttaatgtctttctgttactgaaagcttgcttcctttcctaaagctgatggtaacaatttactgactgtctaaaccttgaggactaacttgggctgggaaaaataaatcctgtctcctgaaatttacatcttattaaaactcaaagcagccagcagagatgagaaggatctccagcctgggagctggaggtgggaattctgctcaagtcaagatcgcttttagctttcctacattctcctgtgaagaaccattggattgaatgatggtggcaaaactggtgtgacttcattcagtttatctctatcccatttcccctctccacatttgactgtcagtctactaatgagacccagttatggtccttggaaggggaaatggaaggtggacata

SEQ ID NO: 125624 - DNA, 1074 bp, Homo sapiens
agagcaggacagactgctttgaatgggggaaggggggatccctggcagtttaaatgacttttctcaaagcaggctgccaaaaggtagcggcgccggccagaggtggtttgagaggcaaagcagcaccacagacaggggtccaaggcaagaaaacgctgagctgctctcaggtgctggaaagccagtgtggcttgaagcgtgctaagagtgagactggaaatgcatgccaagtttgaggccgagttcaggattttgtattccatgataagtgtaatgggaaatctatgagaacttttaagtaacaacaatatgggaatcatacttgacttggctagaacaattaaaagctgatctcttttagaaagtacagttttgttttacattaatcttaacacagaatagtgtattacacctaaagtgaatactcttttaggctgggtaggggctgtcccgtggtttaatattgtttctatcataggagaagccttggtttcctagtttcccaccttgtttctcctctctctgccccactgggattctagctgcttcttcactgcatttgctcacctcttcttctccacagtcctttggtccttgaaatgctgtaagagcagaaataacagctatccagagaccttcagatagcagatgtgccttgggcctgtgggtctgtggctctggagggctaggaattacagaagagttaaaagagaaggcctctgccagcaggaattccgaagacaccaaaactgatgtcactggctgtgcaggcactgagctaattcttttgccaatcagttaaatcacctaccaagagtgttcattgtaagtaacactttcttgccatttggtggggatgtagagggacaaaggatgcaaaaggcaacaggttctttccttgtaaaactgtaatctaattctgtaaacaagccatgtacctttggaaggtcattttgaactcagtcctggtaaatatttgacaggtgttttaaaaaaataattatatttatacaatctataatggaatattatgcagcttttcacaaggaggaactcctgccatctgccacaacg

SEQ ID NO: 125625 - DNA, 1014 bp, Homo sapiens
atacaggcgcccagctcttgccatcttagagtctttgcaatttttacttttatagcctaaagtggcgctttgcatgcctagatgtatcttcagcctttatactttaatcattctgaggggggttttctgtgtccctccttcatcaccttcaccctgtttactccctccatatcattcattcctcaatacttatttccatgtttccctgtctccaccactgggatgtaaggatttcttatcacttgttctgtgcagttaatctcagtgctcgggctcacagctgggagctgataagtgctcaatgaattcaagtgtttagaagaatgttagtgcagagtagagattgggcaggcagtgttagtaggttagtaattattactagaaccaggtagagtttctacaacctgcattgaggccctgagcatgaagaatggagtgttaaaatgagcctttcaaaggcaggattggcaactgtgtgaggtgacaccactagagacatggtttggacagcgcttccgaagatggaataccagataaagatcagtgtggatggtggagtccttaactgattcagtttaagatatttgattttgatgcatttgggaatagggtgctcttgctgagaataggggttagggctcaatttacaaacctttctgttcctacattctaggttcctatgattataatgattcttgctgataatattttctcccagcattatttcttatatataatacgtgactataaaggctcgttcctgtttcaaatgcctttgcacatgcatgatttggatttttttccagccaggtctcaggggccatgtttttaaagtctgctgctctttgggctgatattgtggcttcttgaatcgcatacaaagcaggtttcttgaaatctgctcatctaccatagtttaccagttatctgtatccttgcggctctgcttgaactgaagcttaatcttgttctttgtagggcccagctatttttgcttgtcattctatcacatgc

SEQ ID NO: 125626 - DNA, 1028 bp, Homo sapiens
atttggccatgggaagcaggctggtgactgctttgaaatgaaaaccagatcaaacgaaaattgtaggatggtgtccttatgatgcctgcacctcccctcctccccaaatctctaggatgcttttacagagtctttgctgctacgttgtataaagattttaataaaaatttcttgtccctggagaaacaggcatgtctttgttgtcagagagctagagggaaatgagcaatgcagcccagctggagtaccagcattaatcccatgattcgtagcccgtattttcagacagatcaattacttatggctgtaaccaatctctcatcgttttcttgctgtgcagggctccatttccagactcggcagctgacataaccttccaacttgataggacttcagctgcaaatctcttcaggtctgctgcctccattcatcgtggttatacaaatgagttgttaaataaaaatcaaaagtaaaaaattatgggtggtaatctctgcctggctcagtaatacccatgggcctaggcaacattttcagttggatttttaaaaaacaagatggatgattcacttgtctgacttccttcacttttatggacaggctttgcatgagagaaaagccatctctagagggaagaaattatccacagtggatacatttcttatcaatttataagttgaaagattaacttagaagtggagagaaaggagattatgaggagacacgaaggacatgtacaggtgagctgtgtctaatgcatttcacactgagtgagtcaccccttttcagctgctaggctgcctgggcttaaggccaggagattctgtatcaaaaagaaatgacccttgctaacacagaggtgtcatggaacatgtaagctgtttatagagtatgtcactgtgtgaatgtagaacttgtgtgaaggatctaaacccaataacctttgaagaatttacccagaatttatttagtgttttcaagttataactactccttgtgtgtattgaacccttcacagctatgtcagg

SEQ ID NO: 125627 - DNA, 1005 bp, Homo sapiens
ataacatgaaggtgggtagccaggaatgttgaacacaattagcgatttggaagaatttaaaaatattcaatttaaattagccctagggtcagaacacacattctcacctaggggtggagtacacatgtgtcctgtctgtactcagggagctgtaacagtagccatggcctctctgtgtggatttataatgaatggagcacatctattttagatggataatcaattttgaaatcccttattgtaagtatgctgttaaaacagaaatgttaacttcatgagtttaatgagtagcttcgatgatagcttagtgaagagatggaaggaaaggcaagtggggggaaatgagaaaaggagaacaagtgtttaatgaatatctacttgcagacttgaatgtcagcagcaacattctccctcctggaaaatgtctttcaactgtgcatcccattatgttcctgcagcccgtggtagcatgaagattgagacaaagagagtgtttctaagaaagctctcctttacaatataatgagatggaggtgggtagtttgcagagattgctggagcagtggtcaaatatgaaaaaaaaaaatccagcagaatgaaaagaccatgttaaccaggagatggcttataatgagcccagaaattgcatatcagatagccagctggctagcatttcctcatatccctgtgttctcatgcaaactgctaaaatgttctcctactctattttctcagcctcttaatagttctcatttctacctactgcattgaaaatatgaatgaaatggcaactctaccacttgaagaaataagaatgaagcccttttcagcaaaagtatttgcctaaacatggatggatattatttcaaatgcttttgaaaccaaggaaacttctgtttctttccttaaaaaaacatcttaactttcaagtctcagtttgactcacagccttttcagtattctgtggcctcttttgctatatagtttggacagactttgcttgaa

SEQ ID NO: 125628 - DNA, 1162 bp, Homo sapiens
ccttggttttgtgttccaaagatgtctgcttaggtctgtcacttttccaatccgtttagaagcagaagatttgagaaatgagaacagcagctcaaatcagtatttacataagcatattgcaaagaattcttaaagtagacaaaatagagaaggattggaacaaactttctacatttttgggagcttttgaataatgtgggtgttatacacacagagagacacacatatatattcattacatactcatgcccagctcatattctaaatataaatgaaagtatagactagttggaatcgatttgctttttttttttcttttttggcaagaggactaaaacttgttagagtgtgtgtaggattttcttttttttttttgttttgaacgtcaatgcaatgaacacattttcttttcaatttaaacgttttaggctgtattttctccttaaacatgtatttgaggtttcaatttgcatagtgtataattaagaacttagaggcagaatgatcttttaagactacctgtatgaccttggtccggttattttatgtctctgagtctatttccttatcaatacctacctattagtgttgcaaatattaaatgagataagatattttaatgaacacagaatatcactctatactaccaaataataagtactgccttctgttattcacacaatcgtgtgtgatggagcaaagttggtctcatcaggtggctgtgcaatgttgtgcaaagtaggttttataatttgtacctgtaggatagtagtattttattcttattatattcttcttgtagctttctcaggagcacagcttttgtatttgatcagttatttacattttttctgtatgtgaacataaaacagggtattcatcctctgtgattctatatgaacatgacgatgttggaatgaactgttctattagctgtccacatattatggttgttctctgtaatttgtcagttaaagttacttgtgtattttcttcctcagaagcatttgaagtacttggagcttttaaagactgcttagcagcttttaggattgggctgagagggaaggtacacctgttcaatatattccacttttatgaacttgtatcacatttgctcctttctgacaagaaaaagaaaaattgatgccctagcatatat

SEQ ID NO: 125629 - DNA, 1035 bp, Homo sapiens
ggagtcctgatttcaacggagtggccgagtctgcttttgtttgaaagtaatgtattttaaaattcattatgaacaataatgcaattattcataatgaataatgttttatatttgcatcattcatttagggctagtacatagagatactgaagctgttggcttagcctgttccatagctagtagattgatcatagagatgaagcggtaaaggctttagcacagtgcattgacagtcccagagggaatggacaggtcattgccatggaattctgaaaataattttatcttcattttcatctttttttctgacattggctttaaggaaggttgtcttatccttgttggagatttccacattacagaaatttgttgcatttgttgatacaagctatgtaaaatgacccacaggcaatgtcaattccggaggtttactctgattacccacacaacccttattttgatagatttaactagcctggagttttattgactatcactcagaatctttcagatcagagaactcactcctttgcttaactacttaaaaaatatttttgctgaaattgtaaattagatgcctcccaatccattgcataagaaacttatagcttggtgaaacaccaagagtatcatttgaaaaagaggttaaaaaacacaactggggcttgttaaagaggaaaagtggtattttaactccaagtgtcacattttcctatagtcagctctagcagtaaacaagagttattggaggcttagatagtttgagacacttcacttatctcccagtacttgacttcagaagccaaacatttaaaatgtgttttgctcaggtaaaaatgtttatccatttaaaatacaatgtcattttaacaaaagcaccctggtgacaagctgtttagatatagcacagttgataaactgtcagatcctgtacacatacacttgaaaggaccagcgcagtaacacaaggattggcattataaatcactgttaacaaaccttaatttgcttagtaggctaatgaatgatctccaa

SEQ ID NO: 125630 - DNA, 1048 bp, Homo sapiens
agaatagacaaatctactaataaagtttgagatttcattgctcatccctcacattgatagaacaagttaacacagattaggaaggacaccaaaaacttgagcaacactaccggtcaccttgactcaatcaacatttatagaatgtgcccttcaacagcaaaatacagttttttgtccaaatgcacatgccatactcattgtagacatattttgagctattaagtaaatttcaataagtgtaaaagcattgaaatgatgcaaattatgttcactgaccacaacagacttaaactagaactcagtaacagaaggatacccggaatgtcctcaaatttttggaaattcgataacatacttttaaataacccatatcaaagagtaagtctcaaatctaatttgatttttacagtttacatgcctcttttttctaggcatttaaaaaatatacagaagtacagtctagactgcacatgtgtatataattgatgacagtgacattctctcggaatttatattaatgtagtgcacaatatatttgaagtacatttggcataaggacgtactaagtcacaagacttgtttggggaatgtgatttctttggataaaattaaattccttgaacttgacaactaatcaggctgaaaaaatacacttgaagctttctgatacattattaaggaagttacagaatatccatgaatttagttagctttacactccagtggtactcctgagtattttgtaattgaactcgttgatcttcagatgtgaattggttcttcagatctgtgaccatcagtctgtctacaaacatttatgcaggctctctgagcaagatgcctttcctcacggtggtttctaaactctcccaatattttcagctgcctgggtaggaagcattagggcagacgcccaggctggaatgcagtggcgtgatcttggctcactgcaatctctgcctcccaggttcaagagattctcctgcctcagcctcccgagtagctgggactacaggcgctgccaccacacctggctaatttttgtatt

SEQ ID NO: 125631 - DNA, 1377 bp, Homo sapiens
aaattagagtctttaaaagtcttggtgtttagaaattaatattagttttaatatgactctttaataatgaagaatataaagttctctgtgtgctggtgagaggactttttatttttactcctggaaatacatgatttgtaccagtcacttgtgtggccataatatttttgccctaaatattaggtcatcatttcctctttattgttaggtaacccagaatgctaggtattctctaacagaagaaaaaaaaattggtttgcagtcctggtaagctgttggagattttaataatcccaataaaatatttccatttttcaaatgtgtttagatgtccttggcagatttagattagttacatgagatggatagaaaacaggctcagggcttagggtttattttgatgatttttaaaatttgttgaaataagagttgttttatttaaggaaaaaataatatttctggattaagtatttcaaatgcgttatttttggagagatgctacagagcttatgtcaaatgattattaatatatatatattttttttgagacggcatctcactgtgtcacccaggctgaagtgcagtgtcgcgatcttggctcactgcaagctctgcttcctgagttcacgccattctcttgcctcagcctcccgagtagctgcggctacagacacgtgtcaccacacctagctaatttttttgtatttttagtagagacggggtttcactgtgttagccaggacgcttttgatctcccgacctcatgatctgcctgcgtctacctcccaaagtgctgggattacaggcatgagccaccgcatacggcctattaattcttaaaaacaattgtgaccatgatattagcacctaaagcactattccttttcttagccttgggaagacttcatggtcatgaatactattaatttgattttttaaaattatgagtgccatatggctgtagaatgcagaggtttcatgaaatatattcagtgagaaccagaagtgatttactaatgcctcaaactcatttaaatatctaccaattcaacatataaaattgtcttcacgagaaacattacggggtatgattttgtatttgatcataatgcttgctaattatttcctgttagtattactggtaaaatgggggttggcaaattctagatagtgatgccacatatgtgtggtgtgggttccttacaaaactttatttgctgcttaattttgtaacattgcatcattccctaaatagcctcaagatccaaatacaattgcagtaatacttgctgaaaattggaaactattaaaaacattcatttgctgggaatcaggagaggggagggaatttcaaataatagaggtttttttttatta

SEQ ID NO: 125632 - DNA, 1166 bp, Homo sapiens
ttcattttttgaaggtgctgattctcacccccatttccagctacattgactatcgttagccacttgttacccatctagtgaagccatcttctatagtgcagtgtgtgttagtaggaaaggcttatttggccttgaagggctcgtttggccttgatccggtactgattgtggtttgaggttgagcatgttaaggatgaatagtagctggaatggtccatgatgtgtgcttagtatccttcagaatgtttacatagtcatatttagattgcttctgagaacaagagaatacagaacaaaatgttatgttccaaataaagatcacaataagaagaaatattgcccttctagcttggcatcctttttctgccatgatttccctttgcattttcttcccataccttagctttagccaaggatacagcagtaagtgttgcttggtatttaatcaaattaaaacctgtgctaggtaatgcctcatagattttattttgccaagatagatgtttgaacggaaaaagaaatagtgtatattaaggactaaagggggtactcttgttttctttcaaatatgataattagtataaaactgtctttttcctgccagttggctcatctcatctcctagcagctgttttaaattccttaattgtctattgcttactcagctatcatttcacaaatttcctcactgccgcattttcgttgaagcaaattctgacagtgggggatgctcacctcacaggctgggttgagctgagttctagttatcctctttgagtaacaggattaactatcattagacagtgcattcgggtaaggtgatggttccctaggtctctttggagttgattactatagaaatgggcatctggtggagcctcaggttgccaattgcattactcttcattttactgatgtttcaattctgtttaacccaacgtagacttttttttatgcttataaagtaataggagtttcctagaggatttgcagcgtacactattgtataatctcattgcttataattttttttcagaatgaaggaagtgggtattttaaccatagcattttcattccagtatcattaaccatttaaatacactttgttaaatctatcacattttctgttaaaataatgtaaaattctagtagaaattttaacagta

SEQ ID NO: 125633 - DNA, 1070 bp, Homo sapiens
tgtatttagacacacaaatacttgccattatgttacagtactgtactacataggcaactatgctattcagtacagtaacatgctgtagaggtttgtagcctaggagcaataggctataccatagagcctaggtgtatagcagactgtacaatctaggtttttgtaagtatactctatgaagtttgcacagcaacgagatcacttaacaatacatttctcagaacgtatgcccattgttaagcaaagcgagactgtaattgacctaaggtcacacagttaacaagtagtgaggttttaaactaaggcctttgaccagtgctcttgatcattacagagtggtaccaacatggtagcataagctttaagaggagggaaaacttggttcccgtggctttatcagggaagacttcttagaggaggtagcagttaagctagcccttaaagaataagtcttatcttgaactgaatgtatgctagagtcagaattatagaggattagattcagaataaaaggccatctgtttcaagttcctaatttgcagaggagaaaactgggatctgtgaggttaaataacttgttgtaggacatatggctaattaagtggcattagaactgttctcttccctcctctatcctgtgttattccctgtccccctccgttaatgcacactagctcatgttaagtctgttttttcatcaacactttctaataagagttcctaaaaacattttacagcttgaaagtggaggctttcttgtgtatctatgtatggtgatgaggttaaaccaggaaagggtcagggcaggcatggaaggagatactagagatacgtggagacatggagagacagaccttttctatctgttttttgtttttttttcctagcattttactttattgttacatctgtttccttccataagtatagataattgagtgttgagagaaaggggacaaatgaaattctaatgagaaaaaaatgatttaaaattccacaaaatctatggaatttcagcctcttaagtaacctgggatgtttttaactttcactaatgtttattagccagt

SEQ ID NO: 125634 - DNA, 1034 bp, Homo sapiens
catcttttagtcctagctactcaggaggctgagaggagaatcactggagtccaggagtttgaggctgcagtgaggtatgatcatgccactgcagtccagcctgggtaacagagtaagaccctttctctaaagaaaataaaaataaaacatagatacctgtgttgttgttatagctgttcatatccttagaattaatttaccttgtctgctcctgcatattatttgtctcctcataattagcaaagttccacagggccagatatcaccaaatatgaatagtagattttattctaaggtcagtgagaactgaagaatgttaggggctgactcaatcagatttgtttgtatttatatttggaaaaatattactctccggagaatgttttggaatgtttggcagggtggttggagagacatactacaggaaagaaatgatggtaacttagttggcagtgggaaaagtgagtagtgaattactcagagctctttgggggtgaaatggactggacttatatcagttgaacttgagaaaaggagaagcatcaaggatgatgtaacttttaggtttctggcttgagcagttgtgtaggtggtagtaatttttcatggtgaagatgatgaaatactttttgtacctgtctcatgattgctttctgtacatcaaggtcagaggtcataagctcataaaatgcttggtattagaattcttacataaaggatgtcttctgttttagtttagtaatacaatttggcttaaatcacagactttctctaatctttgttttgattgtcatctgccgagagcttaagacagcaactcacaggttggcccattgagaatctgacaaatgaaaaattataaaaaaaattcagaatccctatattgtagcccaactttctttagcacttctatccttgaatgctagggcagtgttgtatactgtgaagatctttgtagatttttctactctgtaacattttaatagttccattttggggtattacagctgttcagtcctccccatacctcaaat

SEQ ID NO: 125635 - DNA, 1002 bp, Homo sapiens
tgcctgctccctcccttcttatttactttcctcttttagcttagcaagtcctctctctaactttaagagttctctagatctcaccagtctccctttcctgtccaaggagtcagatgctttcagcaggctactttgagcaccactgtatcatgctttacattttatgtctcctccttgcctatagacagtaccccctctgagtttattattagtgttttttttttaactgtaggaggactaagatttattgcatgttattagtaaatacaaattgtcattttcctcctcttcttagcttttctcttacaatcccccaccttatttatattacttctgagctccagagaaacaagatatgcgtgcactcatcatcagagagatgtgtttctgtgtatgtgtgtttgtgtgtgtgtgtgtacatgcacttgtttgtgtgtggttataggcctgatcagacagatgtcagtttatcaattagtagaactccctaattaagtatttgctttgagcaatagagctcttattggttgtgaggtaacttggcaggagggaggcagttaccgatgtaatagagatgcctgagcagatagtttcgttgagcagatactatttgatgtcctttaatcatcagactcctccacttttccttcttctgggctcctgatttatccctaaacaatcagagcctctcctccataattttatgaactacaaaatttacaaaaatgttttacaaaccctctgcctccccagtatcttctccagcccccatgtcttggggcaggccacatcaggtctctctggctgcttcctttcccaggccctactacctactctggcccatcatatgtcttttgagaagatgatttttcagttcttttctttagtttagaaaatcagaattaattgattaatttttaaccccttctacctttctcctcccctaccatatgaattcatgcagagccagccctgcaacctaattttttttgttttgttttt

SEQ ID NO: 125636 - DNA, 1036 bp, Homo sapiens
atttcatgttcacgggcagggagggatgtgtgctgcatacaaaatgagacaaggcccaacgccctaatctttcatcaccttgaacctggagactaggacgcgtctcagcaccaactaatgagattgagcctgcgtctctcctgaggatgccggctcaaagaggcttttctgctcagaaatagcaggctctgtcttattttaataattcctcagatatgacaagtctgatgttatgtatgaaagagccaggcttgaaaaagagataaaatgaattttatatcattacttcaaaaccaaaccaagggaagtgtgttgtagttaaattaaaaaaaaaaaaagataggacacattttagtcatgaaatatactgactgtaaaccaggagtcatcctttcatttattttaatgcacaatcaccttagatttctcttctgtaatttttaaacctattcatgcgttaatcaaaataatgtggatgaaagcaggagcttgttcaataaacatttagatgaaaatatcagaggggacatgtaattcctgatggggtatgtcatactgaacctctgaagtcccatcgcttcttttggtggcatcttttgaaaatgcatcttttttctgtgtaccactaacctattactgtttagtctcttagactttaaaaatgcctaagccaaattactcaggggtattgggttctctcgtttttttttctgtctttttcacaaaccaggtaactattttgcatccatggaaaagaaggttttacagaacagatttcggctctcatacatctatagtacttctggcaaatggttgctgtttttttgtttgtttgtttgtttgttttaattcttagggaggactgagccccagagacaatgggacccttttcctaggtaaagaaaacgtctctagaaagacactaagttaagagccaggcaaggtggtgcacacttgtagtcccagctacttggaaggctgtgacagagaattgcttgagcctaggagttcaagaccaatctagacaaacatagca

SEQ ID NO: 125637 - DNA, 1048 bp, Homo sapiens
acatgtagattttgagtggacataaacattcagaccacagtccctgtgaagaaggtatttgttattctggcagtgcaggagcaagctagcacacttgccatatttagctgatagaagtaatgtgaaatgaaccgttaggaggagggattttgtggaagaaggaatggcggactgagcaagataaaatatggagaattgctccctcttcaagaaacgcctccatcctgatgtatatcagctttcatatccccatggatattttacaggcattgctacctctttaaacatttatgctattaaaaaaatcagaccaattgttgacataaagctaacatagcagcttctatatagacagaatatgaattttttatgctgttgatgagaagtttatgtcatttatatactatagtagggtagaagatggatttggaatcctgaaaaagctactgtttgtaccattcagaatattagcttgtgctttgaatcgaaatattaagatacctgtattgtcaatgtgagtgtttctgtgcaaagtggcttacatatgggtggaatgggagaaattgctctacctggagaaaatagcaatagttttctttcgtttatgttttgttttgtgaaaggaagggttaatagcatttaatacctgatttatctgtgcttctctgcaccattaaaagaatgaactgttgtggtaataaaaccatatttcattgaattaaaagtgccatcacttgcaagatgcaacattattttatgtacctctaaaaaactacactaacaaactgacatgtcaaactgacatgccattgatgttaagatgcattccaatttcagagatgtaaatatactttaaaatgtatatcttggaatcaatgaaatactgcatatagttcttttgtggtatgtgtatatatgtatgtatacacacacatatatacatatgccacaagagaataaagtatacttctatttggttatagtctataatattttgaatcattttactgagttaggttttacttattttttaaagttgctgttgaca

SEQ ID NO: 125638 - DNA, 1192 bp, Homo sapiens
tcactgatggggaaaaatcaaattattcaaagtcttgcaccatataacaaaaaagctaaactaagacgagatttcagggagtatagaaaccagcaatttgtgaaaaatcttgtgtatgaagagtcatgatgtagaacattcaaacaaatggatcacaagagatttctcaaagcatgtcttagaggtgagcaggcaggcatcaattttaaaattctctgttataaatgatcataagcttatgtttttctgtgtaaaggagaaataatttcccaattttataaaacaaattaccaatgatgtaaaaaaaacatttagcacagtattatatcagagggcatttaacattcttttgaatcatttgagattttcatgtttccatttcagagatcagggaagatgtgccttggagaggaagcatgtcttaaatctggaaatgatatgaagagggatgtcagcaacacttcatcctgggccagtaatagggagagtttcttttctctcgtcaaattgcttaaaggattctagttccgtttggtgtggtcactcacatttgaattctaatactctatgtgatatagattctgttgactactgttagcgtgaccccaatgagaaattaaacacttccctccttttcatttgcagtgtgttttagtttaaccttcatttgtttctcttttctccattcctcatcccaattcaggtatcagatcctttgacaattgttaacctgcccagctgggatttttggcattaagctatgactgtaacgtttctactaataaattagattttttaaaagagtgctgcttgccaagaagcaaagtcattacatagtgtgtatatgttcaatgtatggctataaaagtctccttagccaaacataatcgacagttaaaataaatttaaaataaccgtgctacctctagattttaaaattgttaaggtgaagataggtggtctaattttactctatttccatttttcttattcacagggtatatttgttctgtaaaaccacatatgtatcttatagtctgcagctgatgtatttatctgcctaaatacacatttctccaatggaatattctgtaatatcaagcatttcttttttagatggaaattaattttataacagttgaacatcatctttgtcaatcagcagctttatctaccataaagaacaaaaacg

SEQ ID NO: 125639 - DNA, 1051 bp, Homo sapiens
ttcttttaaagttacacatttcataaagaagaagggtatcagtgtaaacttctaaatgcaggacaaaatgcatgattggggatggagattggagtggacttgttcaaagagcagcagcaaatgagacattaaaggaatacataggaagccacttccaagtacttccatttttctttagttgtgattgtgagatggttccctactagttagagaaggaaaattttaaaatgctttgctaaacagatgatccttaaattggtcactgtataccgtgatgcagcctaatcaaaatggtattcctttgagtgagtgagccacagagactctcgccaaccccttgtgcagctttctattaacagtataaatactccattgttgtaaagcagtttatggttaacaaagcgctgtcacagacacgttatcttagttttgcagattgcctttgtacatgttattctcatttcctagcatgccctctatccctgctttgcctgcttagcaagctcattcttatccttcaggacataacaccaactctgcaaagtcctcttgagacccttctgagcaggtagatggtcccttccccgtacttacacaagccctgatctcatctctgttgtcatttgttcacatcactgtttctccctggagactgagtctctcaagggtaaggacactgtgtgctcttcatttttcttcccagtgcctttgtaaccagtcttcctgggggatactttgtaagtaaaggtgaatactgtatggtgtgcagcttaggagagcttaagccacttcctaagttaagatactaagtagtagataagagtaaaacttaagtgtcttaactcctgtttttatcggtttttctggtttatcagtttattgctcatctgaaaacaagctgtccacatcatactcatgctgttctacctgtcagagatatattacatggtaaatgtgagtgataaaggaggataagttctttgtcagaatgaggacatttcggttctgtcatcatgcctgaaatgcatgatttcacatgatttccatgtga

SEQ ID NO: 125640 - DNA, 2007 bp, Homo sapiens
aaaaaatggcaagcgtttcttagtttggctctcttggcttttgtttaaaactgaagatcactaagcctagatttttgtgtctccagtttaaaaaaaagtaaatttcaaaagcagttcctagaactctccctctccataggcctgttgtgagatgcctatgtccctataagtgtgcttcaatctaccagctttcctaaaacaggttgatggcttagtggataaagatgggacttacaaagcctattgattctcttattgtactcatctgtagaatgggaatagcaatggtacatgctgatcttacatgatgtgaggatgtgatgaaataatacatggaaggtattgagactactgtctgggtcatagcaagcagttttgccattattatatttgtcatgacagttttgccattattattaacccaataataatgtcgtgtcccctttctccattcttgtctcccaaagatgtcacacattcattattgccaaaaaacatttttaaagctttctgtttttctggtacttgcagtgtggctgacgccagtagggtataactcctctgagaatgggtgctgaattctgttcccaaggcctatggggaaatctctttttgttgttgttttttgttttgttttgttttgttttgttttttgttacagtctcgttctgtcacccggggtggagtgcagtgatgcaatcttggctcactgcaacctctgcctcccgcattcaagcgattcttgtgcctcagcctccctaatagctgggattacaggtgcccgccaccacacttagcgaatttttttttttgagacggagtctcgctctgttgcccaggctggagtgcagtggcgccatctctgctcactgcaagctccgcctcccgggttcacactgttctcgtgcctcagcttcccaagtagctgggactacagcacccaccaccacgcctggctaatttttgtatttttagtagagacggggtttcaccgtgttagccaggatggtcttgatctcttgacctcgtgatccgcccgccttggcctcccaaagtgctgagattataggcatgagccaccgcgcccggccacacttggccgatttttgtatttttaatagagatgaagtttcaccacattggctaggctggtcttgaactcctgacttcaggtgatccacctgcctcagcctcccacagtgctgggattacaagcgtgagccaccacaccccgctgggaaatatcttaaaagaatcaaaataagaaagttactctacttaaatcgtgtgctttttctgtgtgtgatttatggtaatcttaccatggggtatctgattactttagaaagatccatttagcttatttttttcttctttgggttatttttttcttccttccatttgcacagcctccccccaaataaaaaataaagatataaagtctatcttctccctcttgtcagtttaagtaaaaagaacttttgcttccattttaataatagaatttgtgtgtatataatataggcagtgatttggcctcaagctgagtttagatttgaaaagatgagaatattaaagcttgtcagccagcccacaaaccacttaagtatttctgatctgacaggatgtggggtggagttctttttcttttctccaccaacacccctcacaattaaaataaatcagataaaatagacactgtgaaggtgggactgaaagtaggtgataggaaagggtggccccacaccaggaccagtacatatgcagaaattccgtccaaagtacttcaagggtctaggacagtgctgtccagtacaactttctgtcacattgaaaatgttctgcatggcccaacagagtagccacaagtcacacggggctgaaggcagatagtgtaactaggatttgaatttttaattttatgtcattttaatttaaatagccacaggtagctaatgtcttgaacagtgtaggactagaaaaaatagattttgacacacattctca

SEQ ID NO: 125641 - DNA, 1050 bp, Homo sapiens
ggttattattgatagaccctgccttctttttaagcaggaggacatttcctcgttctttctcttgttaaaatgataagtgcagagcactctcattaggatgtagccccttggctcccaaggacacagtgagatttcctttccttccgtgcatgttgtctctctctctttccctgccatctcattctgacatttcaagtaaacaggcatacatttacctgttggtaggtgattacatactaataaaaactacaagtaaggaacactaggcagcccccattttacaaattggcatttagtccctctataatctcttctctggagaggagtaatatccacctggatgtaaggctgggtggaattataatgcagccctgttacacagatggctgtcttcgtctgtgacatgtgtgcacacgtagacattcttgcatgtgcttttctgtcagcccagattgatgtgtgcataggttaaattgctagagaaatcagctttctacaccagttgcatctgatacaaatttctacctctggctgggccctggtgccaagtgtttgctcattttgacagtcctcaaatttgttgctttagatttttttcctctcatcttaaaccctctagtccagactttcgtatcacactttattatgtgtagatagctctaccaagaatatcaagggtatctagtaaaatcaccctcaacttccatctccgccatttaacatgaaaacattgttattcatgtttatgtcactccctctggagaaaaacatgttcttcattcccaaggtcaaagccatgttcttcaaccaacgcttacagtctcctccatggttttgtcacatcagtcattcctttccctttgccttgtacctgctgtctttttcaccacttccctctcagctcatgaactctagcgagtttcctccaatctttaaaaatctaaaggagaaaccacctccatcttgtgtgtctccatccctcaaggtcaaagaacttttatgcttgctgtcacccttcataacccgtggatgaatagttactgtatccta

SEQ ID NO: 125642 - DNA, 1034 bp, Homo sapiens
taaatgattatttcagaatttatattgataaatgcctatgttttctattatttcaatttgcccacatggagggtgattgttttttagtgtgttcccttagcttctggaatacaaaagctgatgcctgtataccttgactttgctgacggcagtggtagtgagtttagtgctttctacttttagctttatgttttgcactatttttgaattatatcaattagctatgatgtatacacattcaggattctttaattttgggtaaaaataattcttcactctgtgcctacttagctaagaatatctttaacagaggcagagctgtgaaaccaccgagcaccaacactgcctctctggcttttgcagggacgcttgggtttcaggctgtaactcttagttgcattagcctctgataacttttttgttaattgataagtatgtgtatgactcatcaagatgctggttgctcagtaagataaaattatattctctaacactacttctcctttagaagcttacttacctgccttggtgtcttctgtctcggtcttactttgttttttagtttgtagtttgttcttcagcttactaaacctctttcattgactgtggtattggctaccgatttaaaaatccttgaagacttaaaactcagcagacacgtacagggtggacccctgctttttctcaagtctcccttcatctccaggaactgaatttttcatgcagtaattaaaatttgtaggtcaagcctcccatggcaccgtttgctgctaatatgggaaagcagtgatcagattcgcttatgctgctcttcactgagctgagacttaaaggatgaagggtgacattttcccccattttgtaaattaatgccattgatctgcctaacaagaacaaagttaggcttcaaaataccaaatgataaagagattaagactttaaatggctttccaaaaggcaacctctattgtaaggctccgagctgactattgaactttcaattagaatttctaataggctattgacttaaatgg

SEQ ID NO: 125643 - DNA, 1046 bp, Homo sapiens
gtaaagcaacagtgtgtgttagaggaattgctgttaggaaaggaatgaggatatttggtgtgtaactgtgagtgctgggaaatgaaacaaaaggcagccctacctcaggtcctggaaaggcacatagtggtgtgagtgttgcagcccattgaagctacatcctcaattctggaaactaacaagaacagcattagggtgaggccagagatccacctaaggtgcaaaatgtaagggggcactcactttgagggtcgtgcaggttcaggatcagtactgacacaaccctgagaatgagtgtctcctaaaattgtgtgccctagacaccttacttacgccctgaaacatcccagccctgggtttttgtgcagtgaatgggcttgaaaagcaagtagataagaatctgaaccatggaaatatggcagacatggcagaatagaaatcaatgagacctatttgcaaggtaaagtcaagagaacctagggcagaaaaaaatacgaggcatgagagaggggaccctaattgtcctgtcactgaattctggggatcttttctattgcctgatactgacttttctccaatttctcatattcctcagctcctgccctgtcctgaaggtcatgcccagttcaaattcagcccttacctctttgctaagtcccatgccctcaaccttgttttcagagaaggccatgagaactggagtttttaaaatgtccaactctagatagatctgctttactgagtggtcttaacacattcagagaactgcattcttcttggctctctaaattcagtgaccttattttaaaagatgatcaacatgggttagaaccttttgaggattaggagacattttagcaagtttatcaagaataagcaaagatgacatttggctagcagtatgtctcccccaccccatcctgcaaaaccattttttttggagtgaagcttttccatttgacaagtttagaattaccaatactgcttgcaactccttccttactccaaactctgggatgttttcaggagggactcttttcttcaaa

SEQ ID NO: 125644 - DNA, 1465 bp, Homo sapiens
gcatgattctgtgttcccacagaaaagttcctgctgcttccccttgggtgaatgagccatcgccttgggtgtcatggcttacctgaagggaaagttgtaaagccaaggaggaggctgggggaggtgatggctatcagccccatgaaattgaccatgagccctgagccacctgaataccaggagggtcatgagcagaggcatttgtacaggtgatgtcttgaacaacatgcttcatgttagtggcctctgatagagtgtaacctgggaggctctttggttgtcagagaatttgtcttatactgtattagggttgcagagtgttctgtcttcaatgaagatagaactttttggtcatgtacgtgtgtgtgtgtgtgtgtgtgtgtgtgtgtgagagagagagagagagagaaagagttaatcccccttgacaactcctggatggcaagatagttacagataaatgctcctcagaactgtgccattctagtgtgacaaatataatcaaatatctatattaggatgtgttaataattatctaaactttatactttaagaagtccccagattcaacaaatgaatggacttctgttttcttttttaattaaagttacagctgggaaggtcaaattggttctcttttatacaggttagagattttccctatcagtttccatgaggagcatgttgagaagttctagctgtagacctgcatgacctcttcaggtacccgaagaataacccaaagaaagctggaagcagctttctcccttgttgttctaaaccaggcttgactcatatacttacggagacagccgaatggggtctttgaaataaggaaagaccagtaagccctgtggtgggtggttgtagtactcaaggagcccagtttgggcttcatcttttctttctagtgctcttagtggtttttgaagttcctaatttcctggtctaaaaatatagatgctactaatgtcttcggtcagtgaaaaactaagattagggtcaataatagcaactaaatagtaataataagcaccacttcacatgaaagagaacattgcattattcaaaacacttttaaaaacatcattttataagatctgtttaagtatttattgtagggatctatatattctcacatacaccatcgttgaccatgtgccaaactctctgttagggcttttcaaggctttatcttctcaagcaggtgtcattgttttacaaataagaaaaatgaggcataagtgatggagctgagatataagttgtgtcttaggattccagaatctgggccctcttcccatgccgtgctgcttccccgtacgtcagtgtgagttgggataagcctagcagtgccattcaggagctcatgctgtcatcccctctgtgtctcacctacttgtgctgcaagagacctggatcctgtttatctatccaccctcacccccacccaaacaattgcact

SEQ ID NO: 125645 - DNA, 1141 bp, Homo sapiens
cgggagcagcagcatctgaactggttctccccttgctcccctttcttttgccctccagccaaaccagtaacaaagggcattgtctagtagtctgtgtcagcaataaaagccatggggatctgacccgcggcagtgtgtttcagcctgcgaacttcctggatatctttacggggaatcattcccggggaaggaagggcaggctggaaataatataaggagatcaagaaggaagtcgagcaagtgacacctttaaacaggccaagcgagccgggctcttccccctgggacagttagagttatgcagagctgtaattaacccagcagcccactggatatgtctatttcaccgcacaaaggctgttgaaagaaggattcttgaagaaagaggttccaattcaaatggtatttgagtaagtcccttgtcggatatactgtttctagagtttatggctataatcaacaaaacatggccattctttcatgcaggtttctcatgactttctgaataccaatctttagaaagaaaaggggaaaaaaaaggcatccagaattgtctaggggtagaatgggggaaagggaaggagggggaaatatggctcgaatcaaattaaggacttggttttcttttcagaggatgttgaaaacatttaaaaagcaggtgtgtccttctttcataaatgaagactctgagatatgtaagaaaattttcagttgtgtattcaagtccctcaaaatcattttatcaacctccctaatttcaattaattttttaacaaatattttttgtatgcctaccctatattaggcactattataggcgctggggatattaatatctctctcctgccttcctggagctaatagtggggagagatagacaaaaacgtttaagtatgtagactaattggtgtgtgagatgatgtgctatagagagaaaaatagcagggagggaaatacagtggggagggatgcaaggaaggccttgctgagaaggtggcatttaagcgaagatctgaaggaggtgagatgtggatccggtgggtgtatgcgtggtggggtcagcgggtggggagagacagcagtgcaggcagtgtgcacagggattcgtaaggtagcagtgtccatggtagtgtgtgtgagg

SEQ ID NO: 125646 - DNA, 1013 bp, Homo sapiens
actaaaaaccacctgtaccccaaaaaactattgcatttgtaaaaataaatttctgaacccttcaaaaaaaaagtatctctggtttcacgagactcatatgtgtgtttcctcaaaaccactgtgggctcatcctttccctggattggctcccattaggggaccccgtgtgttcctgtcacatttccttctttataattgtgatctttatgattgctgttcatttccatccagcgagggtgctggcacctggatcgccatgcagggtgcagctgtggccagctcttcctccaggaaggagacctgaagagacgtattctgagaagcctgaattcgactctacattgaaaaattaaggactggcaaccaaaggctgtcacttgttgaagaaaaaaaccttaattaaaaaataaataaataataaataaataaataaataaataaataaacctaatgaagctgagggtcaaggggcatcgggataaactgttttgcaagggttgatgacattaggaaaaataactctattaaatcagaagtctgcctctgccaggtaatccttaccaaaagtatgcaagaagcttgagagatcagccctagaaggaaaggtgccaccccagtcctccaagggcacagggcacaggggttagcatgtaagcttgctagtcaggctgctgaggctcacatcttgtctctcgctgtacccttggggaagttatcaaaccttgctgatctttggtttcttcatcagcaatagccctgtcacctagggacattgtgaagattaaatgaagtaatagtagtatatgtcaagtgcttattagtgcagtgtcaggccaaagttagtgcttaataaatgttagttgttgtttggccaggcacggtggctcacgcctgtaatcccaacactttgggggctgaggcgggaggatcacttgaggtcaggagttcgagaccagcctgaccaatatggcaaaagcccgtctctactaaaaaacaaaaaacaaaaacaaaac

SEQ ID NO: 125647 - DNA, 1101 bp, Homo sapiens
tgtttctttttggtgtatcttctcagttctgtcccctaacctccaagccctggtgttctttctcctcagtcagaccttcttagccctgaaagctgcaggccaagccttaatgggcctctttttcccagcaacctgccgtcctcaaccctttctctggatctcacttttcctcatgggccagcctgaattgagcctcaggatcgtcctagctctcaggattcctcctgctcccaaacattctcatctcttttcctgggaggacctttcagccttcctaaatagcctaagggaagacgcgtatcccttcagggaagaaggaagcactggaaccaattaactgaaccccagcccagggctcttagaaccctttcccaaggtgagacagccacgtagctgactctgcctgcagtcccacctctgtcccacgggctcacttttcccatcacattccctagtacacaggaaaagttcccattttcttcaccaagcactagaagaggtttctaattagctccctaatgggatgatgacagtcctgttcagcaaaattttattgtcagcctatttgattgattatgtgagtgattgatcccacctactttgaaaatgaatttgaggaaaccaacaaaaaacacagatacattgagaccccaaagcaactcattctgggagaaggcaatcaataaatacaaaaggcagaaaaacattctcaaaacatagtacaaattaaagaaagttattgaaaaaacacaaatgcggttctgctgtgacaagcagtcatagaaaaggaacaactggatgaatgtcatggattaacaatggaagcatattatttaatcaggggcaactgactttttcccatccagtgtccgctgttaagtatagcattggttatgtcatcaatatccctaaaccaagagcctcatcatacagtcccatcaatgttgtataaaagacctagattttctgtgtaaaggtattgcttagatatccttcagtaaacccccccagaatgtgtcaacctaggacaaagccgtagagagacgacaaaaatcaggttcctgctgtgcccaagttcccactttagtgacgtagagattt

SEQ ID NO: 125648 - DNA, 1328 bp, Homo sapiens
tcttctctttttcgtgtcttttgacatttttgagcatagataaaccaggctgaccaatgcagccattttactctcatcaaggactcagaatggtgtgggtactgtgcacttgtttgagacaatgcccttccttgctgatagcttcccgaattgagcaaagcagatacaaaaaaagtgagcaagactctcagcctacaatctctagtgtggaagaaacaccctatttctttgctttcttacatcaacttcattttctacttgaaactgtaccccctaaagggaccttgcacttaagtcgttcccagtgcatcctacatccctagagttgtgtctgtgttctgtgtctttttgccaagggatgttgaaggctggaagtcctctaggtcttaggtcccccagatcactgtgggaagaccccacatccccatccctgtgagccaccaggagcctggtgtggccatttctcctggggccttgcttcctcctgtgagccattccagaatagggtgtggggccctggtgctctgacagccacagcttcctctgcttctccattctgggtgaatcttttccttagcgaagcccttccccatatcttaggcactacaattctttacttaagctctcttaaactttatctttctcattccattagattttcatggccattgaacttagcaactgaagaaaactagtttccctttcctatagggcagagagagctttagtaaccaaatgttcctaggaggagtggggaaacatttttattttcattccagtaacacagtggttctcaaagagtggcccaggtacccaagggggatccccaagaccctgtcaggagttctccaaggccaaaactattttcccaataataagacattatttgcctttctcacttactatcattctctcacaaatacatggtggggtttgccagaggctacatgacatgtgatttaaaatattgaatgcaaaagcaaatatgagaatccagacatcttctataccagacattaaagaaaattgaaaaaaatgtaaaactcactaatttttttgttttgaaaaagttatttttataaaaatgtatttaacaggtaataggtttattgttatttttaaatgaataaacattttacagttttctcagttttaatttatttatttttatttatttatttatttatttttgttgagacggaatcttgctctgtcacccaggctggagtgcgatggcgcgatcttggctcactgcaacctccacctcccgggttcaagtgattgtcctgcctcagcctcctgagtagttgggattacaggcacccacc

SEQ ID NO: 125649 - DNA, 1052 bp, Homo sapiens
tttattaaagaaacaaaagtcgccaggcctgcagacagctagatcctgtgcgtgagggttgtcttagtccattttatgttgctctaaaggaatacctgaggctgggtaatttttataaagaaaagaggtttatttgactcatggttctgcaggctttgcaagcatggtgccagcatctgctctgcttctggtgaggcctcaggaagcttttattcatggcagaaggtgaagagggagcaggcatgtcatatggtgagagacggagcaaaagaaagggcttgggggtggggttccaggctttaaataatcggctctcatgtgaactgatagaaggagagctgactcatcaccaagaggatggcaccaagccattcatgagggatccacccccatgaccccaacacctcccaccaggccccacctccaacactgaggaccacattttaccatgagatttggaggggacaaatatccaaaccatatcaaggatgaaaggagagggtgtcagttagcttttgttatataacaaacccccccaaaacttagcgactttaaacaactattttaagtagctcataattctgtgggtcaggcaggtgattgtacctctctgggccagctcagctgatctctgctggcttctgtcagtcatctgtggccagctggggttggctggtctagattgtttgacttacgtctggtgaataacaggctgattggtctggggatggtgctgggacttggctgggacagttcatctctgctccatgtggctcttacccttcagtaggctaacccaggcttcactgcatggcaatctcaggattccaaggagcagcaagagagcaggccccagtgaatatgcactttgcaagcttcagcttgtatcgcgttgctgatgagccactggccaatgcaagtcacaaaactggcccagagttaacgtgggaagtgaccccaaggatgtggatacagggaggcatgaccaaatcagaagccattacttcaacaatctctgcaaagaagagaggtttccttctcttcataatctc

SEQ ID NO: 125650 - DNA, 1048 bp, Homo sapiens
agctggaattctcacagcaaccagcagggagctggcaagtaatggctgctgtgtcctcctagaccagggccagcctttagtagcagctgagcgtgggagtggcaggcaagcttggcaccatgcagcagtgggcttccttgggtgctggaagtacagtcagggaacccttgttctgtccactctgcctacacaatggttgccttcagtctggagagtagtgaatggcaatgagtaatgagtaaagggggaccctcttcataatggcaggggctgggagccttctgggttgaatattttgtagcactcaaagagatggccaactaagaggtcgctctggtattgccttttctctgcctccacatcggcaggcttccagcaccccactattctggatctcaacattggacaagtgtactaatgttcaagcaggggcctgggtgagatggcctcatggtgccctgctggttgctgccttttgctgctcttttacaatccctgtactcaagggttgatttctgacgcctgggagggttggcactttgggaaagaccaatgagatttttacatttgagattttcagcatgtcaaacataggcaagacagaatatcggggagttattgggaatatgaatttgtttgtttgtttgtttgtttgtttgtttgtttgtttgtttgttttgagacagagtctcactctgtcgcccgggctggagtgcagtggcacaatctcagctcactgcaacctccgcctcccaggttcaagcgattctcctgcctcagcctcctgagaagctgagattacaggcatgtgccactatgcccagctaattctgtatttttagtagagaaggggtttcgccatgttggtcagcatgttcttgaactcctgacctcaggtgatccgcccacctcggcctcccaaagtgctgggattacaggcgtgagccactgtgcccagcctttttttgttttttaaataggcactaggagagcaatatctttacattttgttacctgtgaacactcagcacaggaccatataggtaat

SEQ ID NO: 125651 - DNA, 1069 bp, Homo sapiens
gaggtagagtcgcaacctggtacagcactaagaatccatttccttcttctcagtgactcacttcccaccatctccaattgctctctggtcatagttactatgttgttgtttgccagcagaaacagccatgttgttgtttgccagtttggggctttctgtcaacctgaaagacttccttctctccagccagtttggtcttgcagattttgttgtgaggccaacaaccaggctgtgaactgcctaagcccagccagcccttctttgaaaagccctgtggaactaggtcatcaggttgttggatggttcttacacagactgtgctgtgctgcaacttttaatgtgcactgtctatggaataccaaacttgtttccaaactaaatagtttccaatgaggatttaatgggagtttttcatttgaaatggattgaaaacaagccatttcctactcccatttcaagcaaattttggtccaattattttcctttttttaacataaagttaaatggactattctgcccatccctgactgagctgaaccgtgatttctcttgattatgcttttacactgcgaatcgcgaggctccagagacataatgggcgtctgtgggagagtggcagcaatttttaaaatcctgccagtgcttgtcagcttccactctggtgtctgctgtgcgggaagaaagcaccccaccaaaagaaaaaaagtctgccaacaaaaccagcgctgcccgcctgttctgtgggggttggcacagggatgggctcctctctgcaaacctatgtagggcatattctcagccactgaggaagcccggtttccactcatccagccctactcctcccactgttttccagccattagctttttgtggtgttgaaggtttctttctcccttttttttccttgcctcaatttttcttggtttcacttagaccatagcctcagggaaaaggagctcttggcaccctgccttccacttggtcctttaccttcagcagcccagcaaaatggaaaataagtgtctcatagtccttcttgggtggtaggttatttgttgttgtgatattg

SEQ ID NO: 125652 - DNA, 1029 bp, Homo sapiens
ggttaaaaatgccaagctagcagagagagggactcagacacacacacctaagttgttgctccagcctaagctggcccaccactacctgactgcagtttgttgcctgtcccgtcatgcttgccttcaaaatgcctttggattgttcacaagctcaggagccatgggcctcctcctgttgaggggtgtttattgtctaaatcccttacatgtgaattaaaaataggcaaaggtaaaaaggcaggagttttctaacaggtatgggagtgctgtagtaggccagtggcaaagactatcgccattttctttgcctgggacttgttgagtctttgaagtctacctgaattccagagtctagggcttcttgattccttagcaagagcaaagggatgtgtaccctctctttcaggctttggtgaattagaccttgagacttcataattaaaatggatttaatagaggcagggaagctgggatgtctgccccagtaagcaggcatcttctgtcagaaggagaatgtgtcctttgtatttaaacggtttctccaaaaggctctaaatgagatttgggacttaaacaagatttggtgtgatttgctaattacccaagttactattacctgattaacacaggaatcctcatagtctgttgcagtgcctttcttccgggtgccaggaggcttgacatctgtcacctgttcacttggaggcattttaagtaacccaaattatgtatgtcttttctgctttaggatttggtgcctgatttttacatttaaaagttaataactacctaaaggaggtttgctgccaaaatacaagagtgaaaactgacaaatctgtttgttgctgacagtgaggtggagatcttggtttattcattccaactagttaggccgagaaatgatacacaggacagtacagagctcttcctggtgaccatcacaggcatcaggaataaatcccctcaaatctcactttgccccaccaaccttaattgaggcctccgcttgagcagtgacagaactggaag

SEQ ID NO: 125653 - DNA, 1042 bp, Homo sapiens
gaaggttggacttagagcttttagagtcttgatttgtccatacatacagcttgactttctgctaagacacacgcttccactcctaaccagcaaccgagaatcaacatcttctgtgtaatttccaggaaatgcctttcaaactcactgccattaggtagctctccaaacttcacttagaggaacaatgttttagaaggattccaaaaataggaataagtgcagtcctttttctctagattggcattttctgaaatgtttcctggaatagtcttttcgtaatatattaatagacgccactaggataaaggattttgtttgaaaagtgttggattagatcaaattaagcaaagcagtggagagggcaatattatgctgtgtttaccaaacagctttgaccacagaacacctaggaacatttcatagatcccttggaacacagtttgggaaatgctactccagaggatctggagtaagacaaaccagcagagaaccagagttagcctttctggtattccagtttagaacagcaccatatgctctgcagatagaggctctaataaccctatgacaccaatgccaggacttttgaatgaatgagtagaaaaaaatattatttagtgtgctatgtgttgttttgcttatgtagatccttgggagaaataacactctgattgcagagttacgaataattgagccttttttgaagagttggttttccttttatcttgcaacccccatgaactgtgcaactgcttagcttcccatcatcaccgtggctgctggaagcctagagccagcttcctggcccatctgttataaataagtggttaagtgatgggcagacttcatttccatctccactgtgcatacccacatggtttatttttccttcttttctaccaataattttaaaaatcctcccccctccctgttatcttttaaaggtaccctaaatccttttggtcctttaaggtactttaaatcctttatccttttggtcctttaaggtaacttaaatccttcggtgtagggaatatgtaag

SEQ ID NO: 125654 - DNA, 1045 bp, Homo sapiens
aaagcatttttgttcatatgtgttttattgggtttttttttaatttttttctttattttttttttattttttgagatggagtcttgctctgtcgcccaggctggagtgcagtggcgtgatctcagctcactgcaagctccgcctcccaggttcacgccattctcctgcctcagcctcctgagtagctgggactacaggcgcccgccaccacgcccggctaattttttgtatttttagtagagacggggtttcaccatgctagctaggatggtctcagtctcctgaacttgtgatctgcccgcctcggcctctcaaagtgctgggattacaggcgtgagccaccgcacctggccttttgtccatatgtgttttgtcctcagtagattcctagtagaatatgaaaataatttgcagaagatatcctagaaagttagagctaaaagggaccttaaagatcatctagtctagagatggcaaataagtttcgattgtcctgctatctatggtttgttagttggctgcctggaggcttgtattgaagattctgggccatgaaggcatcaaaggctaaatcgattagtgatgtctgccatgagcatggcatgaaggcaaggaagtgtgcatgctgcacattttctgtccctagtttctcccttttgaccaatgaaatcacctgagacagaggtggcactagaaatcacgtctttattctaagtccaggactctttgtaaccccatcttgctgaagtaattatttttcttccaactataaacgttagtaaactagagcaccaaaacaatatgcttcttctagatttgccattgagttcactgtaaagtgaaatacaaaaccaagaatcagtccccctcttcattatttttcccaacttctgatatagttgaggaacgaggcctattctatactgggacctacccaaatttttcttgtttatacttagccatattatcatgatttggttttttttaattaagactgttttggtaagacatattctccagcaaattcattttccctgggtccttc

SEQ ID NO: 125655 - DNA, 1652 bp, Homo sapiens
tcaaaagggtggatgaagtaggtcagaaagagggcagtctctagtaggaggggacacagacttatttactggtaggaattctctcctgtggaaaaacagttccgaattcagcctcaggatacaagccccacctctggaggtgctcaggccatgagggctgcagctgcaggtcttctgttcgtcaacctttttctcttgagctgaacacaccagactccctgcagaattgcttgggtgtgcagggagagtcaggttattttttaattgaaaaagacattttttcttgagaacatgggaacactacaaaccttcaaggcaaatggaagaacaaatagatgttccagtgtctaggcccagaacaggaagttttacgttgtgtttaacagatacgacaggatttgcagaggaactttaaaggagcccaggagtccgctgaaaatgtatttaaagttttgtttgtgtgcttgtgcatttgcctcagaagatggttcttggctttcatcagattttcaaatagaatctgtaaccaaaaaaatagttgaggctgggtgtggtggcccatacctgtaatcccagcactttgggaggccaagacaggaggatcacttgaggccaggagtttgaagctagcctggacaacccagtgagactcctttgcttcaaaaaaaattttaaaataaggccgggcgtagtggctcacgcttgtaataccagtactttgggaggccgaggcgggcagatcacctgaggtcgggagttcgagaccagcctgaccaacgtggtgaaacccccatctctactaaaaatacaaaaaaatttgccgggcatggtggctcatgcctgtaatcccagctactcgggaggctgaggcaggaaaattgcttgaaactgggaggcggaggttgtggtgagccgagattgcgccattgcattccagcctgggcaagaagagcgaaactccgtctcaataaataaataaataaataaattagccgggtgcgatggcatgtgcctatagtcccggctactcaggaggctgaggtgggaggatcgcttaagccagtgagttctaggctatgattgcaccactgcattccaacctgagcaacctccaacctgtttcaaagaaaaaaaaatgttgagattcattgggctcttaaccagagactaactatgcacacgccactttggaaatgtatgctgtttgttacccaccacagtactctcacccacctgaccccttctccctatccaaccttagccttaaccaagaacagacctggttcctagtaagccatgtttccattcaccaaggtttggggagccttccctgactataaaagagactctgctatcacttttatttcatcttaattcaggcatttttttaatgtggtgtagttgacttgtttctaaattcctttacattttgtattgttcacacagtaaaaatgtctattttaccattccccattctaatttttcatcatttagtcaaaggtggggccaaaattgagctttagtctatgtatagtaaggttttgtttcattttgttttgttttctttcaaccagaagaataaaatcagaattttagagcttgtcttacccaacccacttttttttttttttttttaaccagagatgttaagt

SEQ ID NO: 125656 - DNA, 1072 bp, Homo sapiens
tcgtaatgctctgtttaaaaggaatgatatgtagtgagcacatcagaaatctggaagatggaaaatctctctttaggatctctgctcctctctcgagcaaagaaagaaatcggtgtggtgccagcagaggtgttctcagcaggacctggcccattaaatgaaagacttccatgctgagccaatcaagagagacctggacaaaaatcagactctttcctgccctggaaacccatgccttgaatctgtaattcatctgttaaatcaagtgtgcagccggtggtttagcacagagggggacgacggggaagagagaggggcaggagctgcagcacttgaatttccagcatcagagtccagttagggaaaagaaacagagctgtgatagcttcttggaccttatgtttccagcaaagagaaagcagcaggaaagatttttgaaaacagatgagctggtggaaggtattagaacaatggcggaagaggcagggaccccaggggctgaacaaaacacagttccgctgttgcctttcaacaagactgaataaagtttaggattttttttttatgggacttgtagccgtttttaaactttcatttttcataatgtcacagataatctttttatctattatccactggctcttttctgagaggcatttgcatcaaatagtgctgtacagatcatgactgtctctagtggggaaagcagcttgaaatgaaaggttattcactccctctgctttcgctggctttgttcttgattctcacacatttttttacatctgaattcgggtatttctggagtttttctttagaaacccttccattctgagatctaagcatattcagactccgatctatatatcaggggttacaaagcttatgcctactgaaagtgaagcatgtactttgaaacatttgttggataccccatggtttccaaaatcccttcagagcatttcctacagaggcagcaaccgtaaaaagcggccagtcacacagtgggggccctttccctagcactggcctcctggtggcagtggagcagtggccttccaagcatgcactgcga

SEQ ID NO: 125657 - DNA, 1038 bp, Homo sapiens
ctcagctcctgacatcctctctaacctcctgtgatctggtcaccctgtgggaaagccaaggcagccctggcccctctccagcagtctctccctggagggctcggcctgttgggttttacttagctcgcagtttatgccttcattctcctctgaccctcattaaccaagaggaaaaactaattctagaaaggactccatttccccccatattgtatatttcatatccacagagcatgctgtgccctattgagaattaaactgcgatcactaacctcatctcatttgtgccaggggtcttgttcaaaagctgtttccccagcaaagcagtgccgtgggttaggaccccctcaccccacacacacatgcttggtggagtggttcccatctctttttaatgcctttggcaggggacagacagagagagagaaagagagagagagaaggaaacacagggagagagagagcaagagaaaaaaaagagaaacacaaaagaagaacaagagggaaagaaaagctctcgaacagcagccctgtgttttgttagaacattggcactgcatttatcaggattactggagggagagcagggtttgatcctcttctccactgggagagggaaaagctttattgtaccttttttaacatctcacagttagatcagaacaatacactgtgtatgtacatacacaccatacgtatgtgcctaaggatgatattctacttgggacacaccctgttttcaaagcatggctgaattttttataaaggccagatacagaaagccaccaggctctccctgggtctccctttccagcagaccttccccccctccccatccccttgccggacttggatcagcaggattcactcctgtcaaacaaattagagcatctatgaaatggggctatcgacatgtgtgacttgatctgttttaataggggcccggtgggagtttcctccctgccccactgagctttgtatccttcacggaaaggcagacggggcgcgggaggatgctgtggactttaaccctttgct

SEQ ID NO: 125658 - DNA, 1090 bp, Homo sapiens
cgcaaaagggcaagatttacacatggggtttgcagaggaaaggggtagggggctcggaaaggcggcctcctctgcgtgtgccaggagagctctatattgcagtgtgctttctgggttcacctaggcagcgttacacagctgtcctcagaggagcggaaagctgggctctggctggagggcccggtcatcaatatgctgacaggccttcatcatcattttcatctcggttgtaaagcacagcctattttccctctttgccaaatctctgctccaaatgtacataactatagatttctgactgagccctgctgccaggaatcaaccagaaagcttcaccagacctctaagacagaggacaagtaaattgtgttctcggctcccgtgaacggggcctgtcactttaactggtttcttctcaggcagtgggtacagcccaggacacccttagtgaacttgccactgcccctggttttctttctctctctttcctgctcttcctctcctgcctgctgtttgctgaccagaaaaatctggctggagaggcccatgcagtgagtgaacatcacatacataattctatcagaatatatccaagggtggggaatcattgttctcggaactagctgagctgaagcccgagcagaaatactaaagtcagtcgtgcctttgagctgcctctaacagcgccctttagagacccatttcatacaaaatttgaagcctgtgtttattgcccattaaagcaacctttattttatggcaaatgttgcagtaattgccttttacgaagagcactttgtaacacacatgcacagttgaaagaaaaccactctggtattgtctatcgggacttaatggcgcaattaattttactccatctgttcctgagactttaaaggaaaatggattttttttttgagcgtactttaatgaagaagataaagcggcccggctggtgtcccacaggctcggcgcagtaagttcagattattgctcagtctgtcagaatgggctgcttccctcagcagcagccacagccagcaacccgctctggcccctcgccgcgccattcctgatgacaaactgccag

SEQ ID NO: 125659 - DNA, 1048 bp, Homo sapiens
ttacaagtgataagcaggacaaatgtgaagtcatctctcctgctggcaggtcagagggggctggatttagagcccctaggagactaggaaattagatggtcagtacccaccgtggaggttgtagcaactccaggctccagagatcctggacaggggtgattccagatgtagactcatacttgaaaggcatcaagagcatccattgttaggacggaggtacagcagtaattagtgcagagtgctaatagaggaacagaaggtaggaaggaggccccagcgaaaggcagccgggggattcggtttcctctaggtccagaaccgtgggctgagatttcacaaaggagaagtgagggaagccctgctggtttctcattaagccccttggcctttgctcattcttcgtgggctccaatggagggtggaccctgtggcttcttcactttgctctctgacctcttcagccccttctctgctctcttctctgcttgtcctaggactgctgtctgcaggcacagatgccccccgttgagccacgcaggtttctgtgaatctgaggttctaactccctgctgccactctctggctcccacgtcttccctgcctgacactcccctcccttccatccatcaccctcctctctcctaagagtgctctctgaatcttattgcctttttatgtctctcttgggttcttcctcctgccctctccctgagcatggttttccttttttggagcatcccacagctcatgccattaatggagtcataatagccacggttggcttttcccgagcaaacagacttctgtgggctgcagaggacacagacccccactggtggctcgaaacacccctcctgcaggcagttcacaggctggacctttaaggttcccaccagccaggccacacattggttcctccatatttgtacaaaaagatgtgagccaggagcagtaggcaaagccctctaccttggggggaaaaaaaaaagttggtctggaggataatggaaattcgcatggggcgagggctctgagagcagcatccatg

SEQ ID NO: 125660 - DNA, 1042 bp, Homo sapiens
gccccgggcggccgccggggagaagccgccgcgcgccctcctcctcctcctccctctccctcctccctccctccgcacatggtctcctttgtcctgtcgccgccgccgccgcctcgctcttagctccgcgcgccgcggcggcggctcaggccgctcttctccgcctcgccctcccgccggccggcccgggacgcgccttgttagcccccgccgcgccagcgcggccccgcgcgccgcaggagcggcggggagacagtggcgagcgcgggccgggcgatctcggcgggcgcgctcctcccgccgcccggggcctcggccgcgctggatgtgtgcgcgcggcgccggctctcggtcgccccgaagctgttgcccggttcggatctggttcggcgcctccgctctcggactttggcgaggaaggagcccagagactcttgtggacagagccgggtcgagagttgggcgttttctcttcgtgtgttttggtggtttcccccctggtctttgacgatcgcccttcgggagccctgctaaagaaccaaaccatgaacttggggctgaccggaccgtttaaccctttgcaaccaggtaatgaagcccccggggcgcggctcgcttgcctacctctcgcggtcggaagggaggcggccggatcgggggtcttttgttgcggcggccgggccggcgggcaggggtggcaggggcgggcttctcccgtctggcgcgcccaagcgccccttcgctacccctcctcccttctttcctcccccctctgcggccctgtcgcccgcctttgtactttcctccctcggccggccgggctcggccggagctgcgcggtcgtgcccgggagggcctggcgttcgccgccaagctccgatgtgaggagggggccggggcctgcgtccgcttgagctgggggccctagcgtggcgctgcccgctcctggggtcgcgcttccccagcgcggaggtcgggatcccggcccgcacccggtgccaagggaggcgaaaggagatctgggctcgggttcggcagcggg

SEQ ID NO: 125661 - DNA, 1711 bp, Homo sapiens
caacataggctttttctaagctttgcttgggaaaccatacacaaataagcattttagttgatggcagattattcctttgccccttatttccatcaaaatggcctttcttttctcctccagagtttccccttaatgccttatgctaattcctgttggtaacatgaatgacaagagacggaatcagtgcgaatccaggtggtgcaaagtagactgactggtatcccgcaccccctttcctccctggggagaaagagattaaggggggtgtggagggggaaagcatcggggacagttttgttaaggggattagtattcaaactgctaaatatcaggaaaacaacttcaaaaagggattcattgtgtagcgataatgtcaataattgcttcaggacaggtgcagagtctccttataggcttgtggttttgggtctgtttttactccgggtagtggcagtgtttacaggatgaatggctgacaaggccttcaaggaactgtcagcttcatgcacatcaagttcaagttttcctgcaaggcggcctgcctgcctgaaagtcaggtctcctatctttgtccagtatctttagccaagagcaataaaaagcatcataagaaagggcaaatttacaccaggtaacaaacacaactggggaaatcttcaaagccccagcttatgggacaatctaaccagagtgcaggggagctgacacgtgtatccctccacctccagatgtttaagttacacatcacttctccctctcaagagactggtagtattctggccttagaggagtgtggctttaagctgctggtgagattatgctgctgagcctggtggcaggcagatttggtccataaaatttcaccgtgggagggcagtgctaatctcacaagctgattgtggtgggggttgggggggcgcagccctgatgttgggctgcacagtgcggagatgaagctcaggcagaggcagcaggggccgtggctcgaggcccatcagtcagcttgtgagcttgaataagtcatttaccctctttaggtcaagattttcaatcataacaaaacctattccagggccaacatctctggtggggataaaacaattaattgggaaggggcaggggttgaaacagagtggatacagtgagtatattttatatcacgtttgttcatcgattttattttgactttccctgtgttatagatgccatccagtttcatagagatttttgtgtttaggtgttccgaatggtcgttttcttctcctgccttttatttcctgctttaaaacaagttaatcaaacagcacatgcttgcatgtacacacaacatgcctaatgaggactgagcatttcgaaaggggtgtggcattgagcagggcttagcgttgtagacacaaaaaaacagtttaactttaatcaaggtcatagttgccatatttaatctttatgtgtttaaatgtttacaggatgttcatgtgaattttatgaatccttctgtctttgtgattcaaccatctgccaaagaaaaaattaattttcccactgagacagaggcacagagagagacttagtaaccctatttagttgattgaaatgctataggagcaacaggacctgtaccccaaattctggggtatttattctataaaggaactttcagtctattcaacatggctagtatttattatcctctcttgcctactgtagatcc

SEQ ID NO: 125662 - DNA, 1061 bp, Homo sapiens
gaatggtttcctccagcagggaatgaggcccctcattctgcttctttctactgtgggcacccagtgtctcctgaaatgtgaacagcaacagagcagctgctcaccctcgtaggcaggaccccacctcacctccatcagcctgggaggttctagtggatagtcactcaccaagaagagcaccagacgcaacgctctggccacctggagccctctctgaccaggactgcttttcctctcccgggccctaccaggcctattagtggaacacacccggcctcttcttggggttggttttgcactgagaatttccggtggaacacagatgaggttggagcctttaggttagtgaagcctttggatatttttggcagtatggttctatcagcattgtagaaagaagacctagcttaaaaattgcctgaaatctgaggagatgaggtaagaaacaagttacccagcgatactgctggcttagtaaccaggtacctaataaattcttccatggcgaccatatgaccttattctttaggtttagacacaagggatttccttggtttggtgacagaaaggtaagagttatattaccatcaaggtcaccatttgacttttaagaaaaacccattcccgccgagcatggtcactcatgcctgtaatcccagaacttttgggaggctgaggcaggaggattgcttgagctcaggagctcaaaaccagcctgggcaatatagcaagacctcatctctactaaaattccaaaaacctagctggggttggtagcgtgtatttgtagtctcagctacttgggagggtgaggtgagaggatcacttgggcccacaaggtcgaggctgcagtgagccctgattgtgccactatagcctgggcgacagagtgagacaccatttcaaaaaaaaaaaaaaaaaaaaaaggcctttccataaaataattctatgcatgaaaataatgcagttgactgtggaatagctctcttaagaaaaaaatttggtttacagtttaaaatccctttataatgaacatatggagaccattttacaattcctcc

SEQ ID NO: 125663 - DNA, 1725 bp, Homo sapiens
aaacagatgccttgtactgttagtgtgaaaccaccagtaacagtcaaaaaatattccatgttgcatgaaagtgtctcccgaaaattttccaatagttgctttggccgaactgatcttttgccgaacttgtgaatgcgtgtggtggtgaatcctgggatactggatcccatcactggaattgtgaaccgggtggaagattccaggcattcgaagtgatcttgatgatgccttttgggtagaacttttgacagctgccacttttccatcctgagtgcccctgtgatggaggaggcgtagattacagtgtaacccattccattcttttagtcagatgttcaaacatcactctggttacttttgagctcagtggaaagcccttgacttatactgggcgattactgctgtcctttgaaagagttttctctatccttggcaatattgaccaaaaagcttgaatgttcatcagcctctcttcaatccattcatatttagcgttttgtgtagttaatgatgtagttagtatttggttgtctcagaaagtaatatgcattcatgatagacaattggaattgaaaaatatcagatcagttctctagagtctaatgagaacagttgagtgacaaagggctcaatcacgcgggccaaccccagacaggagggttcctaaatggaggaagcccgtggctagcccgtggcctctggattatttctagtttctgacaactgcagaaaaatgttgttttctctgaatatgtatgtttatttaactaggtttctttttgcttcacaatctggattccattcagtcagttaccactccaattaactaacaattatttaacattaacagtaattacagacgccagttaagcgcctacagatgtcaactgttagctttgtacctaatcactcaatgaaatggagaaagttcaacaaacatcaattagctaagcaattagtatgagttaggaaagagcatgttatcatgtgtgagctgattcaatttattttattttggcagtaaaatacacacaggcaagcagcaataagttcctcagataagataaaactctattgttttgcggcttatataagaattccttcctttcctgtgcataagtcaaatacactctcgtctggaatttatttaacagaatttgtctcaattactcagaaagcgcagtctcaggaagcacctttggtgaattatgaatccagtgactgtactgtataaggaaatgccagaaaacttcagtggagaaaatgattgattcccactcgagtaatccgctccgtgcatttcggatttttaccagtttattcctgaacctctggtggaacgagtgcaacagtgattttattaatttcatagtgcctgaacttttactcagctgtcttttatttagcccggagctaacatcaaagtattttacctacttgcccagtctgtgcttttaaaaagtagaaacagctgtctattgaagagccatttcatgaattcaccaaggagattccagactctcctgaactcagaggtgctgttccactctcttttttcccccttcgcctcctccaccccacagacttgactcttgtcattagctgagcttgcctggacttactgggagagtgcactctgaggcctgattgtatgaagtggcccagaaagtggagattcattttacctccaagaggaaagctgggcataggagctgggcctctggg

SEQ ID NO: 125664 - DNA, 1051 bp, Homo sapiens
gccacatggccctgtataatgacctcttcccaagatgttagacatcaaatcagtttgatttctacccccatgggaagaggaactccggttgtaaagaggcagcttgagaataactggtaaagggtgacttgccatttccccgctggtcttgcctcccaggagtaactgttatttgaccacatgacccagttacaacctgttacccctgtgtggccagggcctcacccccccagagcacaccttcgggtcaggctcatgcctgatttgtgccttctttccttctcagggccctccaggttgagggaagacagctttacacctccaccttctgtattagctccaggataaacttgaaaactgcctactctgagggtttttttggcattttaaaagttaagtctgactttccgagccctctcagcatcctgccaggtatcttatcttattcaaatatcctaattgcttctggggctgcacatcatcctagcacctaactgacaaaatagaccttcacctgagggcctcattatgctttctgcctgtgcatcaggccaaaaatacctccacaatacctgctcgacatcctgggcttccaagtgacaaacaaataattgggtgaaacaaaccctgggcgccgagcagctgccatcagtgtcggagcacagaagagtccacggcagtaacagtcacagcgctgcctggttcatgtcagagcaaatctttgaacagtgggttgtgctgacaccagagaatgacagctttggaaatggcatgctagttactgctgcaagtgaggcctctcatgtagaccatgacaagcggctgtcatttccatacaggtgaacaactgacatcctagaagggggagggcgggagccacgcaggaggctgtgtttggcagtaggtggggccagacttcggagaggggtcccaagtaccggtgaccctggcgaaaactagcctaaaaacacagtctctttccatgcccctttactcactccccacacatcttctctgttacctctttggagttcatctgagagagggctac

SEQ ID NO: 125665 - DNA, 1037 bp, Homo sapiens
caaagtgctgggattacaggcgtgagccaccgcgcccggcctcatcctgacattctttatgtgtaaggtgctaaggtggtagcatactgctaaaactagattagtagtacttaatctagagggatcttttcaataattccatacattaaacaatttactgtctccattacaaggtgtaccattgacttaatactggttttttggggagggagtgagtttgagaaacactaggacgttaaaaactgctatgttgattgtaggatatctggatttcagaaacgttagcacatgcttgtgcaggggtgggagagggagaacctgtgtcttagaaatgaagaactatggtacatttatgtaggatatgatatcacattttataatttgtctgcttaaacaatgatttacagatcttttgagaaagagagcaaggaggttgggccttttagtaagacagaaaaatgaccttccgtttaagacttagacaaattaaattggactttgaaagtggtttacccttttcctctcgggtaaatgtcggaagtgagtgccctggctgaacataagggaaggtccattgtcagcaccctgaaagcctgtttgaaatgtcatcaacttggagcattcattggcagcgactatcaacagcccattttaaaaggatgccttgggtagaatggaaattacagtggccagccgttaatcctttttaataagggcaactgttgaggagaattatgttgtaagaatgaatgaaatttgggagcaactctagtccccatgttctgtcgtgactgtcaacaccaaatgtactttcatttttgcaactgcctaaggattttccatttaacaaacttacatgacaaatgggaaagcagtggcattccctgagagtccaaaatctggtttggctctgccgttagcacatttgcctgcagggattgatgtatctgattgaagaatgttgagttcagccaagagttaaggttaaggtccttctatttgttttgggtcagttcctacaggtagagaatttgaaa

SEQ ID NO: 125666 - DNA, 1047 bp, Homo sapiens
acttgaagatattctgctgtgtgccattgggttttcgtttttcttttccccaccatctcatggctaaggtaaaacacagttttggtccagagtcttccaggataagcacataactgcatttccaaagacgtgtttcattaaaagaattaaaaggcattagaggtggggtcccctcccccttcaaaatcacctgcattgaattgcattgaattcagttcatctattgaatttgcctgcattgaattgcagcctatatgcaaggttacagatatacagggcttttatgactgcctcgttaaacacctcctgtctggagataaaatgatggtgattttaaactccttcccccagtctgcacctcactactccctcagaccctggtctgtcccctctaggttacaccaaatctctggggcctccccaaacagactggtaggtcatttaataaattagactatttccctcgctcacaattatccaatcacacagaaaactacatctgggcaagaaagtgtctctcctggtgttgaaataggcctttccaggccatcgtcctgattgaatatgtagattgcagttcattagtggagttcttcatatgtatgcaaatcaggttgttaacaactccagcttaattgttagttgtactgcagctgattgcttttctttctttcattcttttcccccccttctccttgtaggcaagcttcgggcctaaacttgagctccttttccccacgagtttaacttcctggtgtggggggtgttcatagaagttgtgatttcttccataaaatagctggtgtcgtgtcctgaatcctttcccactagaaatagtgattgtgcccaaagtaggctttttattgttgctaattcaaaggacagaagctcacagataaggttaatattagcaatatttgagaatggtggtgggaataggtaagagcaagcagaattgctttagaaatcatcaaagagcagatccgcaaggtccctaaattaggttctcttgtcccatttccaccactgctaatgagtaattactga

SEQ ID NO: 125667 - DNA, 1077 bp, Homo sapiens
gctctgtcaatatagatgccccctcatggggctttgctgttgtacagcagggcaaggatccctcaggacatgagggagattgagctgaggctagaatggggctaaaggggctgagagcatcagatgagtccgggagatcagaagagtagccaggcacgatggctcactcctctaatccaagcactttgggaagccaaggcaagcactttgggatcgcttgagcccaggagttcaagaccagcctgggcaacatagagagagagacctgtctctaccaaaatgaaaaaacattagctgggcatggtgacatggatctgtagtcccagctactcaggagactaaggcaagaggatgcagtgaactatgattgtgccactgcatttcagtctgggcaaaagagcgagaccctatctatctcatctctttaaaaaaaaaaaaaaagagtgaaagtcagaagcaggtactaagggcagtgaaaacccaggagactgatggggaagaggtcatagcaagggaaattcaactagaagcttcaagtcccaggaccccatgccttgggagcagtgcttatccaaggcagtgtgaagccagttcaaagagaaagctgtcaagaaacaaggaggtggggcagctttgaaaccatgctggtgcaagggcctccagcctagagaaggatgccaggggaaaagattgagaggaagattaagacccaatttctactgcctaagaggatggtaggcggaaagattagcctgaggatagataaataagacaaaacagagtgatttctgtccatgataaggacttcacacaagagtttgttttttttttttggagacagcctcggtcacagcaacctccgcctcctaggttcaagcaattctcgtgcctcagcctccccagtagctgggacgacaggcgtgcaccaccacgcctggctgatcttttgtattttagtagagacagggtttcaccatgttgcccaggctgcccttcaactcctgagctcaggcagtccgcccgccttggcctcccaaagcgctgggattatggtttacttgtctggatggacactgc

SEQ ID NO: 125668 - DNA, 1036 bp, Homo sapiens
ccccatttctgatccttacgagacaagtcttacagccatcctgccagctgccaccccaggcttttatccaagactcactgttggtggacctctggctcttctgttcaggaagagagaagcacccacactgcaagaaatcatcattataatgggccttagctaccaaagcaagtgcgtccccctggagggtagatggaatttgctaaggtctcaggtttttctctgtcagtgctgtctggggacatatttgaaggctctgttaccatggcacctaggctctgagacagggctacatgaagagcaatttttggaaagaatagatttctctctggcttccatttgagccaagtggatgaattggcttcttttgcttcaataattctggaactgcaaggcacccctgggggccctgggctcagcaaagctctggtcttcattgaagcattaattagcttgcactacacagacagtatgtggccaaaattttatttagctgacaacactgctaacggcctgatgaatattctggaatatattcacttggtggaggcggggtatcatttttacacttcccaggtggaaaataagccagtatgcagggctgaatagataactcctcaggtgtcttccaattccgaactactgtgacggggatgatgttcctcctgtactgagtggcttcctctccaaacccaggccacaagacttttgcagcccagggaacagcagtccaaaacataaatcgagttaacagagtgtagacagcaacaacccctacgtttaatccattttcctaagggaatttatatttgtttataggaacttagacaaaatgcaaaggattatggaacagtttttagtaaattctttatccaggccttgtttatacttccattctagaatgtaaccttctttagcataagcagtatgggattctgcccaaaatagttatttggtgaaccttgtaactgatgtgtataacttgtacatacttaagaaatccagccattttcatcttgctattgggtgctaatcc

SEQ ID NO: 125669 - DNA, 1060 bp, Homo sapiens
ttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaaggtacggaaagaaaccgctctcgagtccccacgggggagcctgctctatgccaagtaccagtggaactggccgcccaccctccctgtcccagcctcgtgctttagccgccccggtagcctcagctcctccccacagccagtgcccgcagcccctcgcagtccccatggcccatagcatatggtgaccgtaggagatagcagagctagcgacagattcctgtctcagtcgcagttatacatcagcacgtcccaagtccctgttagcgtgtccaaacagaagtctttctctagaagacagggagttggagcttcgggccagacacacacagcatgaatcaattccatatttgctttcaagtccgtgcagtccatttaaccatccataggtttttctcgctcttttcctctttttgttttcttttagaaagccatgtttgcattgcctcatcatatttttctcaaattttgttcaaactcaaagcctggggctcacagatgactaataaaattttactcacatagatgtagagaaacgtcgacaagcagttttggtttggttttggtttcactagtggataattttgttaaccgttgtctctgcacttggtaacccatgcctaaaaaaaaaagtagcgttaaacagggaatgtcttggagttttttttccaaagaatatcgtaacgcattcttgacaaaaatgtctttttttttttctttctttaggctatttattttcactttaaatgaactgataaggaatgcacaaatatgcttgacagaaaatacctaatcccaatttccttgcagtatttaagattcaaatttgatccgaatctttaatgtttcttttct

SEQ ID NO: 125670 - DNA, 1028 bp, Homo sapiens
gttcagttttctgtgctttgtgaagttagctattatagaatgtaaaacgtaaaatgcttgggcatgttggcccacacctgtaatcccagtgctctgggaggccaaggcgagggaattgcttgaggccaggagttcaagaccagcctgagcaacatagtgagacactcccccataaaaaaattaaaaataaaaattagccaggagtagctgttactggggacgatgaggcgggaagatggcttgagcctggcagttcagtgttgcagtcagctatgattgcaccactgcactctagcctgggcaacagagcaagaccctgtctccaaaaaccaaaacaaaacaaaagaagaatatgaaacgtaaaacaaatgtagacaaatgtgtatcccaccgtaatggaatttgttgtgtagtgccaaaggatttttatattctgaagtttctgtgctatttacttttgctttatttacagaagattctgggatgttgccaaggataactaggaattgcttgtaactatattggaaatacacacgatgaggttgaatgtggaaatgcagctgcatgtgttgtaaatcagtcctagagctgctgctgggcttggtgatagcttttctttaactaacttcggtgatcacatttgtaaagagatgggcaatatcatgaagaatggagggttacaaatttctgaacaacttgagtgaaagtttctagagtgttttccttgactatttttgactttccgtcgtttgagatttactttccagaaaggatgcaccctcccacccccagcccacctatccaatcttcaggattaattcttttcagctcttgggttacctgggggtggtaatgtgagagggattttatggaagggaattaaggaataggtggaagaaaaccacataggacagatgggaaacagaatatatgaagaatatgagaggagggcgaagaagtgagaaggagaagttaaggtgtgtgtgttcatcataactatggatgaggctgggtgcagtggctcacgc

SEQ ID NO: 125671 - DNA, 1078 bp, Homo sapiens
gccaccgtgcctggctggttgcaacctttttatgagaatctaatgtctgatgatctaaggtggaatagtttcatcctgaaaccatctcccctgacccccatgttccatggaaaaattgtcttccacaaagccactccctgatgccaaaaaggttgaggaccgctgctctagggctcataagaatcattgactggccatggatctagatgaacttccttcttctcattagctaaagcagatgacagtgaagagctgaattcctcctccactccccaccccgcaccccatctttgttgtccttctccaaaaagcgaaataaaaaattccatcccgtgttaggaactgtttatctacattggaattctcctctgggccactgtgcccaaaatgatcttaagtagaagtgagtggtgtttgctcatcttctggaattcagcgctactaggaatgatggctcaatgaaaactgtacaacaggcaaatattgcatgtcaataacaaaactcctgggagatccttggagatatttaacagttggacaaaggcgtggcatccagggcaatgggggtgggtgctgctgatggtgcctttgtgttggatcccaacctgcaaaattcagtgtgctcactgctgggagccacccccacaagctcatgagataaaagaaagccagctagagtgagtgcctgaaggccaagaaagcttatcttctcagcaactacaggattaggagtaggctaaaccccttcctttcatcgtgctgggtaggagagggattaccctgcaagctgctccgtcgtccggaagatggtgaggaggaggcaatgccacgggtcctgtttaaaaccggattatcttgaggagcacaggaatgagcctctcctatttaatcagcctgggagctgatatccctggccccttctgaaccggcccactcttctgaagggcttgggtgcacctgggcccagtggtttgccttctctgggacctctggcttacagagatgggtcatttgttggatttttcacatccttagttttatttccttacctttggccattagttatctatagattctt

SEQ ID NO: 125672 - DNA, 1029 bp, Homo sapiens
ttaaattcttataattcctggagactggagactgtccctttctgcttccagaaacatgtcatctcttacctctcccagctccctggaccttctttgcttcccacaggaccttgggcgggaagctgggctttcccctggagtgctccttaatgcctctgcacactcagctttagctgtgatgacaggagagagtcctaagtgatccgcctaccttggcctcccaaagtgctggtattacaagtgtgagccactgccttatagtattttcttaaaagtaactttattcagggggaaaaaaatcccctaaatcttgtagtcgtttctgagaaacgggaatattttcttgaagaagcttgaaattgcagaggcttaaatcttaaattatatgaggagggaggagcagaggctggcagccatgaaattagagctccataatttgtctacagccattcaagaggggaagaaataagaatgattttctgctctgcttccaatccagatgttgtcttccagcccagtagagaagaacaagaccagagcctaggagaccaatcactttaaaaattatagtgtaaaaatactttttttattatgtattcattataaaatttatactgtatccattataaatttaatattcactgtaaaaatcaaaaatacaaaagatcattagataatcactgataatcataacacccaacgataaccataaccaatgttaatatttcatgagtagctttaatatttcacattattttttactcctacaaataatgtaaaatttatattttcatataaacattttgtatgtacatgtttaaaagtcaaatatatattctacaaggctctacctactctttagaggtaccactttatttatttacttatttattttgaggtggagttttgctctagtcgcccaggctggagtgcaatggcatgatctcggctcactgcaacctctgcctcctgggttcaagtgattcttctgcttcgacctccagagtagctgggattacaggcatgtgc

SEQ ID NO: 125673 - DNA, 1051 bp, Homo sapiens
tgtcatcatcataatcatcatcacagctaaagcttattgagtgcttactatgtgctaggcactgttcaaagtgttttatgtggattaactcatttaaccttttcaatcatcctattatgcatatactattaatttttatttatttatttaaaaaattttaaagacagactgtcattctgttgccccggctggagtgcagtggcacgatcatagctcactgcagcctcacacttctgggctcaagcaatcctgccatctcagcctcccgagtagctgaggctacaagtgcacaacaccacacctagctaatttttaaatttttagcaaagacgaggtcttgctgtgttgcccaggctgatctcaaactcctggcctcaagcaatcctccttcctcagcctgccaaagtgctgggattacagatgtgagtcaacacacccggcccaggtactgttactaactacatttttgcaaacgtgaaaaatccagaagttaaataaccttgtccaaggttacataaccagcatctgctggacctgggattcaagctgccacctggctgcacagcccatgccattcactttcatgtactgaatcctgctccctgtgagatgagatcctgtgtgcttcccttgtacccgtcatgtcaccatcacatatatctctgccaccactgtgacacatgggtgagcacttggctgattaatcaaatttcagtgggtggagagatatttttaaagctctgtgtgagcccagagtgctccttactgagaggagaggtgccctgcagcccaggaaaggctggccatgagcatgactttatgccaggaggggggctggtttctgtgcagtaagctctggagggccctctccacctgccacccatgtggtccatcctacgttttcttgtaatgaaggtcccccgtcccctactgttttatcccgtttttgccggttgatttcaggatcccagaggcaaactcaacttgccttttttggagacacttctctctacaggctttctaagaggaggtttgaaggaggcagaaacat

SEQ ID NO: 125674 - DNA, 1030 bp, Homo sapiens
gatcattaaataatgagggagtaggaaagaagacaggacttgctaacaattcttgtcactaacaacttgggtgattattacctgaaagcctagagggcatttcaattaattttttatggcctaacactgtttggtcagtttatcattccttactaaatgtaattcagtgtgtctgtgtcaagaaacctctgggtgcctggcataatgttaaatgttgtggggcagagaaaagaaatatgtcagtatctcatgtgccttccataaggcatgttagaatcatagtgtttatttttgtttcatctttcctcaaaatatagcttcagtttacaaaagttcatgatgagttttgcctgccctgggttctctgggttgaaaaagcttgagaaaccctctaggttaagaggtgacatccaccaagataacaacgaagttggcttttcctttgttttagcaacaacgaactgtctacagactgatgctcgtgaaagcatggaacgtggacgagctccaggcctacgcgcagctcgtgtccctggggaatcctgacttcatcgaagtgaaggtaagcccctgctgactctggtggccgtggtggagtgacaaagaatcgtggtgcttcgttggccatcgtggagttaaaaccttgtaaaactctagaggtcccaggaattttattgatgtattcatttcgtgatcgatattcatcaagaacctggaattgttctaggccttggggataatagcagtcaagaagaccaagctcttgctcttataaagctagtattttagtgggaggatggacagtccacacaaagtgagtcattaaaaaccatgtagtgacatgaatatgctgagaaataaaatagtgtggtggtgagtaattggttgacttttacataaacctttatttcagacatagacggaaatagagagattggtctaatgaactcccatccacccatcactcaccttcaaaaatgatcaactcatgacccagagttgtttcaattatacctttacccattttctc

SEQ ID NO: 125675 - DNA, 1022 bp, Homo sapiens
agtaaagacggggtttcactgtgttagccaggatggtctcgatctcctgacctcgtgatctgcccgcttcggcctcccaaagtgctgggattacaggtgggagccaccgtgcccggcttttgaaagtgatttttatttgttttaggtcacatagatcatggattttcacctagcagagaactgggggagggggcactccaagagcacccgggtggtttgaactgacattttaaaaaataaccattgctttcaatttgtttttaatgatatttactttgaaatttcaaatagcattgaaggaacattttcatgtttatcaaaagtggtttgggatttaaaatgatggtgacccattgccacaaacagataacaaagaagtcatcgtgccgccaccccccccacaaccccccgccttgactaagagaccagtggcattttaccccattaccaagtagatttcatcctccttaatttcttctaaatggaatcattcacggccattcatctcaccacttgtttaaaaatttttagcctggctattgccattttggagattagagttgaacctttttatgagaatcatcatgtttgatttatgaaaaaaagaatttacaggaaagggaaataaaaaagaatgatcagaagctaatttcttttgctcattgaaactagaaagaaggaagcactttctcaagttgacatttgaaaacctttattagtgcatttgggaaatgaagataatagaaactatatgggttctatttgatttatggcagtgtgaagatggcttgctcttctgatgtgggtccataagaaactcatgtacatggcaaaaactcatttgccactttcataggaataaaaaaaattatgccattagttccttcatagtctgagatattggattgaaataaataccatttatattcagccatttgcaccttcccttccacacactggggggaaaaatgtgttttgcctgttagaaatgttaaaaatcatgtaaataaaatttgagcagc

SEQ ID NO: 125676 - DNA, 1027 bp, Homo sapiens
atgtagtacaatgtaaatgccatgtaagtggttgttatactgcattttaaatatttgtgtgatttttaattgttttattttttccaaatatttttcatccatggttggttgaatgtgtggaaatggagcccacagatatgaaggaccgactgtacgtaaccaccttaaaagaggcgtctgcaggccaggtgtggtagctcacacctgtaatcccagcactttgagaggccaaggtgggcagatcgcttgaggtcaggagttcaagaccagcctgggcaacatggcaaaaccccgtctctaccaaaaaacaaaatacaaaaattacctgtggtcctagctactcaggaggctaaggtgggagaatcacttgagcctgggaggcagaggttgtagtgagccgagattgcgccactgcactccagtgtgggtgacagtgagacccctatctaaaaaaaaaaaaaaaaaaaagatgtctgcaaatagtatacgtttaaatataaagttaattttcctgaatttctagaaccaaatttcctaagccatcaatagcctcagaatgttcacattgaatgtcattttctgcaaacatttggcctttcttgtgtgttttcatatggcatacttaccttccttttctttttcacctaaagtaatcatctggttctgcttttccattaatcctccttctttccttccttgcttcctttctgtcacttttctaagcgttctttgtgccttcttgacatctgactgataatgagaatcaccccaggagcttaaaaaaatgacagtttcctggtcctcatggcatctgagatctgcttgttagacatcccaggcgtcatttggtatgcagccagatatgggagtcactgtcccagaaaacttgcctttctctcctgtgcccagcgcttactttgacattcctaacccatcactgtctggcctcgatgtacatttcctggctcatttttcaccttattccccaggagggccatgcttccctgcttacgttgccatttctgca

SEQ ID NO: 125677 - DNA, 1006 bp, Homo sapiens
gtttcttgttccttagaagacttccgtcagtgattgatggagggaggtggcccagcagcacagaccccatgtggtcggcagagtgtgtgggtgggaaagttagatcagagagcccctctaattgtgctgggctgatgctgtcatacctgaagttagatcacattttgtttattttccattcaaacttagtatttgaagaagggccaattttaagtaattcaatattttcaatgtattagggatggtttccagtcatttaaaaaacaaccagaggccgtcccattttgtcacatgattaaaatcattagttcagtcttttgggggaagtggaagtctctagaccctgtgaagtgtttaatacccatgtctattacaggttttatatcatggaaagcctgatagaggaataatttttctttcttcctttaaaaaaaaaaattactaaggaacctcgagccagttactcagctgtatgtcagtgtggatgccagtaccaaagacagcctgaagaaaatcgaccgcccactcttcaaggatttctggcagcaattccttgacagtttaaaagccttggcagtcaaggtaagaattatgacatcttaaaaataaataaacaaccctcaggtgtgtactgaagttaagaagaaagaaagatggaagaaaagaacagaggtactttttcctcttttctctttaaaataaaaaaagatgaaatatagcgttcaactttttagagacttcttcaaggaattttgaacatttactatttgttaaataattattgagttcttcttaagtttgtagcacaatgctttgtatgtatcatttgcctttcattcatttaaggagaggggtatatatactcccaaagttaattaataacaattggtcctagaaccaattccccatagatacccaacccggaatctatggaagattggttgtaggactccccatgggtaccaaaatccacagatgctcaagtttatataaaatggcataggcc

SEQ ID NO: 125678 - DNA, 1092 bp, Homo sapiens
gctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttt

SEQ ID NO: 125679 - DNA, 1060 bp, Homo sapiens
cccagacaccggagaggccagcaaagaaaataaggtattcggcattctcctgcagttttcatttgctacgtggacagaagggggtgaggaaaggtgggaaacgaacctggctcttaggctttgtgctgctgtgacttggagaatcaaagaaactaagtccctgagagggacaatgcagcacccacctgaacaactatcatccctacagtcttggatactgactccagtggcctctggctgtcgcctcccactccagcatgagggatcgggtgcaagcacagaggccatgcagagtggagagcagagagagtcaagtcagcgggcagtcaccttcaggttcttgactcgagctgatcccctaggtgcttgcagttggctggaatgccactccctcagggatcacatctgtgtctagaactcccagggacttggtaggttgtaagtaaggtttgaagattattgttttgtgcttgttttaagacaaaaactgtcttcatggcctctgtgaacagtctcccttcattctgttggaatttcctgttgactttttttatcctggcatactgagatcttaaatgatggttgttttagatgttggccacttggtagttaggagggtgtgagaaattatttaatacttcagccaagaagtctttctagactaaattgttccttttttcccaacagagaagaagagatgtgtcatcattccagttcttcaactccattggcagcagacaaggagtcccagggagaaaagggtaggttgctgagccaggaggaggggctgctgttggtggtggaggtatttgtggaggatgtagagattaatacctattgaaaaaaggtcttgagcattgctatgtctaaggcatgttagatacaaagagagagatttcctctccttcagaagtttatagtctgatgagggagaaaggctacagacgggggctaacgattggatagaggtaagctcagtttgagtcacctgtgggtgatcccagtaattactgcacagtaagcggtttgtgtgcgcgccttaatcttacaaacaccatcc

SEQ ID NO: 125680 - DNA, 1020 bp, Homo sapiens
tctcggcgaggggaacagctgaccttggtatggtcttgtccatctactcctgccctccccggcttagctctcctaagtcttaggaacgctaaggacaagtttcttctgattttttttctaatttatttttgtttttgttttttgagacaacatccctctgtcacccaggctggagtgcagtggctcgattttggctaaccgtaacctctgcctcctgagttcaagcaattctcctgcctcagcctcccaagtagctgggattacaggtgcttgctaccacgcctggctgattttttgtgtttttagtagagatggggtttcaccatgttggccaggccggcctcaaactcctgacctcaagtgatccagctggcttggcctcccaaagtgctgagattaccggtgtgagccaccatgcctagccttcccgttttttctgattggcctgacttcttctttttcactttggtagcctccacctccccagcttggctattcgatcactgccgaggacctagacttagagaagaaggcttcattacagtggttcaaccaggccttggaggacaagagcggtaaggagcacagattgttgcacactggagaggtttcaggtgtctgttttctttggttttattttggtgtttgaaaaaatgggtttctctgggaaaatcccaagtagggttccatgttttcttgtggtctttctcacctgagatatccgtgttggtcttcacgggaactggacagcagggaccactgcaatttagggcaggcattcctccatgagctgtgctgagagcctgctctccgacaggcatgtggaaagaagtcccagacaagccaggactgcttcacctttctttctttcttagatgctgcctcgaactctgtcactgagaccccacctatcactcagccttcatttacctttaccctgcctgctgctgcacctgcctccccacccacctccctcctggccccaagcaccaacccactgttagagagcttgaagaagat

SEQ ID NO: 125681 - DNA, 1851 bp, Homo sapiens
tcaagggcagagacttccccattcatagttgtgtgctcttagcgcctggcaggtgagcttagtaggcaaataaagtatatctagattcatacgtgaacttcagagttcagacaattggactgtcttagtctctacacattaggcccccatttaggccccattttatccccttctgtctgatgatctgtgaggtggaaataatgaacacttccttgatttactgtacaggcctgtagtgtagacttagctgagtttattgactgactcttggatcccaggctctgtggtaggcgtggggaggacactgaaatactgaataccatcatctttgaagtgtttattccaatttcacattttctattcttcttccagaatctgctggagcagcaaccactgaggccctctcacctccaaagacacccaacctcctacccccgctgggtttatcacagtcagggccgccagggctgctccccagcccctcctttgactccaaccccccgaccactttgctggggctgatccctgctccatccatggtaccagccactgacaccaaggcacctccaacccttcaggcagagacgactaccaaaccccaagccacatctgccccgtcccccgcccccaagcaaagcttcctgtttggaacacagaacacctcaccttccagccctgccgcccctgctgcatcttcagcatctcccatgttcaagcccattttcacggctccacccaagagtgagaaggaaggccccacaccgcctggcccttcagtctcagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcccactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccagcccttacccccagctttggcagctctttcacttttggaaactctgcagccccggctgctgcacccacacctgcacctccgtccatgatcaagatcgtgcctgcgcacgtgcctacgcccatccagcctacctttggcggtgccacgcactcggcgtttgggttgaaagccacggcttcggccttcggcgctcccgccagctcacagcccgcctttggcggctccactgctgtcttctccttcggtgcagccaccagctctggctttggagccaccacccagaccgccagcagcgggagcagcagctcggtgtttggcagcacaacaccatcacccttcacgtttgggggttcggcagcccccgctg

SEQ ID NO: 125682 - DNA, 3336 bp, Homo sapiens
gctcgtctgtctgaggagaggttgggcggggtggcaggctcctggccctctgaggccccgtgaagatcaggttcagcacaggaaagacatttcgggttaggagtacagcacagcccagggatgggagttggatggcagagatcagagaggagctgtccggggtggaagtttgcctcccatgggaagccaggtaaaaatggattcttgggcctcgctctgagactctctgggagtttgcatttcgggaggcttctcccgtacagtgtttctgatgcagcggggaaagccctattgaggcaccctgtgttttattactggcctggccttccagagatttgggcacccagagccagagtctcaggtagcagctgccctgatgaggtcttgttgaatctttccaggatcggcggccccttcattttccattggtgcgggatccaagaccctaggggctcgacagcgactgcaggcccgaaggcagcacacccgcaaaaagtagcctttgtcccctgtccctgttccccccaccccttccctaaatctggaccttggcacgtgctagaaagagccttggacccttccagctgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttccactggggaggctggagaactaaggaaacacctgtacatagtgtccgctgccctgactcccgcttagcgcacccttaggcaggcgccccttccacctttccccgagagccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccggttccttgcaggattccctcctttttaaatgcccttgaatctagctttgccttggagaccccagtgggtgctgctcctgccattttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgccctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccagcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggtggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagcacctgagctagtttacctcagttccgcaggcaggacagccggtccgggaaccctgagtgagtgtgagtgtggatgtgtacagtacacgcactggacggcagcgggaggctgggactttccattacaaatagagacttcattcctgttgagtctagttggaacttttagtatgaatgtgagatttttctcctgcttgtgacattaagaataaaaaactgtgatctatcgtagagtacgttctgcattttatttttgcaggcaacactttgctcaccagcaagaacacagcccaaggaagggacccaataacctttcaaaacccaaactgcttcctgcggtgagggcccagggtcctccacggagaggacaggcatcttcctttcccaccaggaaggagtcagcccggagcctctgctatgtgcaaggcggtgtgcaagcaccggctgcggctctttgctgtctcttctttctctttggggctgggctgggtgtgcgttctggtgctgatgctttggcctgtgaggctgagctagagaagtgtagatgttagatgtgccggtgccatcctgcgcctcccaagcacgcccccactcactcaccttggcacctcgacccgttcaattacagcaacgaagaagccactgctgagtgtggtctcaggggaggcccggaggcagtgctcggcacccgggaacgtgctcaggcctcggtggggccaggcaggcagggcgggagctagcctgcaagagaaacggccccaatgctgggtaagagagcagctcaccccgtcccccactccccacgaccctggcgcccgccctgtacctgaaggcgcccgggttctgctgcagcgcatctcgcaccacgtcttcattctcctcctggcagagggagcacgtggagtagacgagccgctgcagggaagggaaagtgagcgcgtggcacagggctcgctgctggaaccctgccagggcatgcagacgcaccgggctaggtgtgcc

SEQ ID NO: 125683 - DNA, 1015 bp, Homo sapiens
gagcagacagctggaggagcccggggcaggcacacctagcccggtgcgtctgcatgccctggcagggttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggtacagggcgggcgccagggtcgtggggagtgggggacggggtgagctgctctcttacccagcattggggccgtttctcttgcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaaggtgagtgagtgggggcgtgcttgggaggcgcaggatggcaccggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactctacgatagatcacagttttttattcttaatgtcacaagcaggagaaaaatctcacattcatactaaaagttccaactagactcaacaggaatgaagtctctatttgtaatggaaagtcccagcctcccgctgccgtccagtgcgtgtactgtacacatccacactcacactcactcagggttcccggaccggctgtcctgcctgcggaactgaggt

SEQ ID NO: 125684 - DNA, 1051 bp, Homo sapiens
gggtacagggaagtgcttgaggctggggctgcgaggcagggctggcacacgacacccaccgccaccgtgggaacggcacctgctgagccttgatcctcagctctttgtcctccgatttccgacagaaacatcctgggctctacagcctccagcccgtggctccgcgattacatcactcctctgtcttctctgttacatttcacacccttctttgattactgcttattatgttgtgcgattatggtggacaccactggcattgctgcttgggtttctagttcacagtccctgtgccttttccgaggcctggggcccacccgccgtggaagcagcctggttcgtaggaatggattcagctggagtcggctgtggacctttgtctgtgttcgctgcctcagcctgactgccattgtctttgtcgatctccggacttatttctccttgagccacggatacagcttttttctgactttgcacctctgtgcgatacatgtattgggttttcaaaatgaaatgtgagctgagctttcctatgttggcgcattctcgtttatgctaaagtgttactttttattggctccgatttgaaaattcaactacctgaacctcgtgggatcccttcgtctgtagggagcttgaagttgatctccccccatctgcattcatgcctggagaatattgattttagggcttattcctaaagtcatttcatgggacacaccctagatcaaaactttcttttttcacttgattattattaaacttgtcattatggacattttcaaacgtctccaaaggtaaaaaaaaaaaaaatgataacatgatcactacccatgtatcattacccaggcttgacagtgaacatctttctgctgttcctgtacccactctccaattttttggtagtacttaattttgaattataaaaatgccacatgccagccgggtgcgatggctcacacctgtaatcccagtactttgggaggccgaagcaggcagatcacgaggtcaggagatcgagaccatcctggctaacacagtgaaactccgt

SEQ ID NO: 125685 - DNA, 1030 bp, Homo sapiens
acgttgtagcacatggagaggaagatgatggggcgctcggggtactggaagcggtggggctccagcaagaaggtgagcacagtgaaggcggtggagaagaagcacagcgccgaccacacggccatccagaccagcgcgaagtccttgtcgcgccgggaccagaacacctcgacgccgggcccgcagcgcggtgcgcacgagcggctcttctccacgtactggaacttctcggggttctcgcaggtgccactgccgcccgcgcccgggcccaggtctccgggagggcgcgcgggccgcggcgccacgggcagcatgcccaggcccttgtggggctccgcggggccggccgtggcgttctcgggcgcctccatgcacagcgcgtgcgggtcgttgcgcgtgggcagccgggcgcagtcgagcgagtccggccagccgaagttgaactgctccatgatgggcgcgcagcgcaggcgcgcctgctcgcacatgggccggcaggcgggaatgggcgtcgagacctggtcggtgcacatgggcgcgtagagcgagcacaggaagaagcgcaggtggctgtggcagccgtactgcaccagcggcgcgaactccgctagctcggcagccgcctcgccctgcgacgtgtggcccagcaggttgggcatgcgggtcaggttgtagccgatgccgcggcacatggggatctccaccgcctggcacggcgcagccccgcgcccgcgctccgggtcgaagcggccgatctccagtgccgcgccgcccgccgccagcagctgccacagcagcagcgccccccgcagaggcgccacggccatcccgggaggcccgggccgaaggcgggagcgcggccccggctcactcgggctcagcggtcccgcgccccggtgcctgcccgccacgtcgcggggcgcgggccatcgctgagccgcccacgtgtgtccgggcgccctgggcagcgagcgggcagccgcccgagggacaggagccgccgagcccgcctagccgccaccgccgctgc

SEQ ID NO: 125686 - DNA, 1288 bp, Homo sapiens
ggcaccaacacagagaagctggagaagctcatggtcaagatcggggtcttctccatcctctacacggtgcccgccacctgcgtcatcgtttgctatgtctacgaacgcctcaacatggacttctggcgccttcgggccacagagcagccatgcgcagcggccgcggggcccggaggccggagggactgctcgctgccagggggctcggtgcccaccgtggcggtcttcatgctcaaaattttcatgtcactggtggtggggatcaccagcggcgtctgggtgtggagctccaagactttccagacctggcagagcctgtgctaccgcaagatagcagctggccgggcccgggccaaggcctgccgcgcccccgggagctacggacgtggcacgcactgccactataaggctcccaccgtggtcttgcacatgactaagacggacccctctttggagaaccccacacacctctagccacacaggcctggcgcggggtggctgctgccccctccttgccctccacgccctgccccctgcatcccctagagacagctgactagcagctgcccagctgtcaaggtcaggcaagtgagcaccggggactgaggatcagggcgggaccccgtgaggctcattaggggagatgggggtctcccctaatgcgggggctggaccaggctgagtccccacagggtcctagtggaggatgtggaggggcggggcagaggggtccagccggagtttatttaatgatgtaatttattgttgcgttcctctggaagctgtgactggaataaacccccgcgtggcactgctgagtcctctctggctgggaaggggggaaggtaggagggtgagggccctgcaggagtctttcttgtaagcagagctggcagtgggtgctggcaccccccaatcaggaggaagtccccccggaacagctgtgcattgcaggagtcccagacaccatgtgtgcgtgttttcccctcccgcccgtctctgtgcttccaaatggagacagggacgcctgcggatgttcagggaattccccagggtgacactgccacctctggccccagggagtccagtttgaggctatggatgagttttccttctctgggaacttgctctccttattggcgtggaaagtaaaggtgtcagcctgtgtcaatgttgtcacgaggaccgcctccctggggccttggaaaattgctggtgcgtctgcctggctcctcggggcccccaccagggcagcccccaccagggcagccccagcctgctccctggc

SEQ ID NO: 125687 - DNA, 2252 bp, Homo sapiens
aagtttcctgataggcttgctgaagatgaaggggacagtgagccagaggccgttggacagtccaggggacgaagacagaagaagtagagaggcagggccgtggtaagggagctgaggtggggggacagctagggagggtgggagggaggcgagcgaggaagaccaagaacctggaagagatcacagggagtccagaaacgcctgtcatcccaagcttatgctgtttttctaaaagctctttatggggcttgatattgggttggtggtctttgtccagaaatatgaagggacaaagagggccataaccctcccttctgagagtttccaggaggagtccgagggtctagcttttctggtgaagccagttcctgttcctgccttctttcctaagggcctgctcgctctggcttccaccacagtgccaagcccctctggtctccaggggagggattgctgtgttacatagcaggatcggggtaatcaggccaacaggggagatggtggcgatttttcttttttaatctgtatttattatacagtcttgtttctttaagcccatactctgtctcttcccccgtcttcctctcaggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagcacatgtacagtacagtttctatgataatgtgtttgctctaacttccctggcttctccttcagcccatccactctcctctagagcagttgggttggaggctcattgaggcaagcagcaacattggagggggagcagggcagtgctgtgtctgctgcctcccatgcccgttctgacctcagccttggaactcctcaagaacctgaagattccagtggtcagtgtcggtggggggtgggaggagagagcggcagagaagctctgagagccccttcccccacaacaaatctagctctagttgttatatttaggcaaaactttgtagtcttctttcccttttatgatggattttgataaaagtacaaaacagggtttttcttttttatcacctttgaatttggaaattttgagcacccaagctcttctgtacctatttaaagtccaccaaggggactgcagctcctagaacatgagaatcaagcctcttaattttaaactgcggaatgtggcctctgcttcctccgtcctcctgcccaaggacgacgaggattgctccagggctgctgggtagtttaccgtcccttctataggcatggagttggcactgacatcacagcttcataaccccaccaccgccagcttcccctgcctcctacatccagtctgttcttgttcatagtgagaatcctgtgttcccacttcagtgacacctgaattgtttgttgttgttttttttttttattgtcttcaaagaggaagggccccattaaagggtgaacttgtaataaattggaatttcaaataaacctcatgtacttgtgtttataaagaagaaaccactctggtggctgtttgtgctctttcttggtgggtgggggtgggtagtgctgtcccgagtgctgctttcccactgacccttggagccgggtcctctgaaggcttggcctccagagtcagggcctctcagtgttcttaaccacagaaagaagtactccctccaagcctctcctggccctgtctccgtctaaaaccctgaaaaacttcatttgaaactaggaattacggtgaaaataggtttttaagccttcactatggggaaattctgccattttaaaacctttctcagggaaaaaaaattttggggaggggggcggtggggacagtctcactccatcacccaggctggaatgcagtggcgtggtctcagctcg

SEQ ID NO: 125688 - DNA, 1045 bp, Homo sapiens
tgagcacctgttgtaaacctgagacacaagtagtctcagtgcctttgtgtgtgtgtgtgtgtgtgttttttttcttttgtgagatggagttacacccttgtttcccaggctggagtgcagtggcgtgatctcggctcactgcaacctccgcctcccaggttcaagcgattttcctgcctcagcctcctgagtagctgggattaccagcatgtgccaccacgccctgctaattttgtatttttagtagagacggggtttcaccatgttggtcaggctggtcttgaactcccgacctcaggtgatccacctgcctcagcctcctaaagtggtgggattacatgtgtgagccacaacgcccggcctatattctttattctctcattggggatcctgggcagggctcttatggaggggactagccctaaattgtatttaatgaggagccttgtggcccttcatggaagtaccagcttttctctggaaagattctgatggtaagtgtagaataactctgggaattacaacatagggtttgttttacaatccagttccatcttacatgtaaatacatccactcgctcaggctgagcttgggctgtgggaaatccaggctgacctattagcaaatggcttctcatgagtgagagtttacagttgattcctgcaggggccttatggctgggagtaactgcaggacggggcaggacagaagtactgaaggacctagccctctgaagggctttggcagtggatgaaaggcacccattcttcatcggctgccactgccttttagtgtcctgttaggtaaggcaagataaaatagcaagagcaccttaaaaccaaaggaggccactgctttccttgtccaggaaaaggattctccctgcatccctttcccccatttcgaagatgctcctcccttcaccttccgttgttctctgctgaatccatagtttttctttcagtgagacctcgaaagaccatccggggcaagcacagcgtcatcccccctgcagcaaggtcaggccggcgcccgggtaagaag

SEQ ID NO: 125689 - DNA, 1390 bp, Homo sapiens
gaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaaggtaaaatttcatgctgagagaaaaggggaagctctgtagaagatagtaaaagaaaggaaattactgaggtaatggtagggtctctgtttgtttacttatttctgtatgtaataacccagcacctattggtatgtattttattttttattagttctgttgataatttcatatttcagctggagtgttcagcctggcattctgattagttaataagttaatgtgatgttggcatcttttctgggttcagtaaaggaccaaatctacaaatagaaatagtggaaacaacataggacttgggagttgactgacctgggttcaggttctagctctgacttagctgtacagtgttcctttgggcagattacttatccgtgcctcactttcctcatatgcttgataagattgttgtaaaattgattgacaaggtatttgaagcccctagcacggtcaccaactcagatagtaatctgtcct

SEQ ID NO: 125690 - DNA, 1411 bp, Homo sapiens
tgttgctcttttctggttagtcccttctgttgaaaaactggatgttcatatctgtgagtgccattgatgtacttagctgattttggtaataaaaatcaagtattctagagttgatctagtcttttccctaatcacataaagcaacagttttcttctgaaatgggctgtattttggattacttgacttggttatttcaattagtttgcattttagctaccaggcatttttctttgtaattatcttttttaaagcattccactcaaagagtttggtttttctttttttcaatacacatttaaaaagagaagcagtggtatcatgacaaatggaccggactgtaacctgttaactgattgtatatgatggagatgaggcatgggaggtatgaggagatgagatgtgtatcaggagagtgggaacatgagtggactaaaggaacatactgtgtttgctaggtgatatggaggacccgtttgaggtgcctggcaatgaatttaaagtgagaccactcactttttttttttttttttgaggcagagtcttgctccatcgcccaagctggagtgcagtggcgtgatctcggctcactgcaagctccaccttgcgggttcacgcctcagtctcccaagtagctgggactacaggcacccgccaccatgcctggctaatttttttgatttttagtagagactgggtttcaccgtgttagccaggatggtctcgatctcctgaccttgtgatcagcccgccttggcctccgaaagtgctgggattacaggtgtgagcctccacacccagctgagaccacccacttttatttatcttttattttagccgtgtttcagctgaacatatgcagggcaggagtaaatagagtgagttaatcagggttatggtttttccaagtagatacaatagaataagagagacaagggaactataggtttatgtgagattaattatcatgattgactaaaatttaatctgggtaaagcaagacatgggggttaggatggtgaaaatgtaatagaattaatggatttaaggttctggtgagattgaaggattgtagagttgtgggactggagggagtggatttggaacataagagggtatgttcaaagagaggatggtgtgaaattagttgtgggaatgagttctttttttttttttttttttgagacgggggtcttgctctgtcctccaggctggagtgcagtggtgtgatcctggctcactgcaccctcctcctcccgggttcaagcaatttcgagcctcagcctcccgagtagctggggtgacaggcatgtgccaccatgcctggctaatttttgcatttttagtagagacggggtttcaccatgttggccaggctggtctccaactcctgacctcaagtgatctgcctgc

SEQ ID NO: 125691 - DNA, 2902 bp, Homo sapiens
ttttctttaaagtctcgctcttaaagtttgtttgttgtgtatggctgggcgtagtggctcttgcttgtaatttcagcagtttgaggggctgaggtgggaggattgcttgagcccatgagtttgagaccagcctgggtaacatggcgagaccctgtttctacatacacaaaaaattaactgggtgtggtggcgtgtgcctctagtccaagctactttggagatggaggcagggtgatcccttgagcccaggaggtcaaggttgcagtgagctgtgatcatgccactgcactccagcctgtgtgacagacagagtgagaccctgttttgggtggaggaaaaaaaaaagtttgtgagttaggggttagaacagaagtactttaaaaggtaaattatattgttgaaggaatggttgctagaagaaaaaaaatgaaaagtaagttatattattttgagaacactttaaatatattttatagtaacaaattttgcaaacttgctaataaaggcatgtggaaattgagaaaagcccactatttgagtgttgtcctcagagttctaacatgttgccctgggtgaatgagaacagtgagataagaatcaatatggattgccaaggtttgctaattcagggttttgctgcctagattatattgcttattattaagttgtgtgcagcatctgaatgagctgctacaagtaatttctttaatttttatcctttttttaatcaagaaacaggagttgcagacagatatttgtggttgtggtgagtttcaagtgacaggaacaaatgtaaaattgtggacgctctctttttctttcaaccttccatgttgccgagacagtcataaatatttttttctgtttagcaattaggaagggcctttggcaaaaattatactgctggtaatccaggtgtcctttcttctccctccccatctgctagtctggtagattaactgtgctgagtgggggatagggagcactgttagcacataagtggttttatactttttcagatccccctgagtccagccatgccggctcccatttggctgtgactgcccagcatgccccatgctgagatgatccagttactgaaggactgctcacgtggggagccggcctattgggagggggttgggtgagttcatttctttcatttttaagaaaaaaacaaacaaaaacatggtgtggcttggcacaaaaacacaccttacgaataaaaatgggttgctagaccctcatggctaagccatcccaccattttcttgtatcatttcttcatactactatgcttctaagtggaagaagtttaaagaacctcatgtaaaatgtgagtgatttttcttttaaaatagaactataatcagtaaataaagaagtgtcccagttattgtaacagaccctattaaaacatacctatttaaaatgctaaaaatgaaacttagtctcctttttagcgataaatttcattttaggatgactttaaatatataatctgttgttctgagcattagaaaaaatgtccgcctgtatgtgtgtactctgaagattttccaaggctgactgaagaaggttgttaactttttgggggcacacatttgttcttatttcctgccagggtagtaatgggtcttgctctgcaatttggatggtctctgccatattctctttggagtactgatagtaattactgtgcatgaagagattggagtcttaaataagttatcttggcttattcttcctagcattttgaaatacagttctgggaaactagaatgaggaaattctgcatctagggaaagtaatcccggagtcatggatagggtttatatgttgtaaagctataaagcctctttgtcagcccattctaaggatggttattggagattggggaacaacacattccagtttctttttgtttgtttgtttgtttttttgagacagagtctcgctctttctcccaggccagagtgcagtggcgggatctcggctcactgcgagctccgcctcccgggttcacgccattctcctgcctcagcttcccgagtaactgggactacaggcgcccgccaccgcgccaggctaattttttttgtatttttagtagagatggtgtttcactgtgttagccaggatggtctcgatctcttgacctcgtgatctgcccgcctcagccttccaaagtgctgggattacaggcgtgagccaccccgcccggcaacacattacagttttaatcaggcaacaaaaagggcagaggaacaataacctgcagttgcctggaactcttcaaaggccagttggcctttgaagttagatagcttagccaaaagagggatttgttaagtatatcctactcagtgtaggccatatttttttcctctgcgtgtagccatggttctgtgggctcgtttctctcattgtatctttaatgtttaaatctttttttttttttttttgagatggagtctcgctctgttccccaggctggagtgcagtggcgccatctcggctcgctgctagctccacctcccaggttcaggccattctcctgcctcagcctcccgagtagctgggactacaggcgcccgccaccgcacctggctaaaattttttgtatttttactagagatggggtttcactgtggtctcaatctcctgacctcatgatccgcctgcctcggcctcccagagtgctgggattacaggcgtgaaccaccacgcccagcccctaatgtttaaatcttaattggggtctggctgggtggctcatgcctgtaatcccagcactttgggaggcggaggtgggcagatcacctgtttgagttagagaccaggctggccaacatagtgaaaccctgtctgtactaaaaatacaaaagttagccaggtatgg

SEQ ID NO: 125692 - DNA, 1049 bp, Homo sapiens
aaattattctccgttttctgtctctcagatagggtctcactctgttgcccaggctagagtgcattggtgtgaccatagctcactatagcttcgaactcctgggttcaagtaattcccctgcttcagcctcccaaatagctaggactattggcgtattttgatttttgtacacagagggtcttgttatattgcccaggtcgatctgtaactcctggcctcaaacaatctttataccttggcctcctgagttgatgagattacaagtgtaagaaaccatccctggcctatatatttttctttctaatttgtagccctgttgatatagatggaattttgatttttctggagagaacgtatattgcttgttctcatttgggtaattactttttaccccagtggtgagttatttgtttctttttaacctagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaaggtaaggtcactgttaatttttggacagcaggataaagcatcattatttctctgatggctccagtatatttatatttatagcaggttttgaactctaacatcagataatgaattaaaaatttttcaggtatatctgttacatacaggttgttatgtgaggttggtaggggagaggccacatttaatatcttccccagttcaatttattttttattatgctagcataattttaaaagtctatatacatgtgcttttgtgcctcagaccctttttggaatgaggtatggtataaatataaaaagtattttgttaaccagttaccaagaatgaaaactgattttgcatgtcggacaagatgatcacatacagtggcagccttgaaaagaacctggaatgaggagcagtgtgtgtgatagattagtggaa

SEQ ID NO: 125693 - DNA, 2180 bp, Homo sapiens
gttcaggctggtcttgtactcgtgagttcaagcgatcctcctgccttgacctcttttttttgaaacagggtcttactctgttgcccccaggctggagtggagtgttgtgatgacagcttagtgcagcctggacctccttgtggcctcggcctcatgctgaattacaggtatgacgcactgtgcctggctgtatacacaggtttttgactgcgagaggaggagaggtcagagccctaacccccatgctgttcaagggtcagttgcacttttttctctccataatctgtaatctaagtccctctcacacgggagcaggtaaaatcctgaaactatgatgtcctagggacctggagactctaacaataatgtttttaaatttgaacaattgagatttggctcactgggaagaccgttcagcctctgaggccttcattaataaagaatttgactggacttgattattgttgtctccaaaaatgtaggtgcaccaagtgtttggtgtgtattggtctccctccgcatgagtattagaggatcaaatgttagcttactatttaactggtacaaactttgcattagaatgtgatgttgtctgtctcccattctattttgtgtgtctagatgttttggatctgtgcagatggtttttgaggtactttcttaatgtagttcgaagcaaacttctgagagtgtcattgtagttggtccatcccaagttgttgatacttcagtttgttttctcctgtattgtgaatgctaacgtctgtattttccagtttccctcttctttttgatactgaagttttgtaataagggcattacttgcaattccttgaggttgagaagtgttttggttaggaatattctctctgctttccgaacatcagttttattgtggtcttacttctgcctctatattcctgaaatagttcctattaagtttacaagtgtcctcttaattgtcaaaagcagagatttcttcttggcctgtgttggacttttctgttatatttattaatatttatttattttttaacgtttaagttcaagggtagaagtgcagggttgttgcataggtaaacttgtgtcatagggcttggttgcatagattaattatttcatcacccaagtgttaagcctagtacccattagttgtttttctttaaaaggcctgagtgtgtgttgttcccctctatgtgtccatgtgttctcatcatttagctcccacttacaagtgagaacatgcagtatttggttttctgttcctgtgttagtttgcaaggataatagcctccagcttcattcatgtcgctgcaaaggacatgatctcattcttttttatggctgcatagtattccatggtgtatgtgtaccacattttctttcttgtgtccattgttggcatttaagttgattctgtgtctttgctattgtgaatagtgctgtatctgttacatttaatactgttggtcactcatatctcttagcttgataccactgtctcctagtgctccagctattcggtttctttacttccttccttccctgccattcctttgactttttccataggattctattctttgccttctgtttttcagtttgcatagtgtaatgttatatgctattcatggcacagtttgaattcttaactgtttgtagcctggtgatttccaagcctgggtcagacttttaactgtagacttgatctttacttgcctgtcctatatgcaatttatttatttatttatttatttttgagacggagtctcgctctgtcacccaggctggagcgcagtggcacgatcttggctcactgcaaccttcgcctcatgggttcaagtgattctcctgcttcagcctccccagtaactgggactatgggagcacgctaccacaaccagctaattttgtatttttagtagagacggggtttcaccatgctggccaggctggtctcgaactctggacctcaggtgatctgcccaccttggcctcccaaagtgctggaattacaggcgtgagtcaccacgcctggcccctcctttatgcagtttagattcaacatgtgtaaagctgaattgacttcactcttcttgtatcccaaggcaggtaaacaagaattgttctctcattcttttacttggctcaccgtccatccacctagtgtctaaggcaga

SEQ ID NO: 125694 - DNA, 1233 bp, Homo sapiens
tccggaggctgaggcaggttagaatggcttgaacccaggaagcggaggttgcagtgagccgagatcataccactgcacttcagcctgggtgacagagagagactgtgtctcaaaaaaaaaataataataagtaaatacatacaaaaatgtaaattcttgaactgtattcacatattttaggctggtacagtgattgccctttggccttgtatattggcattttacatgaatcatgaacctagattgtgatcatttatttcatttttttaggctgtcatatttcaacctagaagtctgagaaaaaaagttgaaaacacttcattgtacttggatactttactgtttcaatcaccttttgttagttgaggaggcatgtatattggatgatatgttctaaacatcttcaggtttctgggtgtttattatctctgattttctctactacctcctttataggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattagtatgtttgatattagctttccttagtgttttatgagatcctgtttattttattatgaacacatcttttagggttctctagcaactaaatgtgtgattttttatgtagacatgattttgttcatttatgattcatagaacaactaaaatgtccacaacatgaaacacttgaatatccctaaataattaagaccattgggaagtcgtttcctctagttgcttagaaagctctatgcagggctgggtgccgtggctcatgcctgtaatcccagcactttgggaggctgaggagggtggatcatctgaggtcaagagttcgagaccagcctggtcaacatggtgaaaccctgtctctactaaaaatacaaaaattagcggcttgtggtggtgggtgcctataatcccagctactcgggaagctgaggcaggagaatcgcttgaacccaggaggtggagtttgcagtgaactgagatcgcaccattgcactctagtctgtgccacaagagcagggccacaaaaacaaaactccatctcaaaaaaaaaaaaacaaaacacaaaagctgtgtgcacattgc

SEQ ID NO: 125695 - DNA, 1060 bp, Homo sapiens
gtctcgatctcctgacctcgtgatccacccgcctcggcctcccagagtgctgggattacagatgtgagccaccacgcctggccgcctagctaagttttttattttttatagagaaacagggtcttgccatgttgtccaggctggtttcagactcctggacttgcatgatcctcccaccttggcctggcaaaatgctgagattacaggcatgaatcactgtggctgaccattagtgggttctaatcacatactttatatcagtcagtgtcctggcaggaaacagatggcatactcaaatgtaattgaattgagtttaataaaggggctgttgacagcagacagcagtctgatcagggttaaggaaaacttaacaaggaaaggttgagtgcctcatacctatcagcagttggggaagactttatcatttctaaaccccaaggaagcagagggagggagtgggtacaggaactagaaaagagtagctgctgttgttgaagagtactatggtagtgagagaaaactgtaactgtaaccatcctcctagggaggcatttggaaataaacaccccaaggatgctttacttccatctcctggttttctgctcatgctccctatgaactgaactcaccagaatctagagggcaaggggagtcttggtggaggctgtaaaggtcagcctatttaagcatagagccaggtagagaaggatggaaatggaattgacatggcaaaacgaaaatattttgcacacatctgcaaggtgaaagaagaaatgtttgaggaaagatgggctgaacccaatggctcctgcctgtaatcccagtactttgggaggctgaggcgggaggttggcttgaagctaggagtttgagaccagcctgggcaacatagggagaccctgtttctacaaaaaataataaaaattggccgtgcatggtggtgcatttctgtagtcccagctacttggaagacaggcaagaggatcgcttgaactcaggagttcaaggctgcagtgagctatgatcgcaccactgtactccagcctgggcaacatagcaa

SEQ ID NO: 125696 - DNA, 1023 bp, Homo sapiens
atctcgctctgtcgcccaggctggagtgcagtggtgcgatctcggctcactgtaagctccgcttcctgggttcatgccattctcctgcctcagcctcccaagtagctgggacgataggcaccagccaccatggccggctaattttttatatttttagtagagatggggtttcatcgtgttagccaggatggtcttgatctcctgacctcgtgatccacccgcctcggcctcccaaagtgctgggaatacaggcgtgagccaccgcgccctgcccaaaagttaagtcttaaaagaggttaggtgcagtggtgcatgcctgtggtcccagctacctgagaggtaggaggattgttcgagcccaggaggtggaggctagtgagctatgattgtgccactgcactccagccttggtgacagagcgataaatgtttgaaatgtttggaaaagaaagaaagaaatgtttgaattgacttgaattaaatctctgggtaggtgtttctgtgttttcttgataactaattacatttatttagtttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggtgagtgcctgttcgtttctgatttgacttaccatcagaattagagctgtcatcgtaggttacagaacacatttctatgtgtgtaaaactgtgttatatttagtattatatttaatgttaagtattaatactttacgttaatacttgtgtgttttcttggttttgtttttttgagatggagtctcactctgtcgccaaggctggagtgcagtgcgcaatcttggctcactgcaacctcattctcccgtgttcaagtgattctcccacctcagccttctgagtagctgggactacaggtgtgcaccaccacgcccggctagttttttgtatttttggtagagacag

SEQ ID NO: 125697 - DNA, 1357 bp, Homo sapiens
atgcaggtgcccagcccatgacaatccattctcattatacttcagtcttagtcatcttgctttgggccctgattccatttttttcatttttttttattttttttagtttttgagacggagccgcactgtctcccaggcttgagtgcagtggcgtgatcttggctcactgcaagctccgcctcccgggttcacgccattctcctgcctcagcctcctgagtagctgggactacaggcgcccacaaccactcacagctaattttttgtatttttagtagacacggggtttcaccgtgttagccaggctggtctcgatctgacctcgtgatccgcccgcctcggcctcccaaagtgctgggattacaggcgtgaaccactgcgcccggcctccaattccatttttatcctctcatgctacacattttaaaaaggagactagatttttttctgtatataagtatcttatgggtatgggtttgtcgtctctgttgcttgcatattgttttcctgaactactgccaacagagagtatgaagcccgcttggaaaggtacagtgagcgcatttggacgtgcaagagtactggaagcagtcagctaacacacaaggaagcctgggaggaagaacaggaagttgctgagctgtaagtaatggaagtattgctctttgccaccatcttcacattgttaggaaaggagggaatattaaccctaaagcagtatgtgtatttaagtttatggggcacaaattagactatattacattagtgtactgtatgggtttctgggttcctttgcctaatggcattttgcagtagcaatatggaatatttatttagttataggtgcacttgtttaggtatttaccaggcctttgagtgttcctgctccatactttgaccttgtaagtactctggtaatgtggtttattcttttttgctttttctttttttgagacggaatctcgctctcgcccaggctggagtgcagtggcacgatctcggctcactgcaagctccgcctcccgggttcaagtgattctcctgcctcagcctcccaagtagctgggactacaggtgctcgccaccaagcccggataattttttgtagttttagtagagatggggtttcactatgttagccaggatggtctcaatctcctgacctcgtgatcctcccgccttggcctcccaaagtgctgggattacaggcgtgagctaccgcgcctggcccttattcttatttttatttttgagatggagtctcactctgttgcccaggctggaatgcaggggcacgatttcggcccactgtaacctctatctcctgggttcaagtgattctcgtgcctcagcctcct

SEQ ID NO: 125698 - DNA, 1267 bp, Homo sapiens
acacctgtaatcccataactttgggagattgaggcaggaggactgtttgagcccaggagttcaagaccaacctgggcaatgtggtgagaccctgactctgcaaagataaaaaatgtaggtgggcatggtggtgtgcacctgtagtcctagctactcaggaggctgaggcccaggattgcttgaccccaggaggtcaaggctacagtgagccatgatcccaccactgcacttcagcctgggtgacagagtgagaccctgtgtcaaaaataaatacataaatagataaaaatgagctagatgctgcagtgtaagtctgtaatcccagctattcaggaggctaaggtaggaggatctcttgagctcaggagatacaggccagccttgtttccaaaaaacaaaaattagaatatttgtttatttgttagatagtattgtagaggaaactgtttaaatacttttatttcaaccactataaaatgtgtcacttggaatatacaggtattgttcactaactttctacttatgtcagttgattttcttacatagcatctgttgctgtgcttaaaagtaaattagttacttgccgtttgaatttggaagtggctggctgatggtgaattccagttggttttgtgtggaaagttgccatatttacactaccaacttgatgtttttctttccctcgtctccctcacgaagactgtctaaacggctagtaaatgatcttctgaatctcagtattattggagacatcatagagactggataaatattatatcaaaagtactttccggaatacttctaagtattttatgaaatttattttttaaaccagggtagccaatcttttggccatattggaagaagaattgtctcgggccacacataaaatacactaacactaaaaacagttgatcagctaaaaaaaaaaaaaatcacacaaaaaactcataatgttttaagaaactttatgaacttgtgttgggctgtgttcaaagccgtcctgggccgcaggttggacaaaggttggacaagcttgtaaaccctaagaagtaacatgtttccaaggtggactggagggctgtgggtaaatggatcattaatgtatgctcaaggttattccaaactgcctgtgagactgtggcctagtcacctcattttactgtagactgattcctttttttttttttttttttttttttttttgaggtggagtttcgctcttatcacccaggctgtagtgcagtggtgccatctcggctcactg

SEQ ID NO: 125699 - DNA, 1271 bp, Homo sapiens
gggctcactgccatctccgcctccagggttcaagtgattctcctgcctcagcctcctgagtagctaggattacaggcgcgtgccaccacgcccggctaactttttgtgtttttagtagagatggggttttaccatgttggccaggctggtctcaaactcctgacctcaggtgatccgcccatctcggcctcccaaagtactgggattaacaggcgtgagccaccgcgcctggccagtaccctactttttaatacattcgaatcggcagtggagtagcaacttgtgagaatccgacatatacttttccaatgtcattaatgttttgagccgttgatggatgctcacacactttcagatgatactttctcaggtctggttctagcagagtataagaaacatgccatagagaagagacaatttctaagtatatttcaggtactgagctatgtaaaaaatggctgtaggaagttaatttaggactggcaacgcaggctttttcatattattgaatgaatgaaattgaaatatatatatgaagagttttgatggtaacaatttaaaactgaaaccggaaacattttaagtggtatgtatttaataaacattcttcattttttaatttcccataacagcatttaaaactgttttaacaaaagaagtcttaaaacatattatatattggggggaaattgctctttcgggaatttctgcaagtggaagcactttgaggatggtttttaaacaattgtactgtatggttggcagattggcatatttctttattaggctattagtggtttcatagaggagaacaaatatgtggttaggtaacagctgcctttgaagtagtattcccagttctcaacttatatttacaattatgtttttaatgggacttgatattttaattttcttttaatacctaccttttgattgcatgtatcacagaactttgtgtgatattttactgacttaaagctgtatgttggtatgttcttggagtatattgtgaatcttcattaaacttagtggaagttgtgagtaatgcacacatttaatgactaggtgttaaatattggtgattatgttgattgtactgtagctttgtatggtacattacttcctaaggtattcccacaggcaggacactagatcttggaaaacactaactttatcagaatcagttcttgatgtgacactgactgtatttaagtcaagataggttttaggcaggaattggagctacaagcagcgtgttgtagatgagtatt

SEQ ID NO: 125700 - DNA, 1073 bp, Homo sapiens
gcgcgccccggccgctcgcgggcctggaggctgagtctcagcctgcgcccgccgatccttccaggggatccggcggggggcgcgcaccggccctggaaggagaagggcccgcttcggccgcccccggggccccgcactttgtcccggggcctcgccggcgaggagcgcatcccccatccccattaccttccccgggttggctttaggccttgaggacccgagagggaggaggaggcgtggggagggggagctaggttttctcctttaatttttacaaaaattttttaaaaatttaaatgaaacctgcagcttaagttttgaaattgtactcgcgcggcctcgtgatgcggcgtgtgcaagactcaactgcgtcttaccccgatctctgcggggatacttggcgtttttttcgtctcccgaggggactttaggccggggatgaactgacaggaccctggggcagaaaactaggaatgagattccccgcttagaggaaagggagggaaggaaactgcctgtggaggagctgatgcctgccttccctgggcagacacaggtttgaaattttgaaggtttagaaggagattggtatttgttaaaattaaacaaacaaaaaaaccaagacgtgaagtttttatgttgtattttaggaacatgaaattggatgttttacaaaggaagcatcctctcgtcatgactaagatttcttgcataagcattatcttttagtgaaaagttgtgcagcttttatttgcttttttttaatgggtgccagaagaatcgtttttgaggcttatctgtaaaaaaaacaaaaacgatttcggaatcaagcatttctttggtgactgaaagctttaagagtgaaggctaatgtgttatgagttttctcagccccttctgttcggaaggacttcatttctcagtttcttgcttgcttctgtataggaggaagtgtctctcagagttatttcatttctccctgatcctcactttaacgcagtactttagaggataatctcattcttgttggagtgcaatttgtgagtgtccctttgtggggagtatacacacaa

SEQ ID NO: 125701 - DNA, 1037 bp, Homo sapiens
acatagccagtctagtaactgttggaatgaatgtcactttaagtccttctattttcagcatttatgctgtctgcattacatgctaaatttttttcttttctttttttttttttttttttttttaaagagatagggtcttgctctgttgcccaggctagaatgcagtggctgaatcctagctcactgcagtcttgaactcctggggtcaagtgatcctcttgcctcagactccgtagtagtaggactgtaagcctttgccaccatgcctggctttcttttaattttctgtagaaatggagtctcactatgttgcccaggctggtcttgaactcctgggcttcaagtgatcctcccacctcagcctccagagtagctgggattataggtgtgagccaccatgcccgacccaggtttcttgttataatatggatatatagatgtgtcttaggcccttgttaccttctcctgtgctgtgacctgttaacagccaactacaaaatggaacttgtttctccatgggaaatgccaattgtagttaatatttattgtgttcttactatttggcatgtgctgttcttagctcctgtgttttattacttcatctcgtcctcatagcaactctcagaaaactgggagattgagttagagttgtgatgtttgggctagaggatgacaagatgagctgctttgtcggttccagatatctccagcccagcagagatggccctctgcagtctagccgtattttgcccttccaccattcttggctgtgacctggtccagctgggccctgaatgaatgtttgcttctcaggccagtattctcccctcctcaccaagccacctccacacagctctaaggaagctcccccaggtccaggcctcaggggagccctgccctcaggccgaccctactgccttttcagagccctccctgccctcctcggaagttgctgatgaacctcctaccctcaccaaggaagaaccagttccactagagacacaggtaagcaatcactttgagttttccagtttttt

SEQ ID NO: 125702 - DNA, 1164 bp, Homo sapiens
gacctcttttcagttcatcaagttcatcagatatttgagtgcccactctgtgcccaaataaatatgagctggggattaaatacgaataagacatggtttctgccatcaaagatggctggtgggagagagagatacacccttattaagtgctttgtgttagtttattcatagctattgttatatatgtcaaggcaagagaggaccagagcaggacagaggcaatgggtattgaagttgaaggggtacatttgataagagagtcggtattgagaagtttaaatttgtgaatttgaaggctgcgtgggtgtggcaggtaagggaaatgaggtatctgggaaggcttgagtgtaggcaaatttattcatcccaagtcaaactcttgatctctctcacgaaaactatgaccccccctggttgcccctgacctctcaatgttggaacaagccacaaccgtggagttatccttgatgactccccattcattatcccttctgtcccaccaccacagctgtcatctgttcaccagaacgttcttttggttacactccatgtgacatcctgaggctgttgcttctctccagcttttctgttaccatcctggtcctggctactgtcacctagtgggccactataatatggcttcctaatggatcttcctgcttcctctgttgcctcattacttttctatatagcagaatgatcttttgaaaatgtgaaccagatcacattattccctagttaaaaccccccaaggcttcccatcacacttggaataaaatccaaaagaatttttctaaaccaaaaatagtaaaaacaattttttttttctgacaatctcttgtcacccaggctggagtacaatggcgcaatctcggctcactgcaaccgccgcctcctaggttcaagcgattctcctgcctcagcctccagagtagctgggattacaggcatgtgccaccacgcctggctaatttttgtatttttagtagagacagggtttcacgatgttggccaggctgctctcgaactcctgacctcaaatgatccaccaccccccttggcctccccaagtgctgggattacaggtgtgagccatcgtgcctagctaaaaacacttaatccaaaattcttaccatggcctgcaaggtcctgtgtaacctggct

SEQ ID NO: 125703 - DNA, 1011 bp, Homo sapiens
accacacccggcctttttttttttttttttctgagacagtctcactctgttgcccaggctggagtgcagtggtgcaatctcaatctcagctcactgcaacctccacctaccaggttcaagtgattctcccacctcagccttcccagtaggtgggactacaggcatgcgccaccacgcctggctaattttgtatttttagtagagatgaggtttcaccatgttggccaggctggtctcgaactcctgacctcaggtgatccacccacctcggcctcccaaagtgctgggatgacaggcgtgagccaccgcgcccggccaaaataactctttaaaggtttatattatccagatatgaggattatcaactttctcaggaaagagattgaggggttttacaggaacaacatgctccgaaaatgaagttttaaaggcttctgggttgtatggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggtgagtgaatccgctctgatgtctgaccagtggctcttggcccctcttgacaaccagggtccttctgtctgtttgtgccatggctctgaagagggtggggtgcctggccctcggcaggaagctgacttagcttcctagctggagctgctcaagttgggccagtgcttaccctgccagggtgtgttggggcttgagctgtgattttctgtgttgcaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctcta

SEQ ID NO: 125704 - DNA, 1050 bp, Homo sapiens
tttccacctgacaaatcttcgggatccaagaagcagaaacaatatcagcggattcggaaggagaagcctcaacaacacaacttcacccaccgcctcctggctgcagctctgaaggtacgtggggtacctggcacagcgtgcaccctgagactcagccccacaggcttttcctctggagtattccatgcatgttacaggctctcctgcctctgatcagaatcagcgggggtgcttaattctgtcccctctcatcgcagcccaatctcagcttgctgttaatccaggccacagggccccatctccccggctccaggtttggcttccccatctcccccaggagctcctattgacacttcctgccacccttcccctagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcaggtgggacaagacggagcctcaggtttgcctgcagaggcctagtcccaggctttggccttcccatatctgctttgaggtagtgaggagggacctggacccagggcctcccttggggtgccagaaagagcatccacatagtttgcgcgctgcctggggctccctggagatctgggctgctatacagcaaggaaacagggggaggtctcttcctacctggaaataccttggcctggcttccagatgagccttagtttctaaaccctagagagaaactaaaggagccaaagctatcagaatcttaccttttgaggagttttatgagatttggaaccaggggcttaagttttaaggctagactgtggggcatgaggagagatcttgacttccccgagaacccagcacaggacctggaacacagagcctctttgtccagtgagagcgtgacttgtctgctgcctgtctctagagccttcatcgtctggctggccaac

SEQ ID NO: 125705 - DNA, 1030 bp, Homo sapiens
gctgctggccctgatggcgacggcggcggtagcgcgggggtggctgcgcgcgggggaggagaggagcggccggcccgcctgtaagtggggccgggtcgggtgggggcggcccgcggtgtcccggctcccggcctcctcgtggtccgacctgcggtttgggcccgcggctggtggggcccggcgactccatgggcctcagtttctcctctggtaacgtgagcttcgcttccagagacggggacccgccttgccgggttaggcgcacctcctggggcgggactggctccaacctgggccccttactgcggctttctctgtggccgaggccaggccgtccccggggtggccaggagagcaccgtaaactcttcagcctgctccgtggccgcgatctcggaaaaagcaccaattctgtgatgtgcagcagcatttactgggcatctatgaccctgtgataggctttggggtctttttctgtaaggagtccagtaaaggagaagtacatctgtattatgaacacctaaatatgtaagtgaaaaacacggtgaaataagtttcactgaggccaggcgaagtggctcacgcctgtattcccagcactttgggaggccgaggcagggagatcgcttgagcccaggagtttgggaccagcctgagcaacatagcaagaccccatctctacgcaaaattagctgggtgtggttgtgcacgcccctgtagtcccagctccatgggaggccgaggcaggagggtgtcgtgagtccaggaattcaaggctgcagtgagttgtgatagatcgcgccactgtacttcagcctgggtgacggcaagagcctgtctctgaaaagtttcatagaagaggttagtactagaaatgggaaacaccagagagtcagtgggcagccctgctctttttatttatttttcagacagagtttcgctcttcttgcccaggctggagtgcagtggcacaatcttggctcgttgcaacttccgcctgccaggttcaagcgattcttctgcctctgcct

SEQ ID NO: 125706 - DNA, 1022 bp, Homo sapiens
gccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcaggtgagggccagcaacggggagaggaaagcctggggagggaggccagggggtggggaggacagggggttttgggagcagaagatgaaggtgaaggggcaggtccagttcaagggacagagtggcaaggaatgagggatgtggggcctgtacctaaaaggggtgtggactcttgggaggggcaggatggggtcttgatagatgccgggggtgggccagccccagtagcctcacggttctgcccgtgcacagctaagccggagcaagccctggagccaccacttgtatccagcaccctcctccggtccccagggtccccggtaagatctcgggcactgggcggtggggctgtgcccacggccttcaacccgactctccgcccttctccaccccagcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggtaaagagaggggttgcagggatt

SEQ ID NO: 125707 - DNA, 1133 bp, Homo sapiens
ttgtcaggggctgggagaggccatcattagtgcagtcctcactctctggttagggccaaagaaaaagttttggctacagatgtggggcagaggagggaagagagaggggacgtgcaggcttaggattgctgttcagataggagaagaggaagaggaactggggtttgctatgcatttactgcaagccaggcactgcacaagcttttctggcactgtttccttcttcctgataaccagagaaggaaaagatctccattttacagatgaggaaacaggctcagagaggtcaaggctctggctcaaggtcacacagcctgggaacggcaaagctgatattcaaacccaagcatcttggctccaaagccctggtttctgttcccactactgtcagtgaccttggcaagccctgtcctcctccgggcttcactctgcacacctgtaacctggggttaaatgggctcgcctggactgttgagcagagctgggaggaggtctggaagcaacatgggtggtgcattctctgcattcagggagaaacacacaagaggggattacattggctgacccccaacctcccaggtcagctcatgggtgtccatgtgtcctgcgcccacctcacccacctccaccccctccccacccatctttctcactcctgaaacttaggggcaaggtggctctgtctctcctctttgaagttagctaagctgaccttggagaagggggcccccaacaagggaagagtgaacagaatattcccagggtaggtcctggcactgataaataagagacagacaactactgccctagggccagaggcagtggctcaagcctgtaatctcaacactttgggaggccaaagtgggagggttgcttgaggccaggagttcaagaccagcctggacagcatagaaagatctgtgtctctgcaacaaattaaaaaattagccaggtgtggtggcacaggcatatagtcatagctactcaggaggctgacacaggacgatcacttgagaccaggagtttgaggctgcagtgagctatgatgtcaccactgcattccagcctgggcaacagagcaagaacccctctcttaaaaaaaaaaaaatgctctacccagaatcccaggccac

SEQ ID NO: 125708 - DNA, 1048 bp, Homo sapiens
gcagcaacctccaaggtaacagccgctgccaccatcgccagcgcatggctgccatgttgaattgattcggcaggcggtgcaagagaaaccggccaatgagaggagtcggttggtcgccctgtggccagtcacgtaaaggggggggcggggcggtcgtgggggtggaacatgcgtattactaagcggtcgccgggctgatgacataaaaaccgggtgccggcaggcgccagtcgcaggtgtgctgctgaggcgtgagaatggcgtcccgcggccggcgtccggagcatggcggacccccagagctggtaagtcccggggcccgcggacacccctctccccacttctgcggccaccgcgtctgaattattcctctacatgccattttctctttttcgcagttttatgacgagacagaagcccggaaatacgttcgcaagtgaggggagcctgaatactgcggggcgtccgggggtcgggaagcggcaagttgcccctgttgctggcgttgcccggaaaggccgtagaatttgggggtgcgggaagggaaggacccgggtgggtgccgatttctgtctctggtaaatcaactttaagttgccgacctctctgggcctcggtacctcagcgttgaggtaggggtgatcgcgcttgctttccgtgggtggttttcaaagtcgaatgtgacaatttgtcctaaacatgtggtaaaagaggcgctgggcggtgggtacgggcgaggggtcagtcctggtggggggaaggaagtaatggccgtaggatgcttatcgtggcgccttgttgccaataaatctccaagacagcagttggtgtattattgtctgaatttcatagagggtagtttgtataactactgagttgtagccaggtgggagtggctcacgcgtgtaatctcagcaatcgcagcactttgggaggctgaggcgggaggatcgcttgagctcaggggttcgagaccagcctgggcaacgtagcgagcccccgtctccgcaagtaataaaaaaattagccgggtgtggtggctcccctc

SEQ ID NO: 125709 - DNA, 1069 bp, Homo sapiens
ggcgggaaccgagccctaagctgcaaccagaaccgagcacgcacagagcggcgcagaccgaattcccagattctacgcaccgcggcgcttcgcgaggggaggggcaagcaccgcgggttgcccagcctagggcgaggccaggtgcggcgctcagggcgacccgcgcaaagcctgcggggattacgtaatggcgtaaggggcggggatggaggcggggccggactgttctcggggatacgtaaggaaacgggaccaagggcggagaatcccgcgatgggggcggggagagggcggggctcaagtcggaactgggcggggcggctgaagacggaaatgggcggggctgcgagctagggcgggagaaggagcgcggggaggacgtaccttgtgagatgcgagccggccaacagcttgcaagcatgctccgctggacccgagcctggaggctcccgcgtgagggactcggcccccacggccctagcttcgcgagggtgcctgtcgcacccagcagcagcagcggcggccgagggggcgccgagccgaggtcagtcaagggcaccgggcgggaggccatcctctgtcctccttttcctgccgggccccgacggccccatctcctccctttgggcctgtcacctcccaggcctctcccccaaagctctttccccctacccctttccccgtctccgccggctcagactctgacctcgatccttcccctgccaggccgcttccgctttcctacaggcttctggacggggaggcagccctcccggccgtcgtctttttgcacgggctcttcggcagcaaaactaacttcaactccatcgccaagatcttggcccagcagacaggccgtagggtgagctttcgagtgggcggggctcctttggggctgggcgggagtgggcggggcctgagaggaggcggggcagggggggtcccgcttctcacgctcacttccagatccctcactctgagtatggaccctgaacggcaaccccatttattccctcacgttgccatcttcattaattcatgttgtagatctccatcggggctggcccat

SEQ ID NO: 125710 - DNA, 1514 bp, Homo sapiens
ccatgtccatgggcctggagatcacgggcaccgcgctggccgtgctgggctggctgggcaccatcgtgtgctgcgcgttgcccatgtggcgcgtgtcggccttcatcggcagcaacatcatcacgtcgcagaacatctgggagggcctgtggatgaactgcgtggtgcagagcaccggccagatgcagtgcaaggtgtacgactcgctgctggcactgccacaggaccttcaggcggcccgcgccctcatcgtggtggccatcctgctggccgccttcgggctgctagtggcgctggtgggcgcccagtgcaccaactgcgtgcaggacgacacggccaaggccaagatcaccatcgtggcaggcgtgctgttccttctcgccgccctgctcaccctcgtgccggtgtcctggtcggccaacaccattatccgggacttctacaaccccgtggtgcccgaggcgcagaagcgcgagatgggcgcgggcctgtacgtgggctgggcggccgcggcgctgcagctgctggggggcgcgctgctctgctgctcgtgtcccccacgcgagaagaagtacacggccaccaaggtcgtctactccgcgccgcgctccaccggcccgggagccagcctgggcacaggctacgaccgcaaggactacgtctaagggacagacgcagggagaccccaccaccaccaccaccaccaacaccaccaccaccaccgcgagctggagcgcgcaccaggccatccagcgtgcagccttgcctcggaggccagcccacccccagaagccaggaagcccccgcgctggactggggcagcttccccagcagccacggctttgcgggccgggcagtcgacttcggggcccagggaccaacctgcatggactgtgaaacctcacccttctggagcacggggcctgggtgaccgccaatacttgaccaccccgtcgagccccatcgggccgctgcccccatgctcgcgctgggcagggaccggcagccctggaaggggcacttgatatttttcaataaaagcctttcgttttgcactcgctggagcctccttgttcccagcgcctccacctccctgcagagctccccctcggggcggccttggctggatctcgctctcccggatggagcttagagggaagatggggttgtaagctgagcttggtgatggcggggtggtcacttgcccactccctggggattcggaagacagcctgtgaggccaaagccagcgcccaatctaggaagcaggcatgagcactttccgcacgccatggctggggatgggaggggaaggtggcagagatgtgcccctgggtctgtgctgggagcccggaccccgcacaatacccgacacattcggaatctcccgtgcgccttgtgaaagagcgcattccgtactgccatttcctattggaaaaacgaaaacaaaaagacctattgtttggataaaacacgccaccaaaagtaaaaccgggccaaatcttctcacctgg

SEQ ID NO: 125711 - DNA, 1369 bp, Homo sapiens
ctgtacaatttctctggacatatacatgccctgcctggctgttttctgcttttatagcatacttaacatcgcctctattcttaccataaccctggaagtgagtcatgcagacaccatttccctaattttatagaggaggaaactgaggctaagagaggcgacgtgactttcaccagcctcaaggccagcaggcgtagggctcacagtgcccaatccaggcacaactggcagtgcagtggggaccactctgggcctcaacccctagtctaagcccagccacaccacctggagggtctacttttcttctggcccagagccacccccactcaccaggaaactgtagcagccagtagtccactggaggacttgagttatatgaacttcctctagaacagctccacccagcaccagctgggccctctggactggcactcccagatctgcccaggccctgcccaacaggtgcagcccaagacctttgctcctgaaagaagtagaaccctggtttccatgagcccctgacactgtttcttactcttcttcttcttttctttttttttatttttttgaaatggagtctcgccctgtcgcccaggctggagtgcagtggtacgatctcagctcactgcaaccaccgcctcctgggttcaagcgattctcatgcctcagcctcccgagtagctggcactgcaggtgcatgccaccacgcccagctaatttttgtatttttagtagagacggggtttcaccatgctggccaggctggtctcgaactcctgacctcaggtgatccacccgcctcagcttcccaaagtgctgggattacaggtgtgagccactgcacccagccatgtttcttgctcttctatcattccaaggcttaggcatttacagaagagggcacaggctgcatgcctgtgatttgagatatggaggcaaccccaaaaaaccccaaggcccagctcaatggggtctctcttctctctggaagagcccttgactcctacaagatgaccaagcccccttgactcagcacagcagtatccctttatcagtcatttatgccagtaggaaagcctgggtaggcaaggttgaaggaacatgagaaagtcttcccttcattcaagtcactaaatcgactctctgttgagtacccaacaccattctaggcaataggaatgcagcagtgaataaaaccagcaaaattcttgcctgttctgggacattacagatgtcccaatggagctgacatactggaacagaaagaaagaaacaatttaaaaattggctgggtgccatggctcatgcctgtaatcccagcactttgggaggccaaggcgggcagatcatgaggtcaggagttcgagac

SEQ ID NO: 125712 - DNA, 2578 bp, Homo sapiens
tcgtggacgtttccaagacttcattctcaaattctctccctcagggtccccaccctgtcctcccacctaagcctggaatgagggggcactggcctgtggggaccctggtcttcaggctcccaaacctggctgggtctggttgccccctggccttaacctgtgaacatccagctgtccctgggctgtgattcagtgtctgtctcccgggtgacctcagcatgggctttgaggaaggggagagagtagtttcttctgagactggatagtgactcagggacccggggctggggcctcaaaagtgcctttgttggcctgggctcaggaatccagagaaactggtcaggaggaggccccagtgacaaaaacccctccctctgcccccgcccctctgccagagccatataactgctcaacctgtccccgagagagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgtggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatagcttaaccctgactttgggatctgcctgcatcggcgttggccactgtccccatttacattttccccactctgtctgcctgcatctcctctgttccgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacaggaggaaattttattgtctctgatttcaactgtggaggtgggtggggaagggctggaggcctgggtgcgggggtggggggggtcagtcaggggcaggaccactgtgttttggccgggacataaacacttaaaaaaaaaaaaaaaaaacgagatccagggaattgtgaaaaattggagctgggccgggtgcggtagtgagcacctgcaatcccagcactttaaaaggtcgaggtgggaggatcgctcgaggcaggagtttgagaccagcctggggaacatagtggcaccatctctacaaaaagttaaaaaaattagctgggtgtggtggctcatgcctgtaatccctgtacttggggaggtcgaggtaggcgaattgcttgagcccaggagtttgaggctgcagtgagctttgatcgcaccactgcactccagcctgggtgacagggcgagaccttatctcttaa

SEQ ID NO: 125713 - DNA, 1050 bp, Homo sapiens
gagggggatggtggaggtgctgctacctgacggtggagggggaggccggggccagaccaccgagaagcccctaaacccgcacagcaggaaaacatctccgcagtccctgctctaccaaggctggaggagggccacaagccttgagctcattggctggcggggggggggggggcgggcagactgccagcgccttcctttgactggctattttctctcagcggaaaaccaatcattgcgggcaggcggtgagggtgtggccagggtcgcaacacaggccccgccccgagtcctgttgcccacacgcccgaggcgcgctggattggcggtgagttctgactccggcctccttcgagaccgtttcgctccggatgtcgcccacctccgaccctctctcagtcggagggcggaaaagaggaagataggtccttcctccagccgcggggcacccccttctcccaccttgcccttcccccagccctgcagccccagagtgtaaatatccaagcccgccctctctgcgctcagtgtccccatctgggataggggccgggataggggtcgcgctggcaggaggcctggcagcctcctctgaagggggaggagggaagggggaaaggaggggatgggcgattgaggtggacctcgagacagggcaacggtgtccccacaggagcatggcccaggaggagggtgggagcctgcccgaggtgcgggcgcgggtcagggccgcgcatggcatccccgacctggcccaaaagctccatttctatgaccgctgggctccggactacgaccaggtaaactcatttggggccttgcctccactagaccagcctccatttttctacctgtaaagtggggaatcagccttgcacccgggggcggctgtgaggacgaagtgaggcctggctaagaaccctacagtcctgccccttccagaacccgccccacagctctggattggcagccccatcaggggccatgacctcctgaggggggctgcctggaggaggtgctattgagaagtcactgtggggccgggcgcggtgg

SEQ ID NO: 125714 - DNA, 1046 bp, Homo sapiens
tttgggtcttttttttgtttctttcttaaagccactttagtgagaagcaggtaccaagcctcagggtgaagggggtcccttgagggagcgtggagctgcggtgccctggccggcgatggggaggagccggctccggcagtgagaggataggcacagtggaccgggcaggtgtccaccagcagctcagcccctgcagtcatctcagagccccttcccgggcctctcccccaaggctccctgcccctcctcatgcccctctgtcctctgcgttttttctgtgtaatctattttttaagaagagtttgtattattttttcatacggctgcagcagcagctgccaggggcttgggattttatttttgtggcgggcgggggtgggagggccattttgtcactttgcctcagttgagcatctaggaagtattaaaactgtgaagctttctcagtgcactttgaacctggaaaacaatcccaacaggcccgtgggaccatgacttagggaggtgggacccacccacccccatccaggaaccgtgacgtccaaggaaccaaacccagacgcagaacaataaaataaattccgtactccccacccaggtcctgcgtggcgatgtgtgtctggggccctggggaaatagtcaaggtaagaggagttagtcttccctgaccagaagacaaggatgagtgtggtggctcatgcctgtgatcccagcactctgggaggctgagacaggacgatcccttaagcccaggagttcaagaccagtctggacaacatagtgagatcctgtctctacaaaaatttttttttaattagttgggcagaggccaggtgtggtggctcatgcctgtaatcccagcactttgggaggcagaggcgggtggatcacctgaagttaggagttcaagaccagtctggccaacatggtgaaaactcgtctctactaaaaatacaaaaattagccgggcgtggtggcacatgcctgtagtcctagctacttgggagactgaggcaggagaatcgcttgaacccgaaaggcagagg

SEQ ID NO: 125715 - DNA, 1049 bp, Homo sapiens
ggtggcctttacttgggtgtcacccggggaccacttgggggtccaagcgggacaggcctccgaggtccccgccatgtatggaggccgaaaggcagcgtcccaggcgaactggagagggagttccccccagctctccaggtcacctcccgccgacggacggaaaggccggcgcgcacgggcgtggtgcggcggggataggaggcagccacgggcgcaccccagggccagcacataatgggccgcgtaggccgggcaggcgtccagctgggacgccgccgcaccacgtgggctgcagagcgcacggggcaggcagctgccggtgggcccagggccgggcgctgcgcggccagcgtccgtgcgtgcgtgcgcgcgcgcgcgtgcgcgtgcctgcgtccaagggatttgcgatcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtgaggcgggcgtgcgcgggccccgtcgggggctgcgggaccggcggagtcggggccgtcagggtggcggccgtcctgcgctcagccggggcggcgggaggcgggggcccgcggaggcctaggagcggcgcctggagggccggggcctggaaatggcgcgctcggagacggggcggcggcggctgggctcccggggtcttgcttgcggggcggatcccttccactgcctcccgccaacgacaacgtgttggtttttgccctgccttggccgcggcggcgccgatgcccggagacgagcgcccgcttccagccccatcccccctacggtaggaccagtgcggggctgagctgtggcgctggggtacgggccacacggcctgccccgctccggtcccggcctctttcgcggccctctgttgcctgcccgccttgcaggcccctggccccttcgccacgaggccggccgactggggaaggtcggc

SEQ ID NO: 125716 - DNA, 1012 bp, Homo sapiens
gctagaaactcctctgttgggaggtttaaatgagatgtgtctcataatttggaggcatagtcttgccctgttgcccaggctggagtgcagttgcacaatcacagtcccaaagtgctgggactacaggccggagccacatgcccatgcccagccttgagcactcaactttctgttgcatctacttactggatacatccctaccctcataacatctactctgtacattggcttctttttatagttaccctctctcagtctcctttgacacctacagatcttttctggctcaccctaagggttcagtattggccccatctgccatctggaagtggagtcccacttctgttgctctctgctgtgctgcatatcctggctcccaactgctccaccctggtgaaactgttctcattgctatcttccagattttctgcagtcctttgcttgtgacgtgatttctcctttccaaattatcagctccttgagggcagaaaccgagtcttaggtttgtgccttctctacattctctccacccttcatagacatgcagatacgtggttgatttgagtaaggaaaagtgatttgcctgtcaaggattttagtcacacttggagccgaaagtagggtttcctaaattactgaggctgtaattgactactttaatctttcataatcaatagactgtccctaatgggcagtagaaaggacactgctcagtagtggcagggagtttgcagcacagaccttgacttcaggtgtcctgaattggcacgctctgctgatctgttcctgttctacacgcactcctgccagcccagtgtagcctcaggcctgttgggtctacccaggagcatggcagaattatatagcacttggtacttaggaaatgtttttatggtcagttttaaacttataaaatcaagattgaaatataacagacaagaaaacataggtacagaggtaatttggcagaggtcctacatcaagctagctaaggtgtcaagtgaacctgttc

SEQ ID NO: 125717 - DNA, 1050 bp, Homo sapiens
tgaaaccctgtttctactaaaaatgcacaaattagccaggtgtggtggcacatgcctgtaatctcagcatccttaggaggctgagacaggagaatctcttgaacccgggaagcagaggttccagtgagccaagattgtgccactgcactccagcctgggtgacagagtgacagtctgtctcaaaaaatttttcttttcctttttttttgtttctccagccattctctgtaacagtcttgtggtacatcgagcagagtgcctcacctggggcgctggcggcgtagctcagcggaagaccgctttacttgttttgcttattccactctgggcacacttgaatcctgtttgtctcccctcctaggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggtgagtttgggggattcttattgtatattactgtaaagtgtaggggaggatgggaaggggttctaaataaaaatagatttgtgaaccagaggctgtaatcaagaaagtgttttaaacatttgcctggtctaagtggccgaaagaaacataactcttcaactcataggtcttcagttcacttaggggaaaatgttttgtacacagtgtagttcatagaaatacatggcatatgcccaggtttgtgagcctgacctctacagcagtcctgtctgccagtaaaggagttccccaggagagagaggaatagagccgaggactcttaggcacattcctcctggaatgactcgtagattttccttggtagttaatccagtaatcatatggtactgtcatccagtaatcataaaacccagaagagaagcagccagtgctgtcagtatgcatttgtaaatttggagagtgtgcttgggagggctggctgagatttcagatatggtgtct

SEQ ID NO: 125718 - DNA, 1989 bp, Homo sapiens
ttaattaacattcagagaagaatgccctgattgccaaggatatattttcagctttgtgaagcaaattttatgtcagttacctgagtagtaagttaaatcggcactttaagcctctttcttcagagcattttaggtaccaagtttgaaatctacgaaatctaatcctcacttagattaaatagtcattcagaagtcagaagagctctgcagatggcctgagaaaggtttgaatattatggttaaaacattcaagaagaaagctttctagaaacgcagctgctatttcagtgcatgttcagttagcattttctgactgataaaatagaattgagagggaggaatgccagtcagggttctatctattgaaaggctctcctagtctgccatcatctagacaacagaatggtagttgtgacgtggagaagtagtatgaataggatcttcccacatctttaacccagaattacttgaggaaatcggggtcttcttttcttttccaggattctgctatgtagaattcgatgaagtggattcccttaaggaagccttgacatacgatggtgcagtaagtatcctcgggttttctctgtcatagcagttgagattgttttctttgccaatacttacactattttccctttatcattagctgttgggcgatcggtcacttcgtgtggacattgcagaaggcagaaaacaagataaaggtggctttggattcagaaaaggtggaccagatgacagaggtgattggttcttctaaagctgaacatcataaagatttgcagtatgcctaccaattccaactcgtgaacgttcctagtagaactcgattatctcataggtgtgataggttctcgtgagctcttaaaagtttgcgtaaaatcctagaaagaatggctgatgcttctgcaagcctggcgttttttgttttctgttggaagcaaaagctcttaaaatgatttcattgaaccttccatcacttgagttgtatgtcttccaaatgaatttttccatgtttgcgcagcaaggtaatgacacgacctcaactttatcttttttgtgtatcctcaggaatgggtagctctcgagaatctagaggtggatgggattcccgggatgacttcaattctggtatcagtatttaaagtatcaccacttaatttttcctaggagccttgctgctgttctctgtttcttacgagtagcccgcctggccggactacttatttagttcctttaacaaatacaactctcctgcagggtgcccaggcatgcaagtaagcctctgttagagcctgtgggggcaggacttgagccccatgcaccttgtgtggtcacctttgttagcctgcagctccttggatgtgtacgggcctgggtccttgagctcgctcagcagtctttctcagactctagcccagggaaactcctctgtggttttgtgtatggcaccaagagaagtactgttccttctggaaaacataggatagaggtttgggttcttacatggtgaaaggtagtcctgatggcccttttttttcttggaggattgtggggaggtccagtcccttgatggtggacctgatgcacttcgccgttctctttcttagccaacccaggcagagcagctggtggtatagcacaaagcatcagtccacacgccaggcctctgccctgcagggtgattttaagcatttttatcatctttactttctgtttttaaattacaaaagtataattttttatatatgcacatgataaaaacttcagttgtaacccagaaaggtaggaagagaaaaacaaatttgttttctttcccgcaaacttgggatgtgctgtcaatgctgtgctgtatagaacgtcagcaccctccccccatcaaaacaaaaccggtgtaaagtagtgggtgagtatgggagggactggtgcacgctgtcttgtgagtctgagatttttaaaaactcagctttggctgaacaggtgacg

SEQ ID NO: 125719 - DNA, 3328 bp, Homo sapiens
ttgtttaccacacaggtgctttgcttgtagaatggcccacacctaaaacgcagccaaaacaggaaaattgggactttgtgtttttattttgtcttcatatagcgttttcttgtgatttttgtgttctgagttgtaaatacttctaaatttcaggtttatcttttaaaatagctgtatagatttctattagaaaatagagttcaacctgctttgaggctttcttgttttgcttaagccgtattaaaatacagtttcgtggtattaatatttttctacttttcatgcaagctgagcatgtaaacagctcgtttgtttgctctcctaagatcttgattcctttttctttgggaagtctgttagcgctgtcattactccacacattggcatttggacccacttttaacacactttattttggagagacttcagatagtggacaaactaaagaatttaaaatgaaactcaaacaattcccagaacattattctataagcagcttggagacgatagtttgaaaagtaattcagtgtcctgtttcttcctcaggcttcagggatgacttcttagggggcaggggaggtagtcgcccaggcgaccggcgaacaggcccccccatgggcagccgcttcagagatggccctcccctccgtggatccaacatggatttcagagaacccacagaaggtacgggctcatgtgtcagtggagggcatcttgtcctgatgggatgatcatggccggttcacaccccgtggggacttggcgttctacggcacacagagttgtcggcatagatccccacgttctctggaatagcaagttcaccttggtcattagagcatctgctgttggggtagcaggccaggtgaattttagaaagtgggctggtttgctgacagcaacatcagcatggtcgttttgctggatatggaatgggatccacactctgacaaactctgctttttctcccccagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatatttaatgcttgcctttatttttgagttctttttagctgctcatggaatgtaacaattttaaatttgggaagcaccattgaaatggaagagtcttcctgtcattttaattctgggatgagtgaagttattttaaaagctggtgatgattagaaataggatgccaattttttcccctcacttgctaaaaatgtccttttcccaaccaggcagaaaccttgaaagtctggctgtttttggttaggtaaaggaacatttttttcccaagatggaagaaatcaagcatttacacaacatgtggcttcttttaacaactgcttgtaaacgaaattctaggtgcccctcatggctgggagggctgctgcttcctgacagcagatcctgactctggggaggtgctgctataggttggtattggatagtgttaaa

SEQ ID NO: 125720 - DNA, 1046 bp, Homo sapiens
atttttgtatttttagtagagatggggttttaccatgttggtcaggctgatctcgaactcctgggctcgtgatccacctgccttgacctcccaaagtactgggattacaggcatgagccaccacgcctggactttattactgaatttttgagaattctttatacagtctggatgcaagttctttatcagatatataaatattttcctctagcctggctttccgtgccaccaccccgccccccctcgccccacccattttcttaacagtttctttgaaagaactatcagcatccttttaagaaataaatagaactttaggtaaacataatccattgcatcttagcattcattttccggctggggttggaattcctcatgctgattttgaaaaaaccattagttcagtttgtttctgtttttatttttatttttttcagttcagattttaaaaaagaactcccccacttattaaccagatttgaatttggtttgtttttcaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtg

SEQ ID NO: 125721 - DNA, 1028 bp, Homo sapiens
tagtcatcagattaataaagcattttaagagctccggatcaagagattacatgggtgtggtagtagaccattttgcaacacagcttaacacatttgcgataggctgggctcagtggctcatgcctgtaatcccagcacttttggaggtcgaggcaggaggattgcttgaggccgggaacttgggaccagcctgggcaatatagcaagactcttatctttatattactgaaaaaaaaatatttaagcaaaacaacaatacatttgcaatgttatctctctatctgccatgaaaatcagttaaggtacccccatgtgacctgaagggtgggccccaccagctgtggtgagtctcaaaatcacatgtcttcttacagtttaaagtggtaagcagccttttctgtctcctttgtctagattcttgctcacttgtggcatctgggctactcaccagaagatatcattggcaacatctttcgagtgtgtaaaactttccaaatggcagaatacctgaaactggagtttatcaaggtcggtgagaatgtagaaatgcctctgtcctcaagaatgtggcccatagtggccgggtgctgtgggccacacctgtaatcccagcactttgggaggccgaggtgggcagatcacctgaggtcaggagttcgagaccagcctggccaacgtagtgaaagcctctgtctactaaaaatacaaaaattagctgggcatggctgggcgtggtggctcatgcctgtaatcccagcactttgggaggccgaggtgggcggatcacctgaggtcaggagtttgagaccagcctggccaacatggcaaagccccatctctactaaaaatacaaaacttagctgggtgtggtggcaagcgcctataatcccagctacttgggaggctgagggaggaggatcgcttgaacctgggaggtggaggttgcagtgagccaagatcgcaccactgcactccagcctgggcagcagagcgagactgtctcaaaacaaaaaaaaaagactgtgggc

SEQ ID NO: 125722 - DNA, 1024 bp, Homo sapiens
ttatttatttttttttctgaaacggagtctcactctgtcacccaggctagagtgcagtggtgcaatctctgctcaccgcaacctctccctcccaggttcaagcgattcttgtacctcagcctcccgactagctgggattacaggtgcctgccatcacgcccagctaagttttgtatttttagtagagacggggtttcgccatgttggccagtctggtcttgaactcctgacctcaggtgatctgcccgccttggcctcccaaagtgctgggattataggtgtgagccactgtctccggccagctgtattgatctgtgtgtgctgtgggtggaatgcaggggtcagaggtgacggagatgcaaacagcagtgaacataactcaagagctacctgaggtccttctggtggtttgaagtctttactggagatctcattcccagggccctccaggaaccggcaagaccacaagcattctgtgcttggcccgggccctgctgggcccagcactcaaagatgccatgttggaactcaatgcttcaaatgacaggtaggtcttagagtcagacctgtaggggggcgggtgctctgcattgagaattgttacagaaacaacctttctcagcattgggttgtatgcgaagccttgccagctatgtgatttcctccaccccttcccagtgaaagagcgttgctcacttgtcaacttgccggtttattttttttgttttcatggaaattttcaaaaactgttcttctcagccaggcatggtggctcacacctgtaattccagcactttgggaggccgaggcaggtagatcacctgaggtcaggaattcgagaccatcctagccaacatggtgaaaccccgtctccactaaaaatacaaaacttagctgggcgtggtgctgggtgcctgtaatcccagctactcaggaggttgaggcaggaggattgcttgaacccaggagaaggaggttacagtgagctgagatcgcaccgttgagcactccagcctgggtgacg

SEQ ID NO: 125723 - DNA, 1050 bp, Homo sapiens
attgcttgaacccaggaagcggaggttgtagtgagccaagatcgtaccactgcactctagcctgggtgacagagtgagactttgtctccaaaaaaaaaaaaccgccaggtatgatggtgcactcctgtagtcccagctactcaggaggctgaggcaggaggattgcttgagctcaggagttggaggctgcaatgagctataattgtgccactgtactccagtctgggtgacagagccagacccaatctctaaaaaaaccgtcaaaactatgcagtggggtatgtcaccttcatcccctgggagaatcagcgccctgcccaggtctttgcccttgggtgggacagaagctcacgtgttcccaatcctcttcctcccttccctgccggctgaccccagcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggtgaggcggccgtggggccggctgggtcctccctgtggccctggcccttgctcctcttcttgacattagctcatgttatcttggggcagagagggggatagagctggtgggccaggtggccgatctcgagcgatcaccctgctctcctctaagctccgataaagtctccaaagcctctacactgttttccaagcagagcttatagaaaagagtagggccaggcacagtggctcatgcctgtaatcccagcactttgggaggctgaggcaggaggattgagcccaggagttcaagaccagcctgggcaacatagtgagacccctatctctaaaaaaaaaaaaaaaaaaaaaaaaattaggctgggtgcagtggctcacacctgtaatcccagcaccttgggaggccgaggcagccggatcacctgaggtcaggggttcaagactatcctggccaaaatggtgaaaccctgtttctactaaaaatacagaaattagctg

SEQ ID NO: 125724 - DNA, 1158 bp, Homo sapiens
tgcaatggcacgatcttggctcactgcaacctccaccttccaggtccaagtgattctcctgcctcagctgcccgagtacctgggattacaggcacttaccaccacgactggctaatttttgtatttttagtagagatggggtttcaccatgttggccaggctggtctcaaactcctgacctcaaatgatccgcccacctcggccttctgaagtgctgggattacaggcgtgagccactgtgctctgcactccccccacaacaactttaaaaagtactctaggaaaggtcaagtcctcaggaccatcccagccccaaatcctggcccctcttgggctttggttgaattgtgtctactgtggcccctcgtggcacagatgccatctagtagcccatgtcccccaccagttggtcagcccctggacacttggcaaattgctagagtgtgggagctggaggagccagggctgagtgcagtggttctgtgcccgcctcacccccaggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggtatgtggggtaggggtggcctaggggcaggggcactagtccgggtggggctgggctagccttgctgtcaggccatggagactggagacctcctggaatgaccccagggacagctgagtcatggtgaggatttgaaatcttctaggaccacaggcaggtggagggaccctggctagccgcttttgcagacatcatggctgcctatgtggcagtctgtgtgatacggtgcaaaggaaaacttcctatctgacctgtccagaggcaggatgagccaatacaggtaaagagctccctgttcagaggagtaatcaaccacaagccagttccttgctcagggtcctgcagtggggcttcacacatcagtctcaggaaggagacaagaacttgaaagtctacagcaagcctgggattctgggtggctgagttttttttgttttttttttttttttttgagacagagtctcgctctgttgcccaggctggagtgcagtggcgcg

SEQ ID NO: 125725 - DNA, 1825 bp, Homo sapiens
gggaccacaaagggttcagaggagtaagttggggatactcggtctgtgggtggtctctgagttcctgcagatgggtggagaggacagaggaggggccacagggtgctgaacacccacccgccccatcctaagtaccctgggcatgatgggcttgacacctctcctgggctcctcacccctggccagcagccagggagtgagaccctgcctcgcctggcgtgggcccagggaagggggccgctgtgccgctgagagttcgttccaccctcctggcagtgctggagggggctggagctctggcgtctggcctagtgaccctacctcccaggaccaaggtcctgcggtgggagtctcctgtgtccccatcccagctgaagcgagggtgctgggacataggggtctcgctgcagggcctgtgaggggagcactgactcttggatggagaatgtgccaaggggtaccccgggatggccctgggcctggcgggtgggagtggagggcaggcccccgcagtttttggagaagtgggcatttgctggggtttctcttagaagaggagaggggtgtctagaagccaccctggcgcgccgctgccatggtcggcctctgtgtgtctggctgccccgtggccaggactgttgactccttggcactggcccggggccttgggacttggaaggtgccccaagcagctcatttatttcagcagtgtcattccagaggggaagggcaccagcatcgattatttattctaagcaggaggaggtggctggaggctggtggctgctggcagggaggggctaggtataaggtagttaggtggccgtcatgaaccgccctatttggggcccaggagggtgtgagatagactctgacctcttctgagcaggcatctgcggaccaagggacaggcttggccccaaggtgacagggtatcggaacccccatcctgcctctggggtgtgggaggctcaagtccacacctcgttcttccacagcctgttctgagggtgacctagaaattggcagttctaactcagagggtcccacaggaccccacagaggaaactaggaaggaagggttgaaactccgcagccactcagagcctgcactcttaaaatgttcgagaacttaaggccgatggttgtaaaactgggtcttgaagacagctttgtagggggcacgctaaacctacttaaaaggactgttctctcgatgttgggagaagggtcatttatttgcagtatgctaatcacaaataatttttatctgttcattgaaggcagcctcccaggagcccggctagccttctgatgaggtggtagtcgtcagcacttggtgtttggcaatagtctgagtggcagctgtaatctagggtcttggaggtagctgtttttgcagcctgcttgactccagaggccaggccatccacggtttggtgacagcttggttgttggacctggggtcttgtggatggtgggtgatggcttgggacattcacgtcctaagcatgaccttggaaccatagactgcagctcccagatgattctcattcagggtctagtctctgaccactcactgcttcctcagccgactcataaatcctgtagtctggccgggcgcagtggctcacgcctgtaatcccagcactttgggaggccgaggtgggtggatcacgaggtcaggagttcaagaccagcctggccaacatggtgaaaccccatctctactaaaaatacaaaaaattagccaggcgtggtggcaggcatctgtaatcccagctgctcgggaggctgaggcaggagaatcgcttgaacccgggag

SEQ ID NO: 125726 - DNA, 1052 bp, Homo sapiens
ctgcctggctagggtagggggtcaggattatagaatttgcctcttttcctctccttcaggacttggcttggctgtggtatctttgggctgaagacttcctcgtcctcagggctggccatggttccacctttatatccccatgatgtcctctcttttttttctttttttctttttttgagacagtcttgctctgtgcccaggctggggtgcagtagtgtgatcacagctcactgcagcctcgaactcctggactcaagccaccctcccaccccagcctcacaagtagctgggaccgcagacaagggccactacacctggttaattttttattgtttgtagagatggggtcttgctatgttgcccaggctggtttcgaactcctgggcatgaggagtcctcccaccttggcctctcaaagtgctgggatgacaggagtgaaccaccgcgcctagccaacatcctttccttcctttgtcccaacattgatcttactcagatgtttacatctctctccccaattgcactagggacaggaagggatggaggcttgctcctcaaatacttgttaaatggctacatgtttgaatgaatgaatgaatgaaatcctgctcttgagccttgacctaaatggctaagcagactctctcctatttttcttaaatgctcatctctggggcaagttccccaccctggtaggagtcccagggtctctccctgaacttcctggggccccctctctccccactaccccagcctgtgtcttctcccaaccttaaccctgggggctttgctccccaatgtcatcctctctgtatctctcagttctctgactctcgccgtttgtaagtatctctctctcagatgcgtggcagccagggtcacagccaggttctttgggacaagccaggggtgtatgcccagctccatggggcctgcagaggcttcaggggacacccatggaagaagacctgcagggccaatttataaacagaggagcagagcaggacccagggcttggaatccatgctgagttacgtttttgtttttttttt

SEQ ID NO: 125727 - DNA, 1055 bp, Homo sapiens
tggaatcctacagtccacagcctctgaatctggcttcacacagcataatgcatttacggcattgctgggtacacgggtagctggtcccttctggtccctgagtagtgttccatggtgtggatatgccacatacctctagccactctcctctctagggaaatctagcaaaccggcttggccggccctgcatcagctcgggaccccccagaagaaggtggttcctctttctcattttcacaaaggcaccatctggctggcggggggcctgtggcctgcaccccatcactacccaccccccacatcaagagctgaccccaagccgggggagctgctcatctccgccctcagagctggaatttcatcttctgtttctggtgactcatactgtgagccccgcgatgaaattacacctgcctgccgctgccctccgggcctctggccccatgcgatcctcccgccgccatccaggtgggctctggagtaattgaggctatggggccaggacagctggaggttgagggcggtgccagggaggggagctgtctgtgccctggggtgtcttgcccatcatcttatgtatccccaccctgtgggagtctggggttcctggtggtgcgtctctggtcttcactcctgcagctgttttgcttggggtagaagtttcatgtttgcctgaaataagagcaggacttctgagggtagggaaggaaggtggtgaagccactgttgcaggcaggagcaggagttaggatcaaacggaacagggctggccgagtgatgtcacatctctgggctttggtttgttcatctgttcttattattattttgagacagggtctcgttctgtcacccaggctggagtgcagtggtgcaatcatagcttgctgcagtcttgaactcctaggctcaagtgattctcccacttcagcctcctaagtagctgggcttggaggcacttgccactacacccagctaatttttttattttgtagagatgggggtctcgccatgtcgcccaggctggtcttgaactcctgtgttcaagtgatcccaca

SEQ ID NO: 125728 - DNA, 1005 bp, Homo sapiens
gtacacatagagatgagtgtggatgtagtgtcaggtgatgaccagtggatgacagacacagcaggggagggaatgagggatggaggaggctgtgttaggctgccaaagtgctatttgagcaaacacctgaaaggagggagggagggagggagggaaggaaagatgggtggatggatggatggatggatggatggatggatggatggatggatggatgaatggatggatgggcagatggatatacagccgggtgggtgggtgggtggatggatggatggatggatggatggatggatggatggatgaaaggatggatggatgaatgggcagatggatggatggatggatggatggatggatggatggatggatggatggatggacggacaaccgggtggatgggtggatggatggatggatggatggatggatggatggatggatggatagacggatggatggatggatggatagacggactgatggatggatgtttatggatttctaggagaaagggatctgagcagacagaagagcaggtacaaaggcattgaaccgagtgtatgctcctggcctgtaggggaagcaccaagggggcggcaggggtagggggagcacacagaggcatgaagggggcagatgaggccagaggtgatgaagtcacatacgtaggactttggctgtcaccaaatgagatgggagccactggacattttttatttttattttttgagacagggtctcactctgttgcccaggctggagtgcagtggcatgatcttggctcactgcagcttcgaactcctaggctcaagtgattctcccacctcagcctcccgagtagctgggaccacaggcgtgcaccaccacacctagctttttgtattttactttctgcagagatggggtcttgctgtgttgtccaggctggtcttgaactcctgggctcaagccatctgtccacctcagcctcccggagtgctggaattacaggcatgagtcacc

SEQ ID NO: 125729 - DNA, 1969 bp, Homo sapiens
gagggtgggtctgtttcatctctgtagtatcctggaatggaatgagtgagtgtcagaggagagaattgtcacttccccaaacccagcctggcaggaggaaccatgaagtcttaacacagttccgctgccacctggtggcagcctgctcaatttgcaggcttagtgggtacccactagttctatcacatgctacactcagtcacatacctagaaagacccatggtcactcctagtccacagaaccttccaaatcttcattcaggctggcggtgccctagatttgatttcgcaaacaagaatgtgagcccaggaattgtggacctgtctgcgtgtgccatttctgaggaaataagttacccaccgccccagccccagccttcccccattccaagatcccaccacagggccaatgttggtaccagcagagcaggaacatcagccgagaagctgccaccaaccagcctcaacagactgccttttgccttccagacagccacggtgacgtgatccggcccctgcggaagcaggtggagctgctcttcaacacacgatacggtgagcaagaagtgggacagggtctgggggcatcccggcccccctccagccgccctgtttgcagaagggctttggtcgcatccccttgcctgttcccatcccagctgttctctgggcagggacaagggagagagggaagggaggagctgggacccatcatgaggatggggacactagagaggctgtcactcaggctccctggctcactcactcacactctgcctcagtcgcaggttggagaggccactccctcccctgtaatgtcgccagccctcagccctccgccctcaccctcatccctccgccctcaccctcatccagggtcctcaagaagactcataataagaataagataagataacctcagtggtgtgccgggcatgaggctaggtgattccccatgtttttctttttttttttttttttttttgaggcggagtctcactctgttgcccaggctggggtgtggtggcgcaatatcagctcactgcaacctgcgcttcctgggttcaagaaattctcctgcctcaccctcccgagtagctgggattacaggcacctgccaccatacccggctaatttttgtagttttaatagagacagggcttcaccatgttggccaggctggtcttgaactcctgaccttaagcgatctacccaccttggcctcccaaagtgcagggattataggcttgagccactgcacccggccccctgtgttcttgtatcccatctcacaaaatccccgtgtcctaagacccactttacagatgaggagaactgaggcctggtaaaggggtgtgactcgtccaaggccccacaccactcagtggcagagatcgggttcgttccaaggcgtggtgttgtgccacagcagcgtgtggggttgcttatggtggcaggagggacactcggggggccttactggaagggcgaggcccagtggactcggggaagcaatgccgaatctcagcagccattagtggtggcttctgtactgcctgggcatgagggcatggacccagcgtgggccttggggtaaccctgggttgagttcctatcccctggctctgctgttcagtggctctgtgacctcagacaagtcacgtcccctctgaactccaggttcctttcctgcaggctggggggccactctttccacatcccaggaaagctggcaggccctcaaaagggctctggcagctttgccccccgacacaggcacgggacacaggggttgaggctcctggccctgtggcaccgggtggccctacagcagccatgtctctgcagccaaggccattggcatctcggagcccgtcaaggtgccgtactccaagtttctgatgcacccggaggagctgtttgtggtgggactgcctgaaggcatctccctccgcaggcccaactgctt

SEQ ID NO: 125730 - DNA, 1035 bp, Homo sapiens
gaggatacggtgttagcaaaggcaggcaggccagcaagagcaggaggccggggagagtgggccctcgggcttgctttgggaaggaggctggacatgtgggctctggacaggtgggccctgacccccaggggatcaggagcctgaaatcctgaaagggggactcgaaaccttaagacagagcacttttccagggagctcaggaggctgagacagaaaagcctcagcttccagtgtcaacagccttttcccctccttccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtggtaaagttgcaccgatttggactccggcactcatctctgtggccctcacccctctgtctggcagggccgtctactctgggatgtgggcccaggggacggggaggcactgggctttgagtggggaccttccggcctcgggggttatagatgcatccacctgtctcacccaagaggtagcccatccttctcgtggggtactcacaggcactcaggcaggaattcacatcctcgctgggcagatgggccggctgaggtccacctgcccacacccttcagccgcaccagagctggagacatgaaaagacatggctggcgggtgcagtggctcacgcctgtaatcccagcactttggcaggtcaagtcgggtggatcacctgaggtcaggagtttgagaccaggctgaccaacacggggaaaccccatctctactaaaaatacaaaattagccgggcaaagtggggcatagtggctcatgcctgtaatcccagctacttggaaggctgagataggagaatcgcttgaacctgggaggcagaggttgcaatgagccgaggtcgcgccattgcactgcagcctgggcaacaagagtgaaacactgtctcagaaaaaaaaattagccaggcatggtggcacgtgcct

SEQ ID NO: 125731 - DNA, 1085 bp, Homo sapiens
tcccaggaagcaccgcgccggctagccccgaacccgaggacgaggcaagcgcggcgcccggccctctccagcaagggctgtcaatggaggcgagggtggtgggagcgagaacatggctgcacctggggcctgcgcggccgcccgggtgggggaggggagccggggtgcagaaacggaaatctggacgggtggtggctccggcgtcgtccccaccgagcgccagccgccgtccaagtccgccacttgctcttgcaccccacattccttgcaaattgcgaggcagggaagctgcaaaagccggggagccccgggctgggccgtcgccctccttgctctgcaaaaggggagtccttccgccttgcaccaccctccaggacacaaagaactcctctctagtgttttccaagctggcctccaaagagaccgttgcccccaagttcggacaggcgagaggggaggagaccttgtgttttaattcctcccccagaccctccgcctctatctctccctcaggatttggaaggaaacttgcaagggagtgggagcagaaatcctgactcgtagctcctgttttgttctgtcaaccgcgatgcgatttaactcaaactcctccccctaccactattttttgcttctcaacttgaattagccggtgggttttgaaaatggagagacattactgttcacctaagttaaactccaaaactttacaaccccgaggccgacgatttttagatgtttatgtaaagcacgagattgagtggttttttgattcccgcccgcccccccacccagtaccacccactggggattcgggccacgacggccatcctccccccacccgccgcttctcggtaggtggcgaccacgacgctttttccagcctccaagcctttgtcgctagcgagaaaactttccgagcagccagtcttttgatgtgggttccaaaaacctttcctttcaatctgggttctccgattggcattccccatcgtctctcttgcacagaccgcacccaataaagcctcctctagaattttcatgttggattttttttgaaaaatacatggagagcgtaaagctca

SEQ ID NO: 125732 - DNA, 1053 bp, Homo sapiens
ccttctgaaaaacagattttagttttggcttttagtacttaataattatagggagaacatggaaatattaaataccaacaatttggctgggcatgatggctcatgcctgtaatcccagcactttaggaggctgaggcgggcaaatcacttgaggtcaggagttcaagaccagcctggccaacatggggaaaccctgtctctactaaaaatacaaaaaaagctagctgggtgtggtgtcaggtgcctgtaatcccagctactccggagatccagccaggagaattgcttgaacccaagaggtggaggttgcagtgagccgagattacgcccctgcactccagcctgggcgacagagtgagactctgtctccaaaacaaaacaaaaacaaaacaaaaaaccgaaaaaaccccaacagtttcagagatgaaaagatttaggcggcctaaaagattgccaaaatgtagtattacatgataatctaaactagttttaatgcagctgaatcctggtttagactaaagtcagctgattgaactactagtattagatcttttggatttattttaagcactattttaggacaaaatatctaacattttacttgatgaattttaactttttcttaccactcattgttttgaagaaattactttgtaaaagtttgagatgtcactaatttttcccttggcattaagcgatacatgaattcattttattcttctgactgaggatgtttctgttagtgtatacattcaagaatatgatgatgccattagtcatttaattttgttgaaacttggctttagtggctgttaataaaatgaattggttggccaggtgtggcactttgggaggctgaggcgggcagatcacctgaggtcaggagttccaagaccagcctggccaacatgctgaaaccccatctctactaaaaaaaagaaaattagccgggcgtggtgacatacacctgtaatcctagctactcgggaggctgaggcaggagaattgcttgaacccaggaggcggaggttgcagtgagccaagatcacgcca

SEQ ID NO: 125733 - DNA, 1021 bp, Homo sapiens
ccttttgtactgagggcactaattgcccaggtgccatggctgttcgagcaccttgtacaagattccaccctttcccaggggagggccatgccagctcccagctctgggtgcagctacatcagtgttcagtgcttcgtctgtccggccctgcctgccttccgcctcccaagtgctgtaattgacagtgccccccagcaagcctgtgtaaactctcagtctactacttggagaatctgacctataagagattacaagggaattgtgttttttttttccttataaattctgtgttgtcttttgtttaaaatcaggccaaaaactatctcgaaagagaagtacctttaaaaaatgttgttagtttttttaattcatcgagcagaaatgatgctcttaaacgtccgcctgtaacatgatgtttgctgtttgtattgtagtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtaagcattgtatttttatcttttgcatttcattaattttaagcctaaatatttgtaggtaagacaagttatattattttctttctttctttctttctttttttttttttttgagatggagttttgctcatgttgcctaggctggagtgcagtggcacactcttggctcaccacaacccccgctgcgtgagttcaagtgattctcctgcctcagcctcccaagtagctgggattacaggcacgcgccagcacgcctggctaattttgtatttttagtagagacggggtttctccatgttggtcaggctggtctcaaactcccgacctcaggtgatctgcccaccttggcctcccaaagtgcagagggattataggcgtgggccactgcgcctggccaagttatattttcttctaaaacagaatgaggtttaaactaaaaaagattttc

SEQ ID NO: 125734 - DNA, 1066 bp, Homo sapiens
ctagactcaagcagccctcacttcagcccccagacagctaggactgcagacatacaacactatacctggctattttcatttttttgcagagatgtgtccttgttatgttgccaaagctggtcttgaactcctgggctcaagcaatcctcctgcttcagcctcacaaggtggtggaattacaggcgtgagcccttgggcttgtcctcttttttgcttttataacaaatcacaaatgacttgctattttgttacaaaataacaaatcattggttacaatgattaataaatgttaaagaatggttaggaaatagttttttcctgttagaatacatgataaaagtagttttccctgttaggatacaggaaaacgatttttactaaaaaccaaatattaaggtaatggatatggaccttattattatttttttattttattttttattttttttacaggtgttgaagaagaagaaaaagctgcagagatgcataaaatgaaatctacaacccaggcaaatcggatgagtgtagatgctgtagaaattgaaacactcagaaaaacagttgaggactatttctgcttttgctatggtaaaaacaatagatttaatttttctaaaagatacattatataattgaattttctaaagggaagcttatgtaattgattcgaaaatcatataacacacattttcagtgactgaatggattagcaataaccttactttcttccacttccattttgaaggaacccaggaggaagtgtggccagtagagctgtttctttctttctgttttttttttttgagatggagtctcgctctgtcgcccaggctggagtgcagtggcacgatctcagctcactgcaatctccgcctcccggtttcaagtgattctcctgcctcagccccctgagtaactaggattacaggtgtccgccaccatgcccggctaatttttgtgttaaattttagtagagatggggtttcaccacattcgccaggctggtctcgaactcctgatctcaggtgatccacccaccttggcctcccaaagtgctgggattaca

SEQ ID NO: 125735 - DNA, 1022 bp, Homo sapiens
cccaaaagatagatagaaattgaagtactaagttcagttgataactctttttttttgtggagacagagtctccctctgtggctcaggctggagttcagtggcatgatctcagctcactgcaacctccgcctcccggattcaagtgattcaggtgagcgccaccacgcctggctaatttttgtatttttagtagagatgaggtttcaccatattggccaggctggtcttgaactcctgacctcgtgatctgcccgcctcggcctcccaatgtgttgggattacaggcgtgagccactgtgcccggcccaataactcttatttatgcaataaataaatatgtcagttttaagctgagtcaggtttgcacccaccttggtcaagggagggatcttaacactttgagacccagagactttgaatgctgtgggaatggctgtcaccagcacgtggcttgatcagggctttcttctccttgcagttgtggccccatcaaagtgaaaactgaacccacagaagattctggtatgtactagcacttttagaatcaatggtgaaattaaggaagacttttccttagtgtagaagtttatagtttgactcaattattgttttgttttgataagaaagaggcagtcactactaatgtattccaactgtgacactatttgttaatgttatcacattaagacccagaaaggtaatttgctcagtaagtggtaggcagagttctttgccagttacatatgtttgtagataaaatgtatttttttttcccgttgtacagacatataatgtaagaggtcagctgttctatagtgctttttacaaaaatcaatagaatgcccccttcgtctccaccttccttctctgcactcctgttttccactctccaaggagaccattttcaattctcaaataaaattgctatttaattccttatttatttatttattttttgagatggagtcttgctttgtcacccagactgaagtgcagtggcacgacctcggctcactgcaacc

SEQ ID NO: 125736 - DNA, 1100 bp, Homo sapiens
gggcaaagctttatgcagaaaggtgtgctttgtacccttacacaaatccctgtaataaaagggatgtattaggcagaaaaaaaccaatgtatctcattattgaaattgttgaccattatgctatctctcctttggaatactgagttattaaaactgatgtttataagtgtgtttcaatggtttataaaagtatttttaatattaagtgaaaagggagtgtggtaaaattttctttgattctaaagataagaatttgctggagaaaagagcagcacataattgcagaatattaataaatggttaaaactttgcattggctgggattatagtgattttttaccttctgctacctagcaaacttttgtcttttcaaagacgtaaagtctttacttaaaataaatatgcattgctgtatttatagggagggcagagaggatttccctacacaatctagctgaaagttctcacatgcaatcatatcattgcatttgcttttctaggcatttccctggaaatggcagctgtgacagtaaaggaagaatcagaagatcctgattattatcaatataacattcaaggtaatttgaattaatgcaatttttctttctaaaaattattcgtggttaaaattaaaatttgctcatcaattgctttaatttcttaaataatattttattgatcagttcttgattgacatatatattgtaattcagtcccggggataaaacatttaaaaatggggctaaaagatcaactcagacaatccagaggggatatgtaaaatagccatttgtgttcttaaaaggatgagcaaaagttgtggcacaatttagaattcaatcccaggttctagtgttgcaaaataaaacaaacctattaggcaaatgcagataatgtcagcttaattttttctcactgcataattatagtatattaaacacttaaagtaaaaaatctggttagctttgccatctacatatctaatacaccatcttcattgcatccaagataatgaaatatctataaccccaaaagtttcctgtgtccccttgttattcattgccctgcccagtattcaggcaacacggatctgttttctg

SEQ ID NO: 125737 - DNA, 1015 bp, Homo sapiens
gtctacattccaagacttgctcttctttgagattccaaatagaaactatttctttatttctcatgcaattgatttttttctctgatgtgtcctttgcctgtaatgtgtagtgtggtgcatctttgtgaaatttcttaggctttagagaatgaagcctttcaaacaacttcggatgttttcccaattctcttcagagatagttaactgaactgtggtcatattaatgccaaaatgtgttttatattaaatagccattgaaaacacaatgttttgttttctattttaaaactattattattttaatcattaaaaagtttgatgataacatgtaaatgtgttgtcaaaatatagcagtttgtgaagttgaatttaactcagagtactttctgtgttttggaaagaaccttattagaaaaagtgcccgctgtgctggaagaaagggagaatgaattaatagctgttagtttgtcacatttctatttcagtagagattcaaggagatggtttacgttattttagagattctaaggaaggtatataacatttggttctgcatttttcttcagtatgacaaaagagtaagcaaatatttgccaaagaagaaacaaataaacctgtgagataaacctgcatttgtaatctgtatgaagtaaaagttacagtttactgttatgaacattgtactgttttaaaaaacccacatcttccattttagacataccattcccattcaatccatatgtccagtcatcttcaaaatttcttttgactgtttacatatgaattcacctgattacatttttccattcaccaagaccataaattgacattgctcatcttgtcagtcttttttttttttaatttttttctttttatttataaaaaggccattccatgtatctcacccaaatttgttgactaaagtcaccccacatttttttttgggggggattacttttgaagtattatctttgtatcccaaagcaggcccttctgaaactgatgatgttgatga

SEQ ID NO: 125738 - DNA, 1042 bp, Homo sapiens
aggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgtt

SEQ ID NO: 125739 - DNA, 1028 bp, Homo sapiens
gtatctcttaggcttgtcagacaccgagtgtcccgagcaaaaacaagtgtttgcacacccaagtccaacccagaaatcccccgtgcagcctgtagaggacctagctgggaacttatgggagaagttacgtgaaaaaatcaggtcttttgtggcatattctatcgcaatcgatgagatcacggatataaataataccacccagttggccatattcatccgtggtgtcgatgagaatttcgatgtgtccgaagaacttctggacacggtgcccatgacgggtacaaaatctggcaacgagatcttttcgcgtgttgagaagagcctgaaaaagttctgtatcgactggtcgaaattagtaagcgtggcctccactggcaccccagcgatggtggatgccaataacgggcttgtcacaaaactgaagtccagggtggcgacgttctgcaagggtgcggaactgaagtccatctgttgtataattcatccggaatcactctgtgctcagaagttgaagatggaccacgtcatggacgtggtagtgaagtccgtgaactggatatgctcccggggactgaaccacagtgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacgctttgaacatctctctccaaggacactcccaaatcgtcacgcagatgtatgacctgatccgggcgttcctagcaaaactgtgcctctgggagactcatttgacgaggaataatctggcccactttcccaccctgaaattggcttccagaaatgaaagcgatggcctgaactacattcccaaaatcgcggaactcaagaccgaattccagaaaaggctgt

SEQ ID NO: 125740 - DNA, 1037 bp, Homo sapiens
aatgctcaataaatgctagttgctgtcttaataatatgtgttcttgggccaggcacggtggctgacgcatatagtcccagcaccttgggaagccaaggcggacagatcacttgaggccgggaatttgagatcacctgggccaacatagtgaaattctgtctctactaaaaatacagaagttagccagacgtggtgtgcacacctgtagtcccagctacttgggaggcttgaacctgggagatggagattgcagtgagccgagattgcgccactgcactccagcctgggcaacagagtgagactgtctcaaaaacaaaaacaaaacccccgtaaatagtatgtgttcttggatttgataaataacctgtcatttactactgaacaaacttgacattataaatcagttcatgctttgtgggaactgcttttcagatttcatctgctgcttgcggctatggattcacactgctgtcctctaagactgcggatgttacgaaagtctgggggatgggactcaacaaagattctcagcttggatttcacaggagccggaaagataaaagtgagcatccctaccttgtctcctctttgccgggattggtctgagaaagctctttttttgtattttttttgagacagagtctcagtctgttgccaggctagagtgcagtggcgagatcctggctcactgcaacctccacctcccgggttcaagtgattctcctgcctcagcctcccgagtagctgggattacaggcacatgccaccatgcctgcctaatttttgcatttttagtagagttggggtttcactatgttcaccaggctggtctcgaactcctgagctcaggtgatccaccctcctcagcctcccaaagtgctgtgattacaggcatgaggcacagcgcccagccctccctttggtgttcaagaacatggttacataaacaaagaaatagcaaagaaatagaggaagacttaaagggatgttgtttgaaaccatctgggctaggttattttttagcctctttggtaaca

SEQ ID NO: 125741 - DNA, 1055 bp, Homo sapiens
tcttaactctgatttttttttaacagctttgttgaggtataattgacataactgtacttgtttaaagcatgtgacattttgacacgcatacacctgtggaaccatcccaccactaagataatgaacatccatgacctccaaaagttcccacatgcctgtaatccctctctttagttccacccgtgtccccaggcatccactgatctgtcttctgtcactgtagataggtatgcattttccagaatattctataaatcatacatttaagttttaaatatttggcttttcttactgactttgtcagatagatttggccagattgttagcagtaaaaattaaaagcattattctcttcccttcatgttattaagaaagatgtcatgaccgtggatgaaatcgtaaaagaatgttgccttcaataaagcatctaactgtcttctcttttattaggcctgggtctctgaagagaggcctcaattctcagagctcagatgaccacttgaataagagatcccgaagctcttccatgagctccttgacaggcgcttacacaagtggcatccctagctccagccgcaatgccattaccagttcctacagctccactcgaggcatctcacaggtacaagtacagctcttgtaatgtggggggcatgaattcccagcgttcattcattgattagggccagacatggtagcttagccatgtaatcccagcactttggaaggccaaagcgggaggattgcttgagcccaggagttcaaaaccagcctgggcaatatagtgagaccttgtctgtacaaaagaatctttaaagaaatttttttaaataaagtaattggttagcaaaagtttactaatcaccttctatctgttggacattaggattgtctctaactaatagaaaatacagatcattgagtgatcaatataggccagcagaacggagtagaaagcccggaatgtaaagcagtgcatgtgtgcgagctgattcgagacagagctgtgatgtagataaacggacagagggtgattcgaaaggtagactgagtcc

SEQ ID NO: 125742 - DNA, 1022 bp, Homo sapiens
tgctctcatgggactcttgagggaaacaccattttataaggctgggtatggtggtgcatgcctgtactcctaacactttgacaggccaaggtgggaggatcgctggaacccaggagctcaagaccagcctgggcaacatagggagccctcgcctgtacaaaaaattaagaaattagccaggtgtggtggtgcatacttgtagtcccagctgcgctggaggctgaggcaggagaattggttgaacccgggaggcagaggtttgttgcagtgagccaagattgtgctattgcactccagcctgggcaacaagagtgaaactctgtctgaaaaaaaaaaatttacctttcagaaacttagggattttaaacaaccattttctggtctagcatggaatctgtgctccatagagatagtataaggtcccagaaatgtgagaatacactttaaagggacaaacaaagtcatgtcatttcatttgagacttttttgatttgtcgcaggcgccatgatagcagtggcagtggacattcagcatttgagcccctggtggccagtggagtccccgcttcttttgtgcctaagtaagtgcgagtccatccagatgaaataccaactgtttggaaaaaggcctgatcagagctgttgccctatagattttcctctttgttttttgcattgcttaattagttcaggttcatgtctttgaaattaggaatattctgagtaacttgtcacaattaactgccttctgtctaattccttttaatgttcttgcattaatatggatgaaatatgctgagactagaggttttataaatatatttaataaccaagcacatacacagaaggattgcaaagtttgtgcagcggataagacagtatgaaacttaaatgtttaatttctacatgtcagtttaaaaacaaattggaggaagaattgggtggaaaggaaagtggctcaaaagtctgtgtggaaagacttaggataacttagatacctcatctgagtcagcagtgtgatg

SEQ ID NO: 125743 - DNA, 2469 bp, Homo sapiens
tcgctgggagccatgcaggaaaccgcaagagtcagaaacaggcgttgaaggcaggcagcattttccaaaacagctgtgtctcgggagctgccgggctgtagcgtctccccgagtcgcgcgcgcatgacgtggcgggcgcgcgatgacgcgacgcgtggcgcggtgcacgctgggatatttaagtctcctccgcggcgcggagccgcgatgtctccggcggctgcggcggctggagcaggcgagcggcggcggccgatagcgagtgtcagggacggccggggccggggctgcggcgggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggccgccgcccacccgcccgcccggcgccgcgctccacaccgccctccccgccgacccatcgcgttcaccacttttacccctctctccccactcctcttctccgaccctccgggaggccttccccacggtgagatgcgctgattttcccagatcatcctctggctcggctggcttgaaatcgaggacttgacttttaaatccgatttgcattttcatcaaatccgaagggaattgtgtgtggttttgccctccttaacaccttggtgtgtgccagccgtctcctggcctctgactcttggtgtgagatgtgttgccaaaacgattcccttctttccagttctaaaaactccccgaattttagtgcagtctagatttagtctagatttagattttccctctcaaattgttgcaatccattgttgaggcagctgttaagcagctgtcactctctgctcttagatggaataggggaaagttgccataaaaacaacgtgttctgtgttgcgtagaaagagatttaagttctttggaaaatgtcttaactggtgggtttttaaccgtctaaaattttgacattcttttatactttgtttccatgatttgtctcgcattctctgcagggatcgtgggactttaccagatcggtttgtaataacacctcgaagacgctatccgatccatcagacccagtattcctgtccgggggtacttcccacagtgtgctggaatggttatcacaagaaggctgtgctgtcccctcgcaactccaggatggtgtgtagcccagtgactgtgaggatcgcccctcctgacagaagattttcacgttctgcgatgtgagtattatcgttggaagaatactctcccttttcgtgtccactttattcttctccagttgttcctgtgacaacatgactacaacgcaaaaaagaaaggacgaatctgcttgtttgaatgagaaataccaaattctagtaaaaccgtttgtttttcactttttgccgttaacgaaaaagtagctttacttgctaaggggaactgttgtgagtgtataaattatactttggcctgttggttagcttctgatttccgtttctgatatggcatgggaattaaaatatcttacggctagaatcttgtctttcattatagaccagagcagataatcagctcaacactgtcgtcaccatcaagtaatgccccagacccatgtgcaaaggagactgtactgagtgccctcaaagagaagaagaagaaaaggacagtggaggaagaagaccaaatattccttgatggccaggaaaataaaagaaggtaacaggctcaggagagtactaagccagtttcccgcttggacccctatgggatgagatgtagacattcccgtaaagatacagaggccacgtccagtttgtgagccttcataggcctccttctttggctttcatgagagaacctaataacaagggttttaatgctgttcatttcaaggcacaggttagatcgatgtcataatttaccttttctgtgagtagcagagataagctgacagctattagccatgttagcctcatgcttctgtagaaacgtgttaaaagtttattttcaagaaagaaggctctaagtcttccggtcggaattttgtggtgttcagttatttgggtaaccaccagttctagtgtcttttttttttttttttgagttggagtctgtctctgtcccccaggctggagtgcagtggcccgatctcagctcactgcaagctcagcctcccaggttcatgccattctcctgcctcagccccccgagtagct

SEQ ID NO: 125744 - DNA, 1054 bp, Homo sapiens
tgaggcaggagaatcacttgaacccgggggacagaggttgtagtgagccaagatcgcaccactgcactccagcctgggtcacagagtgagactccatctcaaaaaaaaaaaagagagagagagagaaagaaatagaagagaagagccatcttggcagggttattttatatctgagcaaggagtttaaatgagactagtttagattgtctgctgatgcagccgtccatagcagtacccctaaaatcccaccagaatacgggtccctctaacccagtggctggaagaaccactgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcagctggaagttccctcttagctccttagtctagaggggtctcctggctccatttgaccctggtctttaataaccggtcagcatcttgctaccttctaccacctttccaaatctctggaaatcctgccagggaaagcctccagttccaacattggctttccaagcaaactggctttgccctctctctgccatccttgtcctccagagactgcaccacctgtagcatagaaaaccaccaccacggacctgccagccattggcgcagcaaaccagccagctgtttgctgccaaattccttcctctcccaggtccagaccaaatacaagatcagcaccacaccgtggtgttgtcaggagccaaagcaacaggaaacaattcaatgctgttgggttcgattctgagagtagatttttccagacatgtctttcaggtgaccctcaactacctcaggtttgaaggccctaaatgaaactgattaccactcatagggacaaaccgagggggttcggttacatcttggtgataatgcagttgtctcaaacttataacagactctttcacatttcagtttgcagggatagggttgggtttgtttttcttctgttttt

SEQ ID NO: 125745 - DNA, 1019 bp, Homo sapiens
tgcagacgtctgccttggcatcctcttgaataggaagatcgttccaccttctacgcaattgacaaacccggaagatcagatgcaattgctcccatcagggaagaaccctatacttggtttgctacccttagtatttattactaacctcccttaagcagcaacagcctacaaagagatgcttggagcaatcagaacttcaggtgtgactctagcaaggctcatctttctgcccggctacatcagccttcaagaatcagaagaaaggccaaggtgctggactgttactgacttggatcccaaagcaaggagatcatttggagctcttgggtcagagaaaatgagaaaggacagagccagcggctccaactcctttcagccacatgccccaggctctcgctgccctgtggacaggatgaggacagagggcacatgaacagcttgccagggatgggcagcccaacagcacttttcctcttctagatggaccccagcatttaagtgaccttctgatcttggaaaaacagcgtcttccttctttatctatagcaactcattggtggtagccatcaagcacttcccaggatctgctccaacagaatattgctaggttttgctacatgacgggttgtgagacttctgtttgatcactgtgaaccaacccccatctccctagcccacccccctccccaactccctctctgtgcattttctaagtgggacattcaaaaaactctctcccaggacctcggatgaccatactcagacgtgtgacctccatactgggctaaggaagtatcagcactagaaattgggcagtcttaatgttgaatgctgctttctgcttagtatttttttgattcaaggctcagaaggaatggtgcgtggcttccctgtcccagttgtggcaactaaaccaatcggtgtgttcttgatgcgggtcaacatttccaaaagtggctagtcctcacttctagatctcagccattctaactcatatgttcccaattaccaaggggtgg

SEQ ID NO: 125746 - DNA, 1031 bp, Homo sapiens
gcctccacctccctgggctcaggtgatcctccccacttagccccccgagtaactgggactacaggcacacacccctacacctggctagtttttgtattttctttggtagagacggggtttcactatgttgcccaggctggtctcgaactccagggctcaagtgatcctcccacctcagcctcctaaagtgctgggattacagacatgagccttcatgcccggcctcctttcttgccccacccctggctttggcgttgctgtcatccaccatccttggcctggccaagtcagcccccactgcaatcagtgtgtccccgggagggaatcagagtggcaggttaaagagccatcaccttcccagtccttgcaacccggtggtgggttggacctctgggaagtagggactgtttaactcaaccagcgtctccctctttccttgtggtcacctttgcagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggcaagtcacggacatggacacgagcgagcacctgtgaattcccaccgagggcctctgcgcatgcacggaggctgggaggaccccggggctgctgagaaggggtttggggccttggcctgattgtgcagacattctgtaggtgtaatgccagcaggccctgcattgcctgcagagtccatgagggaaagcaaactgctgtcttttttgtatgagaagagaagtttggcatctcctcccagccatgagaagcgggcgcagtgatccatccccacagcctctgtgggcagccgcacatcgtgggcagccgcacatcctgtgcacacagttaaagcgcctttctctgtctcaggcttactggcttggacctcattggccatgacttgagctaagatgctaagagccccagccaggtcatcctgctcaggttcattat

SEQ ID NO: 125747 - DNA, 1754 bp, Homo sapiens
atgggaggatcacttgagcctgggaggccaaggctacagtgagctgttatcatgccactgcactccagcctaggcaagagaacaagaaccaggccctaaaaatataaatacataaaattaaaataaaaaaattatccaggtatggtggcacacacctatacttccagctactcaggaggctgaaacaggaggatcacttgagccaggagttggaggctgcagtgagctatgattgcaccactgtactctagcctgggcagtagagcgagaacctgtctcaaaaaaattaaaaaaattaaacaggtctgaaccgtttaattcgagaaagggggcattctcccatatcactcaactgacccacacacagaattctctggctctctgacttattctcactcctttttggtcaaccacagaatttatttgacaacaagtttgatgacatctttggcagttcattcagcagtgatcccttcaatttcaacagtcaaaatggtgtgaacaaggatgagaagtgagtccaagctgggttcaagcagatggttcaggagctaagttaagccatggtctgcctcaaaacactaaccaaagaggaattcttaatgatactggggcttcttagatacagaacatcttgaagggttgggggcaatggcttatgcctgtaatcccaacatgtggggaggatgaggtaggaggattttttaaggccaggagtttaagaccaagcttgggcaacatagcaagatcccatctttattaaataaaagtaaaaaaattagctgggcaggtggtacacacctgtagtcccagtaactcaggaggctgaagtgggaagatcatttgagcctgggatatcaaggctgcagtgagctatgatcgtgccactacacttcagcctgggcgacaaagccagactgtctctaaaacaaaaccgaaaacacacacaaaaaaggaatgtcttgaccctcaaatattggcccctttaatctcagaagaaaatcaataaccatggatttatgagtattagattagtatctggtaacatttagagtataatttatggcatttcaaagaattgtccccaaattaataccagcttttaatttcctcccctgagctcacaattaaaaacagagggatagaagcactatgaaagcaaactcattccccttctcttcccagggaccacttaattgagcgactatacagagagatcagtggattgaaggcacagctagaaaacatgaagactgaggtataacttggatctgctctgcctttgcgcttcaccaaaacacggtagatttgaatgttaaatttgcatcacactagccaggcacagtggctcacacctgtaatcctagcactttgggaggccaaggcaggaggattacctgaggtcgggagttcgagaccagcctgggcaacagggtgaaacccccgtcttcaataaaaatgcaataattagccgggtgtgttggcaggcacctgtaatcccagctactcgggaagctgaggcatgagaattgcttgaacttgggaggcagaggttgcagtgaactgagatcgtgtcactgcactccagcctgggcgatagaacaagactctgtctcaaaaaaaaaaaaaaaaattgcatcacctagacagtttttggaccacatccttagggtaggttaattagtagaaacaagccaggcgtggtggtgtgcacctgtgatcccagctactcaggaggctgaggtaggaggatc

SEQ ID NO: 125748 - DNA, 1074 bp, Homo sapiens
atatataagtctggattctcttaggtttcttggtcttcagtgtttagattcaaaatagagatttgagaatgagaaaaagatgttgattttgccagatgtggtggctcatgcctgtaatcccagcactttgggaggccaaggcagtaggattgcttgaagccaggagtttgagaccagcctgggcaacacagcaagagcctgtttctaccaaaaaattaaaaattagccaggcatggtggtgcatccctgtaattctagctactcaggaggctgaggcagaagactgcttgagcccaggaattcaaggctgcaatgagctctgattgcaccactgcactctagcctgggtgacagagcaagaccctgcctctacaaaaagagagagagagagaaaaaaaatattggtttcttcatgtgcatatccacccaagattaggacatagtaccaaacgattgtaattctccaagtgtttattgaacggctgccctgtccctggcattatgggaaacagctcagcggagctcagtccccacttcccaggaacttatagtcttaattgtggagagaacaaatagtccaaaaacaaagagaagtaatgaaagaagagagctacctttgtagtaaaattcccttcccttttcctatggttagatggcttatcctcagagaaagtcaatttcttttaatgttactctaaaccaaacactcctcggaagttaaatctgcaaaataacaacatgtgttctacagcaatgaagaaattagctttttgattatctactcttccaaaggatttgtagcatgaattactctttcctcaccagcaggtcactgaggaccagctttaaataatcctctgcagcatcataattgaatcccagcaccatggagtttatctccttgacagcctgtgcctttgggctggggagggggcaggaaagccaggtggctgctctgtcccctacatggggctgatgaagacacccagcacccctcaggtccttctccacccctaggttgaaagatctgttctaccgctccagcaacctgcagtacttcaagcggctcattca

SEQ ID NO: 125749 - DNA, 1102 bp, Homo sapiens
tggctaggctggtttcgaactcctaacctcaggtgatccaatgcctcagcctctcaaattgctaggattacaggcatgagccaccacacctggcccaattagtacagttttcatttcttgaagttctatttatttattttttttcaaatctgcttgttttttgcgggggaaggtggttgttgttgctgtttgagacagggtctcactctgtcacccaggctggagtgcagtggcgcgatcatggcttattgcagcctcaacctcctgagctcaggtgattcttccacctcagccttccaagtagctgggaaaacaggtgtgcaccaccaaacccagctaatttttgtagacgcaggttttcgccatgttgccaagggtggtctcgaactcctgggcttaagcgatctgccacctcagcctcccaaagcactgggattacaggcaggaggagccactgtgtctggccctgcttctcctcctttacaatttattatgccctgcatatattttgaaacagtctcttatttctttagatatatgaaccaaagtcatctcatatatgttttgtaattctattatctaaagtctttagagatttgtttctgtcctccgtcccttttggtgcattttgcccatgctgtgtagttttctttatgttcggttactttctaccctaagctgctcatcttccttggaattttatctgtggagaattctttgaagtctgtaatgaaggcaggttcctccagagagaattggcatttgcttcgattgagatcactcgaaattaaattctcagcttaaggttttgtgagtttagggcagattttccttccccaatcacagcggtgatttgaggcggtagaattcttcatagtccttagggaggacttcctcagtgcaggagtacaagcgtttgttactttattatttatctttacttcccctataccaaggaggcagtcttttgtgtgtgtgttggtggtggtggtggtgttttgagacagtttcttgctctgtcaccaaggctggaggaatggtgacatgatcacagctcactgcagcctcaacttcctgggctcaagtgatcctcccacttcag

SEQ ID NO: 125750 - DNA, 1043 bp, Homo sapiens
tggctaatttttgtattttcagtagagactggtttcaccatgttggccaggctggtctcgaacttctgacctcaagtgacccacccaccttggcctcccaaagtgatgggattacaggcatgagccattgtgcctggccttttttttttttttttttaaagacatggtcttgctctgttgcccaggctggtgtacagtggcgcaatattggctcactgcaacttctgcctcctgagctcaggtgatcctcccacctcagcctcccaagtagctggaactataagcatgcaccaccacgcctggataatttcttgtatttttgtagagacagggtttcaccatgttgcccccagctggtcttgaactcctgggctcaaacaatccacccaccttggcctcccaaagcgctgggattacaggcatgagccaccgcaccctcactgtatttctagagtagtgccaggcatatgataggccttccagaaatatatgtcgaatgaatgagtgaatatgaaaacaattcagagcagttgttccctgagtttagggaagaccagagagagatctgggtggcccctaagaatctgttacccgtgatcacggtgaaacagaaatagatgacagagagcaggggtggtatcttttagaagaaaataggtgaccatctatactgggccagttctatagttagcaagatgacatgggaggagagctatttttctgagctttatgtaacagatgtggttttgtataaatcacacttctgtaaactgaatcctctcttaaatgtactaacggagattgctatttaagggtatcgaatgccaatgtcttctgtgaaatgaataataatctcctaatttggccttagtggcaattcacattttccagaaaaaaatttacttacatcaaggtatacttgtctgagctgagaaactgacttcattcttcacatttccaccatctttattctttgctctcattcttcctttttgttactgtttttcttctcttttttttttttttttgagacaaagtcttgc

SEQ ID NO: 125751 - DNA, 1127 bp, Homo sapiens
acgaggtcaggagatcgagaccatcctggctaacacggtgaaaccccgtctctactaaaaatacaaaaaattagccgggtgtggtggcgggtgcctgtagtcccagctactcaagaggctgaggcaggagaatggcgtgaacccgggaggcggagtttgcagtgagccgagatcgcgccactgcactccagcctgggcgacagagcaagactccgtctcaaaaaaaaaaaaaagtgttcacctggtcactgtaaccccaggagacgtttctgtccccttctcgttggttttcctcaggtgttgtcttttgtctctgccgtggctgtgttttgagtgactgtagatggtaagctccatgtcagttaaccagcaaatatgtttttcaggactcactgtaagtaccaggtgtgaaaaaacagatcccaccctcatggagactctgcttggtcccttgaggacaggagacctgtcatcttcttctgctttctctgcaaaggcccatcagggttctgggtgagcaggttagctggaatgtcagtctgccctcaacagtgcccttcatgccacagaaaaggtttcccaagtgcctacagggccaggcgccacaagtcagggctgaacctggcttgattgctgggttcgagttgctcttggaccccaggaagagctgacgggctcatggtcaccgcagtcactttcataaccacagtagcagaggatgtgaaaagggtgggatgagcccaggaagccagcatgaactgtctcaagctgtttattcaagaactcggtgccggccaggcacggtggctcatgcttgtaatcccaacactttgagaggccgatgcgggcggatcacttgaggccaggagttcgagaccagcctggccagcatggcaaaaccctatctctactaaaaatacaaatattagccaggtgtagtggtgcgcacctgtaatcccagctactagggaagctgaggcaggaggatcgcttgagcctgggaggtggaggttgcagtgagccgagattgtgccactgcactccagcctgggtgacagagagagactctgtctcaaaggaaaaaaaaaaatcagtgctgctcccgtggctgcacagcttgtggttgg

SEQ ID NO: 125752 - DNA, 1045 bp, Homo sapiens
gaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgctgcagcagcccctggcgccctcgggcctcacgctgaagtccgaggcccttcgcaactggcaaggtgagcaggggcgggccgggatcgcggggcgagtccttgtcctccgactttgccggttcctgggctctagcctccgggactcgccccttcaggcctcaccgccagtctccccctgtctcggtcctcatcaccatgcccgccccccggaggaccgacctccagcaccgtctcttgctctccgtgttccacacctttgtctgcagaccccatcttcgtcatcactgtaatcccttccctacccgaatttgttcccttccctgtcgccaccagactggttaaggccccaaatccattcgctagcaaatccatgctcgctctccaagggtaaagatttttcgtctccccctcccatttcacatacacacctacgtctgctttaggcctaagccccactgaaaaacgtttttctctcacctacatcacgacaattggactttatccacaaacccctataagccctataaacgtcctgccctcttgagatttggaatttcttctgctttttcatctgtatcttaatcttgactgccattcccagctcatgggggtaccagggtgtcttctgcctttggagagaagtgtttgtttttctctaggggagagaaattttgcagaccaattaagtataaacatccattcctgaaagacattcctagtctccgtgtcttcctcattttctcgagaggaacacaggaaatttgcatatctcctgctgttttgcaaagcacacacactgatatgtattaatttcgtttaaccctcacaaggatcccatgacgtaggacctgttattggcccgttatctagataagattgaggtttcatgcagagaatcgcag

SEQ ID NO: 125753 - DNA, 1050 bp, Homo sapiens
gaatatcaggagccactcaagggccaggcctggagacttggaacatgcagggtttagggcaacccccgccagccacacagctggggaaagggtttgctgcgaaatggtccactcttgcgtgcacttcctcccgcctgccccccgtgcggtgtccttgtgggattagaggatgttccagcacactgagagtcagtggctgtcattttctctgtcttccagggacccagtcccagctgctgccttagcttgcaccccaggaccaccctgggctggtgctgacaccactgggggctgtctgttatgtcagccccagtccaagactgtggctgtcttggcaggaacctggctgagtgagccccttctcctaccccgtgcagtgaccatttcctgcagccccaggggcaaggcccagcatttaggtgggcaccccagccagcctcaggggcaccctgctaccctctgctgacatctgctgtttctgtctcctaacagtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgtaagtgccgcctctcagcctcctctctctgtccctcttctgtcaccactccaagcagtgtcctgcatgcgggcctcaggctgaaagaagcaaggctccttgtagcattttggggtgactcttgggttttgccttcttgctagattgtgcttgagctctcccttaatcatctcttatgtggggtttataaggcccttttctatctgctgtttatatgaccttcacaggaagcactgcgaaaatgacaccagtttacagattaagaaccgggggctcaagaatgttaacgggcctgccagggtcattagccagcaatagcagcgctagagctggaacccttttttccatttatttatttatttattt

SEQ ID NO: 125754 - DNA, 1049 bp, Homo sapiens
tgccctgatgggaggggaaggtgtgtctttcatggcacacaggatgcttcccgctgacatggacccagtgtcttaagctctgtttgcccgcaattcttttgtgtgggggaagacagggaccagacttaatttaatgtgattgtgtggcgccctggcagtgggatcagtgtggcttcctttatggagtgcagccctgccatagcaacctgcaggctgtcttctagagcctagaagagctttgttccgcagacatgacttcctttttttttttaatgggaaacggggagggcgtggggagaagggctctgatataaacagttaccaaggagacccgagtcggggttggaaaggttttctccttccctcggtccatacagagggaggaggggtgtgtgcccggtgcagggactcatgggaggcttcactctggaatcctgagtcctgcctgctggggctccagatgttgcagagttcttgggctcatgggggcagacgcaggcaggagctcagggaaattccgagaggactttggggtgtccaggagcactttgaggccacgggcccaggcaacttcctcaccagtacggaacaggggatgcacagggccgaactttccatctgctggcccctgctggtgtccaggagagagctgtgaccctcctttttccttaagtcctggagctgagagtgagaagccatggggtgcacgtactcgtctccacctgaggagcccgctctgagaaggtcagttcctgacactgtccctggcggcagactgccctcatgccccttggccaggggacgcctgcaccctcactcgagtgtgggagacttcctcctggcggggacctgctggaggcctgaagatgcggctgcctggagttaacagcaaggtcagccattcccagggttgctgcccctgtctctggcgagggactcagccaggcctaggcactggtggcccctctggtccaggacttgcacgctgcatttccctgcttccaaaggaaggaatttggactggagaccaggaaggcctcatgcaccct

SEQ ID NO: 125755 - DNA, 1324 bp, Homo sapiens
aggctcccctgtccactcccagggccagccagcctggcattctgctttgtccaactgcgtcaggaggtcacatggaagccctcctcccccgccacttgccgggcttctgggatgggagccgagcttggaagttgccatcccttggcaccccgcttcccgtggggctgtctctccagggggccgttttctattcctgagaagacagcccagctcgtccaagaggcctttcccggtttcttcagccataagcgtctgctccctttgaagccctgtggcgtgaacctgtcctgtcccatccgtccctgtggcgtgaactgtgccatccatctatgtggtcttagcacatgccaccttgtgccatggatgtctttgaaatcacaggctgaccgccttccagggaatgcccttttttctactgggtgttaaccaagttccccagtcaggcactggggaggctgcaataaccagatgcagctctttaataatagtgtgggcacgagaggggcggggcctgtgcagtcccgtgcctgtctagtgtcagagccaggatttaaagccaggtccgccctgccacgtggctcttcccatcttgctgggatcctcctcggaggctgtcttcccctggctggaggattgggcctgtgaagtcacaggttgtctcgttctagtctcatgccctcggtgcctggcgcagtgcctcccgtgcccccacctggctggcctgtgttacccgccaggcactcacggggcactggagtttgctcttgtccttttcttcagcaaatcttcagatccactttgttggagatggaacttccctggaagcatctgtcctttgagtagagataggggttggcttttcagctgatgccaggtcagacctcagaggtggctagggagtgagaagtgccctcaacagcctcttagtccgcccctgccagcctcgtgctggacagagaactcagggctggccaccctaggaggagacacggcgtcctgtgccgtgtgctaggcgtcgcgctcatggcagggatacacagacagcccccaaggttattcaacccaggcttccagttaagccacaggaatgtgcagagtaaagtgccttggccgaccagtgtgtgtgccacagcgaagacggcgacagtagcgttgctgcgtgaggggcagggacggcctctgggagaggaaagttaagttctgtggtaaaggatgagtagaaggtgggaaggggtcacaggaagggccttgtaggcccagggagccgcgtggaaatgtgagtagcttagcgtagcccagagaggtgggaaatggggccgggcca

SEQ ID NO: 125756 - DNA, 1918 bp, Homo sapiens
cctgacctcaggtaatctgccagcctcagcctcccaaagtgctgggatcacaggtgtgagccaccacgcccggctgcatccttggatgtaagtatctatgggaggtcctggaaccattcccccacggataggggctatacatttggttactttttttaactttgttttttccccgtgtcatgaaaatgtcagaagtgtgatcttgagcagccgcgtgtgtgagattgccttggtgacctttgccctcctttgccacagtggctgtgacagtgagaagcaagtcccagaggaacttagaagggactcaaagccaggaaggaaagggggcggcctggagggcccccgcctgccaggcctgcccagtgggtgttcaccggagccgtggctgaggtctgtggccctcaccaaccctgtgtctgccttccttaggggaggaacatcatcgtgttctacggctcccagacggggactgcagaggagtttgccaaccgcctgtccaaggacgcccaccgctacgggatgcgaggcatgtcagcggaccctgaggagtatgacctggtaagctgccaccgcgtgctggccccagatggaggcagtgggtaggacagggagcaggtctgtagggcgcccctcagcagggggaggccggcagggagtggggtcctgggaagacgtcctcggaagttgccttcccgtgagggtcattgccatccctgcccgggctgactgacggaagggccattcctgcagttgcagccacgtgccaggcatcgtttccccaggactggccctcccctgagtgccggctgccctcctggcggccgccacatctcccaaaccaaacccaccctccccagctgctccactcccctctccttcgaggtcttggtgacgggcactaccccacagccctctccaggctgcatttgcagttgatgaacagtttagttagatatcagtgtgcaccggggctgtgcggtgcctgggagctttggaatgaggttcccagggtggccccagacctgcatcagctcaggaggctgcattctgatggctcttttgtgccaagcttcactttcctctagaaacacatcctctccgctccagcctaacacgggtgaccttgtcctgcccacctggcacaaatgcccatgccccagcccctccgtgttgttacttctctctgatcccacgacactcagacatccctggcctggtgccaccctgggcaggacctggccttccccatctggtgcgggttgaaccttgaacaggctcagtcatggccggggcgcggtcctgtccctgtttctgcaggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgagtcacccagagactgctatgggctcccggtggcctgcggtgcctccctggggactccagatccatgtatctgaaaggcagccctccagacccccaccctgtcctcagcagccagggcaggccacttgtgagaccctctcctctgccccagaccccagcactacgagaatgtcccctccctgtccccagccccagtcggctccagggggcattgggtgctggagactaaaggcaagaaaggtctggctggacgactgagacctgcctggcctcggagagctggagccccagcccggtggggagggtgggctggccccgcttccctgtgggttgaggctggcagtggacggggcaggctgtgggctgcaggtcaaccagatgaagcctcttcagtggcccagtgttccttgcagtgcgaggcgcctggtggaacggaggcctgcaggtg

SEQ ID NO: 125757 - DNA, 2595 bp, Homo sapiens
aagccctcggaccccactggtcaccaacctgggccgagcccacctcgccccacccctgcttgccggtcctcagctgccatgccagggctgcccttactgtcggcttccacagcccgcctgtagggaagcctgggcggggctgtgtcagaccgtgtagtgtgcggtgaaagcacagcgggtgcgttagtgtgcaggggctcccccgcacctcccctagcagggtcctgcctctgatgaggacttcctgtctggttggaggccccagacttggccccagggccagggaggcatcagagagcataggccttgtttccagcaccagctggggcacctgttgccgcagagctggcccaaggtgtcaccccctcctgccgcagccacccatccccaggaggcggccgcctaccccaagtcctgcctgtctcttccctgcagaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggtgcgccccctcagcccccgcaacctccgccccgtcaccccgccgttttccgagctccgtgggccccaatcagccccatctcacccccgtgtctcttaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtgagggccggcactgccctgccagccacacgctggaggcccagccctgctcacagcaggcagagtgcaaggcggcacaggagctccgagatctgagccctgagctccagttccagccccagcgcagctccaaatgcctccccaggctgtggactcagtcgggctggcttgtgagattctcagcatctgtccagccccggtccccagaaccagtccgggaagccgctggggagggggcctctgaggtttgggtgccaggtgggctggaagaggccctgggtgagtggggctggcctgcagaacgggacttggggccggggctgggcaagggcctcggtgtggcggtggagctcacacggccctccccacaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggtgagtggggtcccatgggggagagggggtgacgactgggagccccgcgctcaccccggcccctgccacgcaggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtgagacgggcgggcacccacgaaggtgggcatgaggctggcagggccacagccacagtgcccccctcacagcaccacccttggccccaggtctacgtccagcacctgctaaagcaagaccgagagcacctgtggaagttgatcgaaggcggtgcccacatctacgtctgtgggtgagtgagtggggtcactggaatagggggcagggaggacaaggccctgcctgccacagttggcccagcccccagcaccccctcttcctgcccagggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgtatttgcctggtattgtgtgagtagatctgggacctccacctgcatcaacttaactaactcagaccccaggaacccatgtggt

SEQ ID NO: 125758 - DNA, 1034 bp, Homo sapiens
ctctacaaaaatacaaaaattagccaggcatgatggcaggtgcctgtaatcctagctacttgggaggctgaggcagaagaatggtttgaacccgggaggcggaggttggagtgagctgagatcctgccattgcacttcagcctgggcaacagaacaagactgtctcaaaacaaaaacaaaaacaaaaacacctagtctgtttttggaggaggggtgctgtgggggtctctgggctcacaggaggacacccaggtccttgcctgccttggggagacagccacctcatccctgggcaggcacagttctacctcctttcccgctgagcgaaaccctcccagcagccctgggggagcctgagcgccacgtcctgcctgcaggctctggctcagtagctccccaactggcctgagcctctcccctccggcccccaggagacccatcggctctaccgcctgaagctggaggagctgaccaaactttagaacaattgcaccagctccatcacgcggcagaagaagcggctccaggagctggccctcgccctgaagaagttaggatcccctaccccacccgccatgggcagagtgtggggtgggagggctggcgctgtgagaccctgggcaccgcccctcccctctctgggccctgtttgcccttctgcccctgtgggagtcagggaggacacttgggagtcctcttgccctgactgtttctggccttacccgcagatgcaaaccctccctcccagcagaggccgagggggccgcacaggagctggagaaccagatgaaagagcgccaaggcctcttctttgacatggaggcctatttgcctaagaagaatgggtgagggcccccaccgccacccccagctcagttcacagccactcctgaagccgggtgctgcctcctcttggtcattatagtcagcaaatgttccctgggcccagtacaggctgagcaatgaggcacagtgctgacttcaggggagacacctggctgagagtgacatttcactgtgataggtgctttgta

SEQ ID NO: 125759 - DNA, 1230 bp, Homo sapiens
acctttccggagctcagagtcccctctggcctccaagggcagaaggaatgggtttggctgaggtcgggggctcgggtctgggacgcgctccacctccccggctgcgcgactatggccaggctccctgtcggagcctctgcctggggccccacctggaaaaatggctcctctaaggcgcttccagcctaaagcccgtcctcttccacctcttgggtgcagactggccctcccactccgaccgcaggtcccccaccggccacacagacggctacgctagaacccagccaaacaccggggttgccaggatggtcccacagctttcctttccgactcccggaagtggccgtgatctcacgagatcccggaggcgagcgcgaccggaagtccggtcactctcgcgaggccccagagagcaggcgctgggcagtgtggaggtcgttggagtcacttccccgtcaccagctcctgtgcctgccagtcggtgcccctcccgctccagccatgctctccgccctcgcccggcctgccagcgctgctctccgccgcagcttcagcacctcggcccaggtaggccagacgaggggcggcctgcaggcggaggccccccggcccgggccacgtgcgtccccggttcgcgggcagctctgaccctctccaggccagcctggaccgcagggatgcccggcactggctggagactgtggcgcccggggcaggccctgacactggcctggaggtgcgggggagaaagccggggaaaagggggcgaggtagtcccgctccagggccggtccatttgtcagggttcccccaggtctcccagatttcccagaggacctgctcttggcttgcacgccttcaaggttgggaaaccagggctctgcatctgaaagtaaacttacgtttttttctgcagcgttccattgctttgacgtagctaatctccttgcagcatccgtgtgagttgtgcgtgaataaaagaaatcgtatacttcctaattccatagtatggacaaaccgaggctagagaactgggccagggttacagtcatttggccagaggattagaattcagcgcttctgacctgaagacggcttcctcttaacctttttggaggatctctcctgctgtgggcggactgagcctgccgccaggtgtcttaacagtgcttgacttggcccgcgaccacttaagcctaggagcctaggctatttttagccatcttctag

SEQ ID NO: 125760 - DNA, 1448 bp, Homo sapiens
cccagggccagctgctactttgctgcctgttcttctgattagcctggtatgaaacagtgattctcaaactgtttggtatcaaaatcatctggggaaaatggcaaaaatgccaaggcctaagccccatcccgcttccaggagcctagtcctgagtgggcttcattagctcagcaggtggctctgatgcacacctaggctggagaaccagtgtgagatactggagcccgagatgacagatctgactcaccaggagggttggagtctttcgcaacgtacgtaaccccttccacctcttgttaggcagctccttgtcctgcctgaggctccagccacaagtttgctgcctggatgaatcttctctgattccccacccctgcagggagttgattgccgcaaccccatctgccctcttgcacaaggggcttctgtgacagtgttctccctgctcctaatgcatctcattacctgtctcctacagagccagcagggatcttcctgcaacctcagttaccgggagggcctgttgctaggcactcagtgtgtgtttatagtttataaagctgcaggttgaagggaaggctgctgttaccagtccagctgcctgatggagtccagcttgttcttcatctttcaggagggttttgaagtaccctgagtatcacagactctacagacataaattctccccatttgaaagtggacctttggaatgaaggtcctgaattcttccagaatgagactgttacaaatacaatgattgtatcttgctttggcaactgcagtaaaaagaggcccagtgcaacattataggataccatgtgaatccttttcatgctcatttcctcctaagagtcctttctctgtgcctctttttagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggtactgggcgcgctgaccctggagacttgcttcctgtccccagtaggccaggattcgagttttgagtaagattcttagatgaaactaaatgtttagagacgggggtttctctgttttaaatttaaattttacaagtgattacacccttttagacttggcgtctataaaaattgaaacagcggtgtcttttagaaatgtgaggtagcctaatcatcccattttctactttttctaatttgaaaagtagtatgaggatggggaagagggaagtgtcagcaacctctggtgaggatttggggacagtaaggtggtggtctcagctgcgggccaccttccctccaccccagggttatcttgccagcttctcaaaaagcacggcctctttgggaaacctccccgtctg

SEQ ID NO: 125761 - DNA, 1052 bp, Homo sapiens
aaagccttgtctggtacctccccacgtgaagatgtggggattaaatccatttcctattaaaaatggatttaatctggttgctttgttgtaggaaaaatgtcaccagctcccctttcctgtggggtaaaggtcacatctctttgttggcctgggatcaaagtcgtcttgccgttcccctgtgcctctgtgcacggacgcccttccctcttctcagtcccactctaccttgggggttcttaataaacctcgacggtccttctcagatgttgtcctcccctgctccacccatgcagacctcgcttctggcactcatcatgctggatcatttaccctgcaagagggactgacttgaaacggggaccttgagtggctaaatttcctgtaacagctggcgctcagcacatgctgcctgtctggaaatttgtggtgttctctgttaacatctcatattggatcatttccaggcatgacccgggacgacctgttcaacaccaatgccacgattgtggccaccctgaccgctgcctgtgcccagcactgcccggaagccatgatctgcgtcattgccaatccggtgagtgtggcagcacccggctcttgcagctatggcaggtgtttaggtgctgacagtgcgtgaaaagctcacggtttgcagcaaaggctgctgatgtgctggggggatggggggatacacagatgaaggggctgaaatggagaggtcgggtgcactaagcagaggcccgtccgtgcacttcctaaggactccttccagcatgaactgaatgagggttgtcacagccagccttgtgctgtgggcagaccacgtctctctctgctttagtttccccacctgaagagaagtccattctcaaggctcctttcagccgtgattgtggtggtctcttgattccctttttgacacagtagctcctacttagccggaaaagtatgttccaagagcccagtaggtgcctgaaccctgaaccctgtatataccatgtgtatactgaaccctgtatataccatgtgttttcctaggcatgcacacctgt

SEQ ID NO: 125762 - DNA, 1027 bp, Homo sapiens
gagttagggtgacctgcccagggtcatagcacagagggactgagctgccagtggacctgcttccttggagcacacagccgctgtgcactgctgtcccatcaggagtggccctgcagctgtgagtcccggccgagcagaaggtgatccatggaggcatcatcacacatttcagttgatagctgaagggccaccaagggaagaagcatcctctacagcaaagggtttctttgttcacatggtgcggcctgtcctttctggcaggtggcttgccagtacagagttatcagacagggcagtttaatgtggcatctttggactagttagacctttgggaaggtctgacaaaaagcccttttcctgctgtggcttggccctgctctcggaacccagggcaagccatgcctgtctgttggatgtcctaggttaattccaccatccccatcacagcagaagttttcaagaagcatggagtgtacaaccccaacaaaatcttcggcgtgacgaccctggacatcgtcagagccaacacctttgttgcagagctgaaggtaagggcggcgtgggtgttgctcaggtgacctttctgaacttctcccgccacccgtgctcatttacgggcgtggaagacatgaaggcatgcccaggtcacgtgtcactttggggttttaaatgtttttagagctcgccctcttgatggaagcagcccctgtgtttcctgtgggttccaggcactcggcccaacaggcatctactctggccagtgtctgtctcccggctctcgctgtcttccttctcgccaagagcactgtgggttcacaccttctttgggcttctcagtggctggacttggacggggctcccccagtcctcccctttctccttgcccctgaaaactggtcctgggaggatttacctgttggccactagataaagggtgggaaaattagcaaacatgaagaactgaggaaagtgccagaagtcctgaggtatcagaattgttgttggccctggtccctggcactgactt

SEQ ID NO: 125763 - DNA, 1089 bp, Homo sapiens
aaacctggttcacagattcttgggggtgtggtacctccagtttaagaaatgaggcagccttgaactgtgctgtttggagccataggagtcagtttgttctttctgtcccaatcactgtttgaggtggcagacttctaactcatgggtatcctggaatggatttgaattttgttctgtggggcctgaagaaaagggaacttggattgttctgtgtagggaggagtctgggcttgtgcatggggagtggagccggctctgggaaagaggatgccaggcccggggggggcctccacaggaggcagcatcctcccatgcccatccacagtgggcacaaatgctcactatgaaggaaggacttgcgatggcctcgccagacggcggcaagccctcacggcacctgctggcgctcatgctcagccttttggggcaccgtggcaggagatccaagcgcagcaggggctggacagggcctcctcctagctggctctgttccaccctgagttctggggggcttttccagtgttggggctgtgggcagctgtgacatgttttacagtgaaagagcttgttaactcatccagcttcatactttggtcaccagggtttggatccagctcgagtcaacgtccctgtcattggtggccatgctgggaagaccatcatccccctgatctctcaggtacacgcatatgaccctgtgaggggcttcgaggtcaggattccctttaccaggccctgctttgaggtgatcccggtagactggagaaggcctggccacgtgccaggttttggaagggctcctgttgtaggcagccccgcccctctgctgcagggcggtgtcagtcctggagcgaatgtgggtggaagctgctcagggcccagctccagcacgcaaggagaaccactgttgggaacctcaccgggttactggttaggccggagcgggcgaggtgcttttttcaaaaatgagtccagggctggacacagtggctcatacctgtaatcccagcatttgggaggccaaagcgggaggattgcttgagcctgggaggttgaggctgcagcgagctatgatgcaccactgaagcc

SEQ ID NO: 125764 - DNA, 1071 bp, Homo sapiens
ttttttatctttttattattatttttttgctgctccttgtggagcagggctaccccataggcagtgtgcccagaatagcatgtcatttttctataaaggttttctttttcttctttatagaaaacctttcccatgccctggtgatgggagggagaggagaggtcgggaatagtgggggtgggaggcagtgggtctggggtcatgggccggaagccactcactgatcccatggcttggcttgcagtgcacccccaaggtggactttccccaggaccagctgacagcactcactgggcggatccaggaggccggcacggaggtggtcaaggctaaagccggagcaggtagagtctcaggcagccccggggctgggtgccagtgaggccctgcgagagctcagggttggggagaaatgctgcttgtccctgggcatggacgatccttttcagtgttgatttgcagttgcctggtggaaaatccctgtgtgagagggcagctcggcctgctttgtggggttgagagtcatttttgagggtggcagagtcaattctacaccattcatgtataagtaacaagaaatcggggtgctgactgaaattctccactgtcaggctggaaggtgtgcaggtgtcttggctggcggggccggctcacctgggcgtcacgtttgtggcaccagccaggctgacctgtctgtgcccccctaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttggggtacgtatccaggcgtgggtccttctgactgtggaataagggggcgttccctttgcttaagcctcaggagctctccctggccctttatgcagtaagctcatgtgcctgcctggcgagtgctgttgttttcaagggtggacgcacacccgagaaaaaagagctgggaggatcacagactgtgaagggtgaacctcccagcaagtgggtctcct

SEQ ID NO: 125765 - DNA, 1040 bp, Homo sapiens
cccgagccgggggctgccagtcccggagcatcgcacacacggttccccgcgcctgccctgcctctgcctctcctgggtgtccaccttctggcctcaacagtgcagctcatgcagggttcttggcatgcaaaacacaagagggacggagcggtggggggcgggggccaaagggggaggggctccaggacaggcatcggggctggcattgcccccccgatgggacggacgattcccggcagagagaagagagagcggcaccgggagcggggccagggccagcccaccaggccggacccccagcgcttgggggtgggcgaggggatggagggggtgggggcgtcacacggcacacagatgggggagggggcgagggggacaactgaactcaaaactgaaccgaagaaagggaggaaaaacagaaataaaaaaacaaaatccacaaatgtcattagataccaaaaatcaaaaacaatatctgatcctggggaacctgacatttttctgttaatatttttctttgttttccggccctgcagagagctttggagctgtcagtagcacccgactgtctttctgtttctctcttttctttttctttttcttttttttttttttaagttctgatttttaagtccctcttggttaacgtccacttaccaataaagtggcacttcctcctttagtaggtaaggtgtgtaagagaagggaaaagtgtggtagtataagttcatcattagattcacaaaaatgcaagagagatagagagagagagagagaaacgcaaccaccccattctaggcctgagaagaggccacgccgcctctggaggaagggctggcagcgcccggctcctgagtgggcaactcttaggtgaccgctggatagaggtggcaaatgtttttccaaaagtggagttaggacacaaggattgggacacagaaaaccaggaagggcatctggcaccatcaaaagggccctggttgggattcaggagtctgagagcctgcctctatctcaccgagtgaccctggccacgtcac

SEQ ID NO: 125766 - DNA, 1051 bp, Homo sapiens
ttctgagagcccagaccggcgggcacgcccccatccccaaccccctctgttaatccctaccagcctgcagtcctggctgcttccaagcaggaggtggggcctctggcctagcggggccgaaaggcagtcccctcccccgcagtctgatttccctcttccccccaaaggcaagcacgaggagcggcaggacgagcatggctacatctcccggtgcttcacgcggaaatacacgtgagtcctggcgccaggtcggggtgggtgggtggcgtgggggtggggtcagggaagagggcacagggacccacccggtgtgtaatgtaacgcttgcctttcctctctgcacgtccaggctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctgtcactggcccaggccctggtgtttgtggaaggaagcctcaggcacctgccatttgctggctttcaggagtcatctttgctcaggcccgtgctgggccatgtgggtacactggtgtaggttgctggacacaggctgactcacatccataaagacagaggtcttagggccgggcgcagtggctcatacctacaatcccagcactttggggggttgaagcaggaggagtgcttgaagccaagagttctagaccagcctggacaacatagtaagactgtctctaaaaaataaaaattaggcagggtggtactgcacgcctgtagtcccagctactcaggaggctgaggcaggaggatcgcttgagcccaggagttgtgaagggtacagtgagcta

SEQ ID NO: 125767 - DNA, 1028 bp, Homo sapiens
tgggaggctgaggcaggagaatcgcttgaaccagaagatagattgtagtgaaccaagatcctgccactgcactccagcctgggcaacagagcaagactccatctcaaaaacaaacaaaaactgatactttgtccgaaaggtgattaaaaataacagtgtgaaacatcagaggtctccattccaagaacttcaggtcaggggtagagtggagaggccataaatgtaattcagtgggaccttctagtacagcaaagcatgaaagcagttttcctccactctatttatgtgtgatgaccacatgcgttggcctctgctctggtcagctgaaactgcatgttgattcactgggtgatttgagtggctaagaatggcacctccctcctgggtgcacagttcccaaagcctactcagagaaacaaccttctgagcactagctgggtaaccctgttctaggagttgacaatcagtggtcaccagcctaatcagaacattaacatgtggcataccagcttgctaattagcccactggtttgaattttccaactctgatgtggataaacgtggttgaatctgaatggccacaagctgtacctctcattaaccacacagcgctgtggtcagtgaggagttagggtgagagtagctggatcacactggcaagacaatgagtcaagacatctcaggttatgtaagggactcacgtggcactctgttatcctgttatccagagtattggagaggaaaggccgtaggaatttgaggaacactatgacttggggccttttttttttttttttggaaagacagaatctcactcttgcacaggctggaatgcagtggcatgatcacaactcactgcagcttctacctcctgggctcaaatgatcctcctatctcagccttctgagtcgccgggaccataggtgcgtaccaccaccacacacacctggctaatttttggattgtttgtagaattgaggtcttgctatactgcccaggctggtcttgaactcctggcctcaggcaat

SEQ ID NO: 125768 - DNA, 1807 bp, Homo sapiens
tggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttggggggggaggggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgccagtgctccttagcttcattgtgtgagttttactgtcctttgcttttgaaggttggatcagatgttggtgttctcttccctccccagcccaagcaatgaagttggattggcaggaaaaaggggaaagacagtagatactggaaagcgcctccaaccaggaatcagatttgggtttggggacttaaaaaaaccattgcaccaggccaggcgcagtggttcatgcctgtaatctcagcactttgggaggctgaggcgggcggattacctgaggtcaggagttcaaggccagcttggccaacatggtgaaaccccatctctactaaaaatacaaaaattagcagggcatggtgctgggtgtctgtaggaccagctactcgggaggctgaggcaggagaatcacttgagcccaagaggtggaggttgcagtgagccaagattgcaccactgccttccagcctgggcaacagagtgagactccgtc

SEQ ID NO: 125769 - DNA, 2537 bp, Homo sapiens
tttggactccctgaggtttagaattcacatggtgttggcatatgagcagaaaggcctccatgtttctcagaagtcagcttgaagttgactcagtattttcttatccagaagagatgggactgaagtttagtagacagggcaggattaggaggaatttgtcagtccgttttcctaaaaaaccactgagttagaccatctgtactcatagtctctcatctaaggcctagacttgacagtgttttgtggaacacacgtgataagcctgtgtccttttctggggaggaagccagggttcagacaccgttgatccattgatccagccgcacttttccctcccttgtgtgtgctccacctccagcccccttcccccagcccacacaaagtaatttccttctgttcatcatgttactcaacagagctctgttctagtgtctcaaagatacagttaacccagtggacaccatctgtaccataacaactctgttctttcctcctggcaggtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtcaggtggctgtgggattttttttttttggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgc

SEQ ID NO: 125770 - DNA, 1056 bp, Homo sapiens
cctcattgcagtcctggattaactgcaaacctaagagtaggatttcatctcttgtactcagggaagccttatttattaagccaatctttaaattattgaaaagagtggagaaaacgatgtgtttttatcgaggtaaaagttgcgtaacataactgtcacatagtcacatcagatttcaagtgcaattgagtggcattgggtacattccgtgttgtgcagccatcacctatgttgaagaagagagaaagtggttatttttaaaaagtgatgccggtctggactacagctggctggaattcagcacctattcaggaatgtgtcgataatggagtgcccacaacagctcacagccagcgataattgtctatccctttgtcttcatttccaagcgtctgaactgaaaaaagggaattagctttagctacgtttgtactgtatttccacttaaaaagttatggaacttgaacactgtataatgttcacccaaataaataagaacaatttacttgaaatctgagcaaatcgttaactctttggggattatggaaattttgctggtgttctagtgactcgttttcagccctaaggctggctttattatcagtgatttgccgcctgtgtggtagtggtttcctaatgagtaggatgcagggttgagactggggagctcctgcagcatgaggctcttaactgatgggacgccagcacaagacattcagtacattgtggctgtcaggagctggatgggaaaagtagttacttttcccttctttgcccattcccaatatcagcagtcctaaccttattttattttattgtattttattttaatttttttgagacggagtcttgctctgtcacccaggctggagtgcagtgggcagtggtgtggtatctcggctcaccgcaacctctgcctcccaggttcaagtgattctcctgcctcagcctcccaagtagctgggattacaggcacccaccaccacgcccagtgaatttttgtagttttgatagagacagggtttcaccatgttggccaggctgagctcgaactcc

SEQ ID NO: 125771 - DNA, 2598 bp, Homo sapiens
gaaaacctgagctccgtggtgcaaaatcgaaaccaccttgctcacgtttttcttaacaaaaggctcttctttctccattcgcccaaagcaagtcctccggcttttaggaagggagaacgtttgtctcgctagcgttttcattgatcattctcaacatgtcatctccattttattccctaatgtttttgtattgaaaagggtaggtattgcctgtaaaattaaaaggtggtgaatgtagctgactggttcgattcgtgtgacatatgccgtttcttttttgaatacaggcacgcgtctgttgaaattcctataagttgggggaaaaaatattctgtctgatctgatagtgcaaacaaagccgtggtgagaggcagtatcaagtcattccagaagattctgcatttgtcatattgcagagagcctagactgggtggaggctgggaggagttattttaaaggggaaaaagtctttttaaaaatttttggttgttagatgcatctgaggcttttttttgtttaagcgagtacatcttcatgctgatgaaaagagaataccgatcgccagttgtcgcattttgtctgggttgcagattcatccctgtattgcaccattttgtcagtaacaccacatttatctaatgggctgtcaaccagtttgatattagaggagggggaagtattgagcattatgaaatgaaaggtagaaaattaatctaatgatttcgggcccccactatcttaatatttaatttcctgccttatgtaacaaagattttcaaattcatctccattgtgaagtggatgctggagtgtaccttgcgtgttacatcttttaaatgaagcattattgatattacagatcaattcttgaataaatttactggttctcaaaagaggacaatgctgatacctttatatttaaagcagctatgttaacaaagaaaggtttttgtcttattgaagagaactgattctgaaattcggaatactgctgtggccacagttgctgtcttacaaggttttaatgcttaaatgatgtaagttgcacttctaataggtatcagtattggaaatatcttcagttcgtgttatttagactcttataatttttccatatttcttttccatatttctagttccacaggaaagcgagtgacctcgcacctatatccatagcaaccaagtgatgtcacacacaatgacacagaggctgcaatgcacctaagggctggtagggagtgtgcaaatggcatttatccaaggtaatgcagaaattagccgataagccaggtggaatcgagcacttcatattccactagatgagaattagtccaaaaaataaggatatcatttacccttagacatgcaaatctgtgacctctagctaggccttgttcaccctattgctagctttctcacaaaagtttataagatgcttttttatatttttaaacattcatctcatttatttaaaatactgggcaatgatggaataaaagtagaaattttaaacgataatttatggaataaaagaaattttaaacaagaatatagtttatgacactagtgcacagatgggatgtatacttgtgtttattgcagataattaatttggcaggttttaataaaaaccttaaaaaaatgatgacttcctactgagtcattttcagttactagtagggaatgaaaacccgttccaaaaccttttaagttgagatttgggaagtttgttttttactagatttgtgcttctgctccttcacagtatagaggaaagaacagtttgtaaaataaaaaccttttttcaaatctgtttcctgtgactttaaggaaataggctctgtccctcattttcctcatctgtaaaatgggacaatacttgaaaaagttgtgcggattcaataagaaatgtagtaggtgttccaaaatggcaactacctaagaaattttcttcctgtttataaaagtcatcgtggagaatttggaaactgcagagaaagaaaccaatcttaccactcaagtgagctctcttttaaggccgaaatcatcctgttgataaagggattaaaatttatttgagtttaatgaaattatcctagtgctaacactattgggatctgtgcagaatgatagttctttgtgggtaaccaggacagaagtactgtattgtgcagtattttgaaaagaaggaaagaggaatgttaggtcttttaagacagatgtttagtcttgtattgaaggagagtgaacacctagatgtatcctacgtattagacaatactgtcttgtcctttgacttttactagtctcttgagaagttaatattttaaataggctactggtacttgccttggggagaaaaggttcagggttactaattttgttgaagttactgagttaagcagtttaactcaatgaggggtgggagggcaaaggtggcaaaaggctatcataatttttctaaatattcctagtgggatcaatagactttcaaattctttctatcttaaatattccattccccctcccccccaggctcttccaggagatcaatagctattatcactaatggagtaatggtacctctgtagactcttc

SEQ ID NO: 125772 - DNA, 1004 bp, Homo sapiens
aagtgaaaaaaggggagagtgggggcgcagtgggaaaggacggggtgcccggaagacgcgcagtgagcccagctggggagcggggagttctagccgcggccgggctcgggcggggcatgggcggggcttgcggacgggtgggcggggcctgccttcgtcatgcggcgtgggcggggccgcagggggttgtccgtcagtggcacgcacagcagccgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgagtgtctcctcccctcccccgccgctccctgcccctccgaagacgcggtccttggcgtggaaggcccggggcttcgtcgccctgtcgcgatggcgggttgaccgccccgtctcgctcactgaggggggctggggagggtcccgagaggcgacgggaacccgggctgtgacgcggcctcttttcggagtccccgtggccccgcggcgctgccattcaggcccggcgcgggcgcgggccggggcgaggtcccgcggggctggacttgggagcggggtctccggcccccgcggctctaggggtgcaggggacccgagcggggaggcgtgcgcatcctttgtgccccacttcccccctcctcctagcctgggcgtgggggcgggggaccgcatggatgcggttcctctttctctccctggtgtctgggcggcgcctttcccattcactcagcaggtctcccggttttccacctccccagcccccccagaatcttccccactgtctgtcccgacacatccct

SEQ ID NO: 125773 - DNA, 1050 bp, Homo sapiens
tagcactttggaataccgaggcaggaggatcacttgaggccaggagttctaggctgcagtgagctatgatcgcaccactgcactccagcctgggcgacagagcaagaccctgtctcgaaattaaaaaaacttttttttcaatgggatgatgctgagattgggaattgagagaccttatgagggggtcgattgagatgaaggttgagtcaaggttagcagtgcaattggaattaggataggaactatccctgggcctgaagttaggataatacctagaattagctttcggttcattcaaccaagtttcccggagatcccaacccgcgccagacaacgtggtgactctggggttgcagctgagtgggggtacgggtgtggtagggttgggggtcttggtaggcgtccccgtgccctgctgcaggacagaaggcctcctcgtccccttcgaacgccctagatgccctgtctccacagctacaggagttggcccccagccttcccgggagacagcactgctcaccaccgccgcctgggccgcggggaagaaaagtaagtggcggtgcctgggtctgcgggggatggggaagggtagggctggggctctgccgggagccggcagccccagcccagcccctctggccgcgggcctgtgcgccccgcaggtggacggctgcgactggtgggcggcccgggtccgtgccgcggccgcgtggaggtgttgcacgccgggggctggggcaccgtgtgcgacgatgactgggactttgcggacgcgcgcgtggcctgccgcgaagcgggctgcgggcctgcgctgggcgctacgggactgggccacttcggctacggccgcggccccgtgctgctggacaacgtgggctgcgccggcaccgaggctcgcctgagcgactgcttccacctgggctggggccagcacaactgcggccaccacgaggacgcgggagcgctctgcgcaggtgaggctgacagcgaaggtgaggctgacagcggggccgcgcactgcggcgtgggaggggcggggcggcgccacgc

SEQ ID NO: 125774 - DNA, 1045 bp, Homo sapiens
tctccaggcagcatccaaaattacttctatctcagtcctgttctagaagtgcctccgaatatcccagaactccttgtggtacactccatggctatgaaacaatattgcactaatccagtctggccaacatggcaaaaattagccgggcgtggtggtgcatgcttgtaatcccagagactcgggaggctgaggcaggagaatcgcttgaacccaggaggtggaggttgcagtgagccgagctgacgccactgcactccagccagggtgacagagacagactccatctcaaaacaaacaaacaaaaaaactgtactattgcttcaccaatactcgagaattctatagcaatatcccaagaatgcctccagaatgttccagcaagtactgttcctggaccactttagagtaacactctaggataacactcggagtaacactctagaattgccccagagatattccagcattctctgatgctcacagcattacctagcacacccctctgtcatcctgatgctctaataatagtattttctccccacctaggccctctccaatttgggagggtttctcagcaaagaggaataatagggccaataatgctatttcacagatggactctgctctgtaagagataaagtggttgcccacaactcataactcatagcaaactaagggctatcattcccagtgtataggtgggaaagctgaggcccagagagtcagagccttgcccatggtcacacagttaatgcaaggcaggcaagcccccaaatcgaggcttagtccaggagggtttttggcttccctcagcaaagaatttaagggccagctggtgttagcagctttcattgacgcggcaatgcacagcagcagcagaggtcctgctccttgctgagcagggctaccccataggcagtgtgcccagagtagcagctgagaggcaggtctgcagtcgtaattctatttactttcaagtatatgcaaattagggggtggattatgcagatattttaagaactagaatagtaatttttgggttgtc

SEQ ID NO: 125775 - DNA, 1048 bp, Homo sapiens
tttaaatttaaaaaggttgtgctcgatggctcacacttgcaaccccagtgctttgggaggctgaatgaagcaagaggatcgcttgaggccaggagtttgagatcggcctgagcaacgttgcagcattgcaaaacccccatctgtacaaaaaagaaaaataaaattaattttaaaaacaaaaaaagagaaacagtagcacatgtatgtactggcaccatgtatgtactagtaaaaactagttaaaattaagtcagtaattaatgaaggaataagtcaatgagtgagcaggcgaaggaagaaaacatagaccggagcaggtgcgccttgggttgagcccttccccgctgagccccgccttctgcccgcccctgggccctaccgggactacatttcccagaaggccgcacgccccgggcatgcgcagcggctcgctcggaagctgcgacgccgagtttcactctggctgccttctcctgagagtcggagccacagccagagccctgcccaggccgagccggagctgcagcccgagcgcggtggtgccctcagccccgtcctcttgtcctcctcagcctcggtgagagggcgggaaggccacctgcgcgtcgctagggctgcggtcccaggggcgcggggtggcgcggggagccggagcctagctgggaccggaagggggcgggcgtgggtgtgagggggaccgacggccggggcggcggggacacccgggggtcccgggagatcgggggtgtcggggggatcggtctccgggatcaaggtcctgagggcgagagttgggggacttgggaggcgccggcagctttggacgggacagggtgccgggtgcgaaaggggacgttcggatgaaggctgaggggctcgcaggcggaggggcgcggttccgggtcgctcggaaggcgcgcaccccttcccaaagtacccagaggagggggtgacgagattgccaccggctccctgacgaggggttggtcctgctggggtctacccccaggtgaagggactcactgggccgggggttgtactttggagg

SEQ ID NO: 125776 - DNA, 1059 bp, Homo sapiens
tgtatttctggactcaagcgatccgcccgcctcggcctcccaaagtgctgggattacaagcatgagccaccgcgcctggccctttctttcattttttaagactgatttgtattccatcattagaatgttccataattggtgcaagaattcctttattgtaaagtgtttaggctgcctccaaattgaggctttttcccatggccaattataatactaataattttcataatgaagaaccggcatcattaggagctggaacaaattaggtttttaagctgcagctaagtgatggttaagccgaggctgctgcagagactggtgcaccgacacgccactgtattgtgcataattgctgggttcaaggggaacgcagtgggcgtttctgggcagtgactcaaaggtgcctgtgcccctggagcagaaggctcacccctcctttggtgtttcagagcctctgggatattgggcacctgaagagctgcagccccagctctgccctcagggagtttctgttttggtggggagaaggccactgaaaccagggagtgcggttgtgtttgcgtaagtgccctgcgccgtgcacacaagggtaggtggagccagccgtctctggcaagctgtgggtcagggggcccaggagaaggggataccatggttgggtctggaaggatgggcgtgtttgcttgggggctggtatagagggaggatcaattgctagaaggtggtaagtggcttggaatgttctggaactttctagaattagatgtaggtatcaaaggtggcgggcttggtgtgagtaggaacagtggctggtcatggaggggcttgtgtgccttgtcatcctctggagtctccagtaccctcctagggcctgggccatggtgcgccctccattggggaggctgcgtgccttcgtggaaagttttagctgatgtcctcgcctgtatttcccaggctgtttttgcagagttgtgagagttggttcatccgggccatgaggacatgttgggacataccccgtgtgccgatgatggaggcggccgtggctgcccgagagat

SEQ ID NO: 125777 - DNA, 1021 bp, Homo sapiens
tcatttgaacttgggaggcggaggttgcagtaagccgagatcgcaccactgcactccagcctgagtgacacagcgagactccatctcaaaaaacaaacaaaaaagaacgttgacaaaattaaaatattttgttatggaattgtatgtggtgttaaaggtattgtttgtgaaatgtatgtgttaaaaataataaaatttcagagtaattactttcatgttgtttcatagtgtatgatttattttcctagtgagttggtaagctttgtgagagcactggtgtgtcttttcacatcttttgaacctccctaatatacttagcatggcacttcctatagtgggcggcccaaagtgtttgtagtataaaagagaatcctccaaccctgaggcactgaagtttaatctgctattattaataataaggcagcagcagaagtatccctctgaaccaaatgtacataaacaaagaatgttacagggttagaagtgggagtggggagggaggcaggaaaaagctcaccttaccaagaagcttgttaatcctatttttaaacaagacaattctgcaagttacttcctggagccctgtctttgttgttgatatttagtgcagaatagatcaggtatattttgggttaaataaaaagaacatagagattcatatatttgggtacattggggcagcagtttcgagagcaaattacagagttaaacacatgtcctaggaagcctttcctcccacttagtggaagccacagtgtatagggatagagtagtcattttcccatttcttggtcaaagaaacagtgtgtgattttaattggcaaagagaagtaaataaggaggaaggcttttgaaaccccagattccaatatatgttgaaaaacttttgtaggaaggaatttataaactttacaaattattaatagaatagagtctccacagattcaggtcaaagtacaaagaagtttcagtaaattacttattggcaagatagagaaagctattttcaagcaacctagat

SEQ ID NO: 125778 - DNA, 1042 bp, Homo sapiens
ataattatgcagtgtgtgactgggtatcaaatatagtgagaatcaacttgtgatctaatgcttgaatttgataaggagccaagagagttacctatttttggtcccaataatctaaaacaataatacaagtttgtttaactgtgctctgaatcatagcataaccaaaattattggcatatgtaagcatgtttgaattataagctaaagctattttgtcatatttttattcatttattcatggaatcatatgcctttctaaaatttagattgttttaaaactattctcacaacttcagtcattatttctatgtacataacttccaagtcaatacatgcagacctgatctctattgttcttgtgcatttctattccactaaaccagtgccacctaaaacttaatgtttaaaaacaaaattatcttcccctagcctacctcttccttctcctgtcttttctatttttctttatttgctcagttactcaacaaatgtttgagtcaacactgccggaaactaggagtgcaagggtaatataaagcatggtctcactgccttctgaggagcttacattctagtgaggaaaggcaaaccagagaatacagtacagtgggatcaatgttataaacgtatgtacattgtactgtgagaacacaggggtgaggaagtgagaggagtcaaatatggccaaactatagagagtaaaggggaaagtggcataaaagtaggctggagagtttgggagaggtcagatcatatgggacagtttggattttatattaagagcattgggaagcccttggaaggttttaacttggggttcacataatcagatttttgtgttagaaagatcactctgaatgttgagtggggatagatgagaaagaacaatggtggatgaaggagaaaaaaacaacttttgctttttaggaggttactgcagtaattcagcagaaggagtacaggggcctggactccatagtgagctatcttaaactcagcaaataaataggccttcagtaacttttgcttgaatataaagatg

SEQ ID NO: 125779 - DNA, 1051 bp, Homo sapiens
caatccacctaccttggcctcccaaagtgctgggattacagccacaagccactgtgcctggctgcaatttatttcttaataaaataaactagttctagtaatatgcattgttccctaattttttttagaatagaacagttcatcatgtttatctcaaacttctagctccagttaggaagaccaagaaattacttaaggaagcttaagctgatgttagccagattggaaggaaaaccacgacccataagtaaatgcattctaaaccccatcctaactatctttgtccacagaggtggggttaatgctttatggcaggggccttttacctactttatttaatgaaaaacaggaagaaaaacttctgaaataggagtgtgttggtgaatttacgctgcaacccacataattcgaaaaatgattccatacctaacagagtacttttcctgatttactcctttagaagcttgaattacagccaggttgtatggaaatacaggttgagtgtcttaccttaggtatccaaaagcctgtaatctactcaaaagaaacattagtgagttggaattcaaataatccttttctattgttattttttgttacacacaaggcacatctgaaagcacaagagctcagtgttctagttgtgttataataatgaggtcacaagtcctgtactacgatgaggtaggagtgtgtgaaataccatggtggttaaaagcatgggctttggggtggagccaagatggccgaatacgaacagctccagtctacagctgccagtgtgagcgacgcagaagacgggtgatttctgcatttcccactgaggtaccgggttcatctcactggggagtgtcagaaagtgggtgcaggacagtgggcgcagcacaccgagcgtgagccgaagaagggcgaggcatcgcctcacccgggaagcgcaaggggtcagggagtaccctttcctagtcaaagaaagggggtgacagacagcacttggaaaatcgggtcactcccaccctaatactgctcatttccaatggtcttagcaaacggc

SEQ ID NO: 125780 - DNA, 1050 bp, Homo sapiens
aaaaaatagagacaaggtctcactttgttacccatactggtctcaaatgcctggcttcaagcagttctcctacctcagcctcctaaagtgctggaattacaggcataagccaccacacctggccctttctttaaaatatctatcatttactcagtgcccatgtgccaagcactgagctaatcacgttacaatgtagatttattttggtttcttttgtggtgtggttttttttttggcttttgctgactttattgagacataattgacaaaaccgtatatatttaaggcatacatgcaatataatgatttgatatacatatatactgtggaatgatttccacagtccgtttagttaacatatctgtcacttcacctcattaccattttatgtgtatgatgaaaatgtttaagatttactctcttagcaaatatcaagtttacaatacagtattgttaattacagtcactgtgctatatattagatctacaggactttctcccagatccatagaatttctccattatgtaaactccaaaagaatgaaattctgtggatgaagccttaattttactcttgataattaattttagttctgataatttgtgttaaacaaaaaaaataggagggcttgttttgctgcatagttttaaaatatcacctttgccttctttcttgaaaacatcttgcgttttcatttttttattttttaacagcctccaagggatgagccatcattagagatcaatacagataacacgaggatataattactttgtggcctaggatataattatttagctgtcatttatttctcatttggagggaaaaataaatgaaagtattatttatgagccacataaaaattctgtgttttttttccctccttgagaaagcgagaaatcacactaatgtttcagctattttactttgttcaaactggaataatacacaccttgtgtattacgcttttcttttttttagcataatgtaatttttacttggcttcttttaggatgcggtaagaggtttaaaaaggagtttctgttggt

SEQ ID NO: 125781 - DNA, 1059 bp, Homo sapiens
aggcctagaagtgcatatattacttctgcccatagatctttggacaaaatattttcaaatggctttacctaactgcaaaggctgagatatgtagtttagcagtacttttatggaagaagagaggcacaccaatattaatggacactggcagtctctatcatatatttataattgctctttcacaaatgtctctatattccttctctttccacctctgtgataattggtattctccaggatttcatccttgtcctattgttctttctctacatattttcctagggcatcttatatacttttgagtctgaactacccttacaagggtgtttcaaatctgattattcaaatctatgtctctagccctgactaatttatacatcccatctggcaggtagacatagccatttggatcttcacagacatcttgaactcaacatttcttgcttttttcccttcttccccagtccctgaacgtcatctgtaatgtgtcctctttccttgtttttatttgctgtttctgatattgccatgttcccaattcccatgctataaatctggcagtggtcttaacttcctgtttctctctcatctcctgcatctaatcaactaccaagtttaggcaggttttatctcctaaatattttttcaatctatctcacctttttcctgctaatttctacacctctgttttagaccctcttgacctcttgccttgatactagcaataactttgcctccagccttgccttcttcagatccatttctcctcactgcagctaaagcagtttattagtaatgcacattgaacatgtcattctcttattcggaccgttttctactgccttagtgacgtgcccaacttccctcttccctcttctgactgtatgctttgtcttccagaattagtcttttttcctatatacatttttacctgttttatacctctgagttcttgatcagagcctttgatcatactgatcatactgtttatattctgcctgaaatgcttttcctagctttttaaaaatcttggtgacttttttaatctttcagtactca

SEQ ID NO: 125782 - DNA, 1054 bp, Homo sapiens
tttccctgaaagcagacactctgaaatggaaatctgagcacagcaaatttactagggaggcctcttgggaccaatgccatgtaaaggaagaaagccagatttccatgggagaagttggactgtgatacagtttcagtaacccacacggagagctctgaagctgggatggtccctcagagttgtctcaagttggggtgagaggagctggacgtttatatccccaatcattagatgcaagctgccccaggaaggagtatgatcttgggccgaagtgactcctttttgctaggtaattcccaaagagggctgacagctgagggctgtctgccagcagtactccaatagctaggaaaataagcccttcagttatgatgtgggatctggataaggaatatagcatctactacagttatatttattcattcatttgacatatttattgaccacctactgtgtgccagatttccaggcaccaaaggtgcaaagttgggcaggaggtgaaacctgtcgttaaagaactcagagtagagtagaaggattaaatatactttcttattttctcagttattaccatcccctttgggatgttacttcccacctcatttccagtggtccattatcaccctgcctcaatgcaaagaactcttttagatgtttctcacagcttctttttgtaatactagtacagcaatgagaaggagaaggggaagggaaaatttaatccagtttcaaattatagttactttcacagaagtaactgtagaaaagcttccatgttcagccttgctttctccacctagtccttgttcctcactctgctttggtttttcagcatatacaagagagaactaagacaggaaacccctcttaattccatggacacaccccagtgcctcgacttttaaaaaatcacccttcagacacttctaagtttcttgccttcctctcccctgtcacctctatttccatccttgtcctaagggattgtatgaacatgcttttggagtttgtagtctggggtttgggatgggaggggtacaggagagcgggcagt

SEQ ID NO: 125783 - DNA, 1119 bp, Homo sapiens
aaaagtattaatataaggattggaagggaggaaatgaagccatcacttgtagacagtataataacacatacataatttttaaaagtacagataaattattaggattagtgagtttagtgaagttgctggattaagattaaatacaaagtcaattaggataaaatgaaatttcaaaagataccttgtacaatagcacttaaaaatatctaaaaggaataaatctaataaaagattaagaattttatatagggcatataaaacattaagagaaattaaaggagacctaagtcaatgggggaatgtattggatctgttccatattctgcagagaatgcactattgctcagaatctcgtaattagaggtagggaatcagagtcaataaagtgattgtgtactaggtagtaacattttatgtagttatccactgattccacaggtagcattttggctttttaccagtctttgttttataatgaactgattagtctttctcttactaggctgtgaccatagataaactgcagggaagttctgttactgtatctaccgaagatgggttgctgaaagccaagtatctttatacagaatcatcatttctgtcttctgctgctggggatattacattaggaagtgttcatggtaagctgacaaaggcgtaatacatctgagactttccacgtagcataaattttaagagatgactctgtagttgaaaaaaggatcaggaaactggccttttaaataatgaaatgcagactaaccatctttttaaaaaaaaaaccataaaaataaaatgactcataaagctaattttattttatttgtgcaagagattaaagattatgctgttatatatggaactaatagtaagtctaatttttaatgcatttcttttttctttttttttgagacagagtcttgctctgctgcctaggctggagtgcagtggcgtgatactggctcactgcaccctccacctttcacgttcaggtgattctcccaccccaacctcccgagaagctgggactacaggtgtgcgctaccacgctaggctaatttttgtatttttagtggagatggggtttcaccatgttgcccaggctgatctcaaactcct

SEQ ID NO: 125784 - DNA, 1022 bp, Homo sapiens
tgggaaaaatgtaatacttacctctctggtttgttgtgaggattaaatgatagttcatgtgaagtagctaacatggtatctggtgcagagaaaatgccaaataagtgataactattattgttattaatgatgaatagtaactgattattattgtcatcttcatcactgtggatatttagttagctgatcacagtgatttttgattcccaagtccttcatcagtgaagctaccagaatacccaagtatctcttgtttttccctttgagtccaagtggcttatttaatccctttaacagcagttgacatttttttccagttgatgtcattattcgaagcagtgagtttctgtttcattccttattgttcttttgttgctttgtcagtattaatacagaaatattgaaaatgtttcactagtataagtcacacttactctctttttcactatatgtatttttaaatttgtctttcagggtcaaaaattgcatgttcaaacaaaaggaggcaaagtgatctgtctgggaacagtttatggaaatatagatattcatgcatcagataaaagtgtaagattgaaactttctttttttttagtaattgcaactttgcttccatttggctcactaagttggtaggttctacaaagttcgtagcataacattccctttttaatgcattttagttcataagtaaattcaaatttgaaattgaagtgatgaaataatatacaacttaagttttagtttgtggtttaatacttttgacagttacttagttcctagtctggaatcaataaaaacttaaatgcttactatttaactcaagttctgaaaagatttttatttttatgatcatagattaaaatagatgattaagtaatatcaccagtaactggattggatttttcttgtgttaggtttatttgagtattttctaagacctttttacttcgcccttaggcaaattgaaggatgtttcaaaactcagctttcttcagtattttccacaaggtggcaccatt

SEQ ID NO: 125785 - DNA, 1036 bp, Homo sapiens
atgccattgtaggcataaaattaaaaatggtttcttagccttggcaatacaaaccttttcagtcaggtgatttgttgtgggggcctgtcttgtgcagtataggatatttagcaccatctttgccctctaccttttagatgccagtagcatgctcctcagttgtgacaagggaaaatgtctccagacattgccaaatatcttctagagacaaaatcatctccagttgagaatgattgctttatgcaagtccatcattcttctgttttcttatttagtttttttaaaaaacatagttgggaataatttatgaataatgatgaaataactcctaggatgatgaattagcaaaaaaaaattaaaaataagaacactattatcccataatgtatttcaggtttataaaagtccagtggaccaattaatggtaattacaggatagaatgagttttgttctatttttttaaaagtaagtacattttctatttattccttgaaagacctcccaagaaataacagaaatcatgaaatatcagttcttacaaataaaatagctcaaaacaagaaattcatgaaaaattatgcctgtggatactaatggtataccaagggttaagagaattatccttgagatcataggatttaactaacttcaattcacaaatgagaacactttggtaaaatatctggtttaagttttaagtatcgtacaataatatcattaccttgaattagtggtcacctgttgatatgtttctctttcattaacttaaggacttgaaatatagttgacctgcatattaaaaaaaaaatttttttttttgaggcggagtctcactctgttgcccaggctggagtgcaatgacacgatcttggctcactgcaacctccgcctcctgggttcaagtgattctcccacctcagcctcccgagtagctgggattacaggcacccaccatcatgctcggctaattttggccaagcatgttggccaggcttgtcttgaactcctttcctcacatgatccgccccaccttgg

SEQ ID NO: 125786 - DNA, 1671 bp, Homo sapiens
tcgctcttgtttcagcaaaccctgacttacgtctcctatttgacttgaggcggcacagtggccaagtcgattggccgtggcaagtgaccctccctgtggctgaagtgttctgaggactggcgagagaggcgcgccatgcttgccccctgttcaggttgggagcttggctgcttccgtctctgtctccgtcaggtccgactgtgggctggcgctgggcgctggtcttgctgggcttgccaagccaggccgtacagctcaggtaggggcgagcgctggcccggatcggagactgaggtccctccgcctggcccggcgcgccgaactctgaaggagtggacactgcaggtgagcccgttcggtcggctgcgggcgcggctcccgtgccacctggccgtgaggcccctggaccccctcacctacccggatggcgaccgcgtgctggtcgcggtgtgcggcgtggagggcggcgtgcggggcctggacggcctgcaggtgaagtacgacgaggatctggaggagatggccattgtgtctgatactatccacccccaggcgtccgtggaggtgaacgcgcccctgaagtttggcaagtgaagtgaagtgaaaacgggtttgggtcccagggaacgcacagtgaacttaataaatttggtcgacgtgcacttttaattggtcctggctttctaaacctaatttacagttggccccttcggaaatgcaacttttcctctgttctattcttgagtatccgagtagtatttaaaaaattaggttcccaattatagaaattttatacatcgaatggaaacacgatttggtataatccaggtcaaattctatttctggagccgcttgtgttcttctttatcccgttgtcattagcaaactggcttatttttcaaggttgaagtttcttgacaattcattcaatggtatggcagtccatctacatttccccttgctcacagcctgggggtgtgtcccaaaacagccctgtcaataggatgttccaggtaccacctggtttgagtatttggttttagacgggcgcccagcttcttactgttatgtttccattctttttggcctaagttttccatgagtagcaagctttgaagaaaaacacatggtaagcctgcctaggaagcttcaataataatgcctgcaagatacctttcttaggttttcctaaatggcaagccactgtgtacacacacttttctaggaagggctccccagactgtcattcttcctgggactgaaggaagatattgatgatgatgatgatggtaataataatagcatttagcatttttaagatcatcttttataatgcttacagttgcccaaatagtagatgccgtagtcctcccttatccaccgtttggctgtctgagtttgttacctgcctcaactgttgtaggaaaatattaagatattttgacagatcacagtaatataacttttattacagtatattgttataattgctgtatttattattattgttgttcatctcttactatgcctagtttataaattaaacttgatcattgatatgtatacaggaaaaaacatagaatatataggatttggtactatttgtggtttcaggaatcaagtcgggggggcgggtcttgcctactttaagagaaatcatcaatatttatg

SEQ ID NO: 125787 - DNA, 1099 bp, Homo sapiens
cgcactcatttccactgataggaattgcatctgtcctttgaagctccccgcaaatgccatcacttccaagagagctgttttgattctctcctggtctgataccttctcccatgcatgatgtttttatctgttgtcagtagtagtatacttagagatctgggtttctgtgggtagctctacccgtgagacaggcttgagaatgcctgcctctcaattgaattcctataaatttactatctggccatattgtcttaattctttcttttctatactttagtccaagtagactctaaaagcctttctctagggcatacccagagataagccatataaactattgccttctggtccaaatttgtttcccttcagcaaaatggtcctcatcccaacaaccttttagtctggacatacgaaatctgaaatgcttctgtactcttttgctatcttactgtagaatcacaaacatatcaaaccgtaaaaccattgagcaggcccttgctctgtttctgtgcaggaagagacccaaggagcaaggaatgtatacttaccggaaacttactatagacccagcgtgatatttagttacgaataatacagagaaggaaacttggaccttgttttcaagaaattcagttggttccaggcaccaagcactgaactaagtgctttattaacatgatctaatccattccccgggggctgctggagatgttggctgactgtgtttaccctccagatctctcatcctaggttttcatactctgcacaccatcctcggggtccagtgtctccctttgcataacctgctgcattgcattgacagtggagtgttgcttctcactgaaacagctgtcataaggctcatgaaaggtaagaagccctgagtttgccagagtgctagttccagcctgagcaccaccaaggctagcttcttgggtgtgcaacctgtgcagtcaccaagagcctggctgcactcagaagagtgccctgctcagtttaatgctgcattacatcttgaaattcttagtagtatttgaacgagggcttgctcgtgttcattttgtgctgagccccacaaattatacagctggtcctgtga

SEQ ID NO: 125788 - DNA, 1049 bp, Homo sapiens
taaaagattccacccattcattttatttattgtttattgtttctgccttttctactagtcttaccaaatccataatgtgtttttatttatttatttttagagatggggtctctctttgttgcccaggctggagtgcagtggcatgatcatagctcactataatctctaattcctgggctcaagcaatcctcccgtctcagcctcctgagtggttggtactacagtcatgagccaccatacccatccagtttcttattttttcttatttttttttttttttgtagagatggggtcttgctatgttgccaggatgatctcaatctactggcctcaagtcatcctcctgccttagcctcttagagtgctaggattataggtgtgaaccaccatgatggaccataattttttaatggacaacaaaccagtgaagaaaaattttgaaagaaatatcatccataattctacagttcctaatgtaccaactgtctcttctcccccatttcctcttggcctttgttataggtatgcatattttacccagtagtaattgtgatctacagatattagataaattttagaaattatgttattgtaaacattttttcatgttgctatgtaaacttataatttctaatgactccataggattccactggatggcagtgtctttttctttttattattttaaattagtaagtgtgtgaggaaaaactctgtccaaactgtgttttccctctctctcacactgcaacaataatcatcaacacagaaaaacacttctgttaccaaatgtgtgggaattcttcatgtaccaagcagcagacaccagctgggtgtcctttaattcagttctgacactatctacctagagacagtgtcagatcccacaggttgggggacatagtccccaagactaccctccacacccccagataacaggtgcaagtccagacctctggaacttctgaccaactgtctttaagttggggttcccacggtacctctttaggtttgattaatttgctggggtggctcacagaactcaggga

SEQ ID NO: 125789 - DNA, 1083 bp, Homo sapiens
gagggaaagcagtaaattgatagtgaatgcctcaacctgtccaaatgctactttggagcacattaaaaaaaaaaaacaaaactctatcggagtcagcagctaattaaatttcattctcttgtggttttctaagaaactatggctgtacagagattgatgagatacaagataggatcttgattctataaccttattagtgatttttttttccagtaagatgtaactttcttagcccagttttgtgttggctggtttcgtatgaaatgatataatgtcatttgggtagatatggtactaagttattcttctcattgtaaaaagcagaacctgaacattttagtcagtagataaaatcatgatggttaccgttttgaggatgagggataagacaatgaaaactttgttggtttgcgtgttttggttgcattacaatgctgtcatcatcttattaaaccacatcttttttccccctgtttcaaaaaaaatctactcagcttcttcatactggagtgtatattcagagacaagtaacatggacaaactattgccacattcctcagtgctcacttggaatacagtaagttaacactgtgtatgctgtatgcaaataaaatcaattcacagttgtgggtcagttgttggacacctctcttatagccatcaaggtcgtgatttcactactgttttgactgataaagaactcagttgaattttttttggcagaaaagtaatagcaaatccctgctattggccaaaagtatttgtataaaaacagtaaaaccaaaggagcaggtacacagggtatttattattcttcctattaccaggcagaactaaacctctatcatggtatttttattttctaagtgactagagtggattaaaatatgtactgagtttttataagtgaggaatgggtggattgctgctatcatacttggtagataaggaccttcacgacccctttttccagccccattaaaaagtctgtaataactctagagcttcaggatcagtaaaagtcagcaatcttaggcacattcaccccaaatgactttttctccctgtcggttctgactccct

SEQ ID NO: 125790 - DNA, 2087 bp, Homo sapiens
ggtgggggtggggaacttgggaacaatagtcctggtggggcggaggcgacgctacgggccgaagccctgaactgggagataaccttcccagcgcccccccgcctccgccaccccctactttccgccctctgcttgtgcaggcagtcttgagaggaggtgaaggttaaaagtcttgttcatgaaattgctctagatacactattgctttagcacactgtgagggggtcagatccgaaggcgtgagaccagaagtcgacttcctacgttacccacccccccaacccccgccctttttatttttctgctggacaatgttccctctagggttgtttcccggcttaggaggcggtggttgcggctgctgctcctacggatattgcgcaagactggggcgttggaaaccctgtaggtctggggaatgaaaaaggaagtgggactttgggaagtggttgctccttagtcttggcgggggttgggaatgggaaataagctggggaaaatttttatcttgggtaaggtacacctcgaagaataatcacttaattctgaaatctgattatgagaaggatacacagttaatgcctgtaaaatgaatgggcagcaaacattggctagtttttattttttgtttaaaaagtacagtagtttttatggtggaggtgatatgacttagtagtgaatactttttcacgttttaaagagactggtctagtaaagctttagcgttaaatttttaacagcttataaaataggcccttgaccatacacagtattatactagcatcgttgagctttgtgattcccgcctccccagaccaataatagaggacggaagtaaagttttctcagtatcttttgaagattgaaaatataagttaaataatctaacttattccttattaaaaataaaaatattgcttatatttaaacatttgctcttgatatttagcctatgtatttttgaaaaattactttttgatctgaaagggttaaggaaaacggcattttccctttttactattgagagtttttattgtcttggtatcttttgaatggtgtcatttacagcaattggatggagtcccttttttactactttctagcaaaagtagaagaaaatactttgaatatttaagatgtttaaaactagtttttttgggttttgttgtttggttggttggttggttggttttttttttgagacggagtctcgctctacgctctgtcgccccggctggagtgcagcggcgcaatctcagctcactgcaacctctgcctcccagattcaagcgatgctcctgcctcagcctcctgagtagctgagattataggcacgtgccaccacgcccggctaatttttgtccgaagtagccgggactacaggcgcaagctaccacgccctgctaattttgtatttttagtagagatggggtttcgccatatttgcaggctgctctcgaactcctcatctcaagtgatccatctgctttggcctcccaaagtgctgggattacaggcgtgagccaccatgcccggcctaaaactagttttttaccgtcttactttggttatggaagaagagatggtgtggtccctggtcatttcttgtttgcatgctagtcaccttgttatccctaggcatataccgtcaggaaggagcattgtttggtgatgcgggccatcaggacaggttgcccagcctctgaactcctgtactggagaagtggccttagggttcatgctttggggatgagtcagggattcctattggagagttcatttctttctttctttctttctttcttttttttttgagatgtaacacctcgctgtgtcgcccaggttggagtgcagtggctcaatctcggctcactgcatcctccacctcccaggttcaagcgattctcctgcctcagcctcctgagtagctgagattacaggcgcatgccaccacgcctggctaatttttgtatttttagtagagatgggatttcaccatattggccagactggtcttgaactttcatctgactgactttgtgatctgcccgcctcagcctcccaaagtgctaggattacaggcatga

SEQ ID NO: 125791 - DNA, 1704 bp, Homo sapiens
tataaacatttaatacatgttcataaacttgaaaaagttttgtcagtttatacaactgtcataatgtatgagtgttcatattataattttcttgatctttatttgatggttgaaaactgatatcttgttttaacttgaatttcttgattactattgaggatagaaattttccacctgtcattactattctatgagtgtctattcctggccttggttgtgccccatactgttaaagaggagacagctaaggtacccagactgtgcagaactatgttgcctagatggttatttgcatgttgaaaacatgctaattttgctaataaattagcaaatagctaatttgtggctgatccagaatttgatctcaattatctctacttttaatatttacaaaatgagagataaatgtataaagtagggtggtgcacattcatgtttgacagacctaggttttaactccacacagactccctctgatggctgggggttggggaggtggtcctggaccatactttgagaaccagtgagctaatacatggtaaatgataaaggtaatgctgggaaagttaggtagaggtctttttgtgaaggatcttacatctatgctatacttagattttattctacagaccgataatagcaattctggacagtctgcattgtaactcctagagacatggagaaagtagggaggtgttaagaaaatagacatgctggtccactccagcgtcattcccccatctcaccttctccagcctgctccttgagttgtactctgaaccttcacttacttagataggttctggtagaaaaggtgagaatcattagtctgggtttctggagcactactgagtcttttaagaaaggtaaacagtcatttgtgttttacaaagttgaatctgatagcagtatgaagggtggcattttggaagctgttgaaatataagaagtgagatgtgagggcctgaagtgaactgagatggggaaatagagtgtatacaacacatctgataagaattaagaaaggagtctcaatgattcattagatgtaggtagtaaagaagaaaagagtatagtgttatgactcgcaaaatatctagcttggtatctgtcacccaagctagagaataccatttggtagagtaaggagtgagggaggagaaacaagtagaggagaccaaacaacattgtaggaggaagtttcagggggagaagaggataaatttaattttcaacatgttaaaactgcggtgcctctgagacatccagtagaaatgtagagctcaagatttctgacaggacggagttaaagatgtaggcatcataatataagcatgtaggagatagtcgacagcatgggagtgaatgagcttattccaacaaacttatagagtgaccagctttaggttgaagaacatcagtcttaaaataacagccaaaagaaggatatactagtgattgttcctgagaaggtgtggtcaaggaggagggaggagaaccagagatgtcagaaaagccagggagagtttcaagaaaggagttattaccagagtcaaataatgctgggaggaccggtaaggtgaggttgagaaagtacctattccatttggcacataggagtgctttggtgactagaaaaaacagtttgggttggggtatgggaagaagctagattatagggtgaagggtgggtttagtgtcttt

SEQ ID NO: 125792 - DNA, 1011 bp, Homo sapiens
gcttataggtttaaaaaaactaataatagctttattgagatataagtacctaccataagatttattcatttaaagtctatgattcactagttttttattacattgatgaagttatgcaacaataaccataatcaattttaggacattttcttcactttctgtacccattagcagtcactccccgccttcccataagccccaggcaaccacaaatctaccttctgtttccatagatttaagtattctggacattttatataaatggaatcatacaatatgtggtgttttgtgactgactccacctaacatgatgatttcaagtttcatccatgttatagtattgatccgtagtacttttggcctttttatggctgaataatattctattgtatagataccacattttgtttatccattcatcgtgttgatgggtatttgaattgtttccactttttggctaatgtgaataatgcagctatgaacatttgtgtacaagtttctgtgtggacacattttcaggtctcttgggtatatatctaagtgtggaattgctcagtcacgtggtaacactatgtttaacattttgcggaactgccagactgttatccaaagctgctgcacatattacattccaatcaggaatatatgagggttccagttcctctacatcttcaccgatacttgttgctgtctttttgattataggcatcctactgggtgtgaagtggtatcttcttgtggttagcttgtaagattttgtgtgtcttaatttgtctttcaaagctagagtgataggaaatattttccagtccttgcatttgagctaatcttagtgcttacccagtgccactggtttagttatggttttcttatccatcctttgatgagtattcacctaaacatatttacatcaactaacttcagaagtggaagtgaacttttaagtaactctccagacatggttcactgagacagtaaactaaaaatttactttaagcattctcaagaatg

SEQ ID NO: 125793 - DNA, 1045 bp, Homo sapiens
tcttagcctggcattccagaaccttcttaacataatgtcacagtacctttccagtgttaaacttctatactctggtatgtatcctctcttctttttgaaggaagctattcctggtccttgagcatacctactaaatgaatgaaatcttgcttatctgtggttgtactgttgaacatactttttccctcagaaagcttcccttttattttattttattttatttttttgagacaaagtcttgctttgttgccaggctggagtgcagtggcaccatctcagctcactgcaacctccgcctcctgggttcaagcaattctgctgcctcggtctcctgagtagctgggattacgggcgcccgtgaccacacacagctactttttttatttttagtagagatggggtttcaccatgttggccaggatggtctccccttttattttataaaccagtacttggaagatgagaaagctaaaaatttaaaatgacttcaccatgttcaccaaaaactcagaagcaaaaatgtgattaattctcaccttctagaataaatattttagcacagttaatcttaaagcactttttctcctttgtaaagtttgatctttaatatcacaagaaaaaaagcctttcattagatttgagttgaaaacttgataaggtaaatcaggtgatatgcaatttctaaaccactagtcttttccaaatatgagttgaactcctcttccagcattttatatttcctgtagtatttaagtttctttagattcatgcagtcaaaccttgacaattatctccttccttctgaaatcacacaaaaatcttgtttgcatttgtacagtattgtagggtctgtagctggcctatggcagatataagaagcaaacagtagttgctccctaaaagttttttttggagaaagtggagtgtggactgtattagtccattttcacactgctatgaagaactgcccgagactgggtaatttataaaggaaagaggtttaattgactcacagttcagcatggctggggaggcctcaggaaac

SEQ ID NO: 125794 - DNA, 1052 bp, Homo sapiens
aactgttgggggagtagctaccaaatttgataaaaactcaaaaattcgtaataattcagaaattgagaatagcggccgggcgtggtggctcacacctgtaattctagcactttgggaggctgaggcgggcagatcacgtgagctcagaagttcgagaccagcctggccaacatggcgaaaccccatctctactaaaaatagaaaaattagctgggcctggtggtgggcgcgtgtaatcccagctattcgggaggctgaggcaggagaatcgcttgaacccatgaggtggaggttgcagtcagccaagatcacgccactgcactccagcctgggcaatagagcaagactccatctcaaaaaaaaaaaaaaaaagaaaaagaaaaaagaaagaaaaagaaaatggtaaggatatagaaaactagtgtttctaggtccattaaggggagggtaaactggtgaagcctgttttggaaggcagtttggccacttctaatagaattgataaatgtacatactctttgatccagcatgtcaactttagggatctttccgtaaaaatacttgcatatgtgcataaaatagtatgtccaagtatgcaacaatttttgtgaaacaacctaaaatagctattagtaaggagactttgcataactggttacctaaaaggaaacagatgtggaggggagagagtttggctttttcattttatacctgtatgcagaaaagagtaacatagcaggcctaagactactatccttagaaaggcctgcttacaatgttatcccttggctggtgtctgggaacttagacttttgggagaatttccattatcccctgataagagtggttcactgtgcccaaactgtacaaacaatgtggtttatgagctgggcccagtggctcaattgtgtaatctcagtgctttgggaggccgaggcaggaggattccttgaggccagcttgggccacatagtaagacctcatctctacaaaacatttttaaaaattagccagatgtcatggtgtgcacctgtgtagtcttagctactttg

SEQ ID NO: 125795 - DNA, 1637 bp, Homo sapiens
gtggcacgtgcctgtaattccagctactcaggaggctgaggcaggagaattgcctgaacccaggaggtggaggttgccatgagccgagattgcgccattgcattccagcctgggcgacagagtaagactctatctcaaaaaaaaaaaaaacaaaaaaacaaaaaaaaccagtgtacctagcacatagtaaccaatcattaagcttttgcaaaataaccagtatacctagcacatagtaaccaatcattaagcttttgcaaaatacactccacttttctcacctgttgtcttagtctgttcaggctattacagaaataccataaacagggttgcttattaataacagacatttgtatcttcaaattctagagactgggaagtccaagatgaaggcaccagcagatatgctgtctagtgaagggtcactctggctcatagatggtgccttctcactgcacttcacatggtggaaggggcaaacaagctctctcgggcctctttagtaaaagctggtaatcccattcacaaggcataatctaatcatctcctaaaggccctaccacttaatactgttgcattggaatttatgttttaacttatgaatttgggaaggacacaaatattcagaccatagcaccagtctgcctcagaataggggatgacatggctttctggatacttcgtattaagcaagataattttaaggtgatcctacattgctctggaattattcatgcacacattcaaagagttagcctgtccactttctttttctgtcgtctagccgtaggtttctcttttcatatgatgtttcattttcttctttgtttttgaaacggtgtcttgctctgttgcccaggctggagtgcagtggtgcgatctccgcacactataacctctgcctaccagcttcaagctattttcctgcctcagcctcccaagtagctgggattacaggcacccgctgccacatccggctaatttttgtattgttagtagagacgtggtttcaccatgttggccaggctgctctcgaactcctaacgtcaggtcatccgcctcccttggcatttactcattttacagaaagcttctgagggtgtactgtatgctgggaatgcaacaaaaaacaaactggcaaaaatccctgcccttgtggagcttatatgttagtcaaggtgatggacgatacatattaacatatatggtctgtcatgtggtggtaattagtgttattgagagtgtggttcgaatgagggatagggagaaagcagagaatagaagggtaagtttacagttttggctggggtagtgggaaaggttagtggtgtagtgttaaactggtcctctgaaagttctgatttgtattgtttgctgatttctgtgataaatggattatttaccataatcatcacagcaaaactctgaggtaagtactgttatgtgccattttgcaaacaggaaactgagacagagaggttaaaaagcttgtcacacagttaaatattgtggggtaagaatttaaacacaggcggttttaaagccttcactagggtgattttgcctctcaagggacacttagcaatgtctggagagatttggttgtcacaactggggtatgggagtggacaggctgc

SEQ ID NO: 125796 - DNA, 1024 bp, Homo sapiens
tataggtgatggctatacaatgtttactgtaaaattctcaactatgctgtgtgttggaaagtttacattataaaatgggaaaaagcaggtgtgatcaacttttaaaatggtgttaaacgcattcaatatttaaataattataaatatatttttaattaatagtgctatttataattaggtaaatatcctaaaagtgatattttaatataatttcagaagtcacaaagtaaatctgtaagatttacatgatttaattcaaaccaaaaacatcatgttaattggaaccaatttaatttgttgctgtatagttagcccttgtttggaaagtctaattttgataatttctttaacttacacatttaatattgaaactacttttttaggcaagccaattatacttctcggtgcaaaattcttgaaatctgtattttattaaaaagtaaaattgtgtttaactgatacgttctttatctcactccccaccatcactttttagatcattgtaatggcctgccgagaatttgagatgggaagggtatgtataatctattcctcttactatttcatttttacggataaatattcttagtcttttattattatagtcttaacataagcggttaatgtagatacttcttttattttggggtactgctgttgcttttatttcatacaagggacaaaataatctctcaagcatgttgttttcttttatattttgtaagtatgttttatcacacacaggcatacctcagagatattataggttcagttccagaccaccacaatagcgcaattcaaacaaattttttgttttcttagtgcatataaaagtcatatttatactgtattatagtctgttaaatgttcagtagcattatacctataaaacacttcatgccttattttatttttttattttttctagacagagtctcgctctgttgcccaggctggagtgcagtggtacaatcttggctcactgcaacctccgcctcccaggttcaagcgactctcctgcctt

SEQ ID NO: 125797 - DNA, 1034 bp, Homo sapiens
tatcttctctcctcctttgagtaccttctccttcttttagtcttaggctttgtttacatcaaacttctcaattccccacatagattatacattgaatctgctgtgcttatgtatatttccttcactttttatgggataaccttcttttgatatccaactatgttgtagctgcacacactcaacagttagccatagcctctttattccctgtatactgcagtcatactttggctggacataactgtctccccatcttgaatgctgagggtcaagaacagttttgtttccacagtgccaagcacagtgtctgagatgcattaagtggtgttcaataaatgtttgcagtaaaccagcaggtatttaagttttatgtgaaaagctgaagaagattttactattttctgaatagatacacaaagttgatgtattaaattttctgttttagaaaataccagaggaatttaatgtatttaatttaatacaagaaatgagaacacaaaggcattctgcagtacaaacaaaggtatagttgtttgtttccctttataaactgctattttataaatgctttcttcttttttaaaatgttgttttcattttgttttttaatcatttttctccttcataggagcaatatgaacttgttcatagagctattgcccaactgtttgaaaaacagctacaactatatgaaattcatggagctcagaaaattgctgatggagtggtaggtgttcttggtctattaattttaggaaacttttactctttgttaagatgtaatatttagccttttttttgttgtcttgtgttttgtctaacatgagaagaatatccaggacacttaacatttttacttaaactcatttccttcttattcgtatctgtattatgatggctatttaatgactccgatataaggtaaattatgttctaaatgaaataaagttaggaaagatctcatgtcaaaaatcatataattcgttaatgttttacttttttaaaaaataattgcattgttctctttactcttc

SEQ ID NO: 125798 - DNA, 1617 bp, Homo sapiens
aaattttagaagcagctataaaaaaatgttgaaagttgatgcctctggctaacaggagggctgcggggcagagactatgtttttcattcaaagtcttgtatttgactttttaaacagtatatgtgtattaccttgatgaacattaaattttcttagtctgaaaaactgcagtttttattcgcaaccagattgtaatggctcttaatatgctactcttagctacataattctcaggtatcaacttgtttaacagtcttaaaatgccctttttaaatgtttgtttttcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaaggtaataatatagtgtcaaatacttaaatgtctttcctatgtgctagtcactgttttaagcactttagctgtattgatttattatgttttattccacactctaccatagaacctacagcaaaatctgtcttagatactaattttttaatataagcttttaatgtattgttaacaatttggtcacattatattactgggttttgtgtttctaaattattttagtagttataactggataacttattttctttttcttctgtattatagatcttagtgtttttgtatcggtcaaaaatttatctgactgaataattagaaataatttagggaagaatcacttaaaataacagtggcaaaaa

SEQ ID NO: 125799 - DNA, 1027 bp, Homo sapiens
ttgtgataaaattggttttatttccagcataagatttttaaaagaagcaatcattttcagttattccaaataaatttacaattgttttgcatttaccaagttttgtttggcttaaattctaaattcccttgtggaaatttatttgttccagaaaatgagaatgtctgtggacatggtttttagtagtttgaaagtatttctgaacactgactagttattgtggtgttttcactgtaggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaa

SEQ ID NO: 125800 - DNA, 1050 bp, Homo sapiens
agaggaaacccctttctctctttcctgaaatttggagaaggcgatgtggggcagtaattatgaagattgtaagctttcagctcatattttgcttattcaacatttcaggtaattcaggtaaattgaattctcaactctttatttttctgagaccaagtctcactctgttgcccaggctagaatgcagtggcgtgatttcagctcactgcagcctctgccttctgggttcaagcaattctcccacctcagcctcccaagtagctgggattacaggcatgcaccaccacgcccagctaatttttgtatttttagtacagacggggtttcaccatgttggccagtctggtctcaaactcctggcctcaagtgaggcctccacccacttcagcctcccagagtactggaattacaggcgtcagccaccatgcccagccaaattctcacctcttaaccagaaaattgtctcactacaaatatagcctaaccacttgctcaaccacagtcttctttccagtttgaatgtgtacttaaggagagcaaactgggggaaaataaagttgaaaattgtagtacaggcatcagccactgcttaaaggcttcactgaagagccattagcagccacacagcaggaagcaaaaggtagagagagtaaaaggggccaaatagagtaaatagaaactatccataaatgtctctcctggggttaattatgctgccagaattttcatatggaagaacatcagctcattttgatacttattttaagaaagggataggaggcctataaaatgtgtatcaggagccttattcaataatataaatctctgaaaagaaaagcttaagttttgtggttgtttaaaaaaaaaaaaaaggtttgtggttccagtcaattctccaggaagaggaagctattttaggtaagaactggtaggtagagagtaaagtgtatttatccacaccttgaagcctaggtctggcaaagaaatgtaaggaaaaatgatagactcatagaatgtctgaattgcaaatgcagccctgtacgtaatttg

SEQ ID NO: 125801 - DNA, 1474 bp, Homo sapiens
ggttttgtaaaagatgcttgattgattgttagaccacttagacgtggtcgcgggaattcgtatttgtgacacagcgttcaaccccggataatcctgtcaaaaaaggggtgtggagagagcactggcgtcagctggaagctaccagaggcctgagcttttcatccctattagggaaatgaggtagcgtgcagggcccgaagtgcgctgtttcgtaaggtaccctccctgcaccctactctccgctgcgtattcttaagtgttttgggtggtcctgtttgaaataccacccttctgaaagaattttcagccatattctttttttccctgcagcaaatgataaaaccaggagctttgacgatttttcgccagatcaagcggctgcagaatgtttgagcattagaaaaaggcgaattcttaagggttcttgtcagacagggtcagttttgtttttaaatgtaggctagtcgtataatttttcaggtgtttccaccacttcagctacggatacacaatgatctgacaatagtgcaacatacggactagttgaaaatcaaatctttatgtgatcgcaagcttaaagcgcataatctttattataaatgtgcactgctacacagtgttgtcaaataactctttttgttttttagaaaaagaaatgtcaagcagtttcagcattgctgatctaacagtagctcagatcatgaaaaattctgtttggattataatggtttgttttcacaacttaaaacatgctgcatgtgcatgtagcaatagtgtcacttcttccttgatattttttgcctgtagcaaagctttaacatctaagcatagccatcagggactctggtgcaatgtaaatatctttcagcttctgggagtgttgtttctaggaaagtggttttgaggatgggattttggtacttttagtcaggaattccaggtgattagtattttaaagctattttgttttaacaatttatatgtaaaatttaggagataagtgcctggaagtttgtccatatgcagcttggtatcatcactagtgtttgtggtgtgtaaactgcacatttgctgtaagttctctgaaagaggaagtgaatatgagtattacatagttggagtaatggaatatttgagaagaaataagtaagcattctttaacaattctaacttaaaatgtggagtacacaaatggtccttaaagtgaaatggctgttaaagaggaatttttatagtcttttcaattacatttagaatccttcttcttttgagggttaacactaatattattaatcctgaatataaacagtgataggttttacattaagatgtgggaatgatcttttcccatgacctatgtgggttttttggagtagtgacaagatattaacactactgtaagattttcattttttcagacacaaatgctatcttgttgaggaaaaactatcagagaaaaagattcctttccagt

SEQ ID NO: 125802 - DNA, 1045 bp, Homo sapiens
tatttaataataatagctacatttgtccagtgcttaaaattaggtattgtgcatagtgttggaaataatgcatatgttgccttgttataaaaattgtaaaaggctgggcgtggtggctcgtgcctataatcttagcactttgggaggccaaggtgggtggatcacctgaggttgggagttcaagaccagactgaccaacatggagaaaccccgggtctactaaaaatacaaaattagctgggcgtggtgctgcatgcccgtaatcccagctactcgggaggctgaggcagagaatcgcttgaacccgggaggcagaggttgcggtgagctgagatcgtgccattgcactccagcctgggcaacaagagcgaaactccgttaaaaaaaaaattgcagaagacaagtgttattatctatacagatgagattactgaggcacaacacggttaagtaacttgcttcatgtcacttgatcagttattggcagagctagaatttgagcttaatatgtataattacaaagcctgaattatttctattatatcacaatacatttggggtttctttctttttcattttctttttcttttttttttttttttttttgagacagagtctcactctgtcacccaggctcgagtgcagtggtgtgatcctggctcactgcagcatcagcctcccaggttctcatccctcagcctcctgagtagctggaattacaggcgtgggcgaccttgcccggctacattttgtatttttagtagagatggggtttcaccattttggtcatatgacctcaagtgatctgcctgcctcggcatgccaaagtgctgggattacagcggtgagccaccgtgcccagcctactgctttttttcttatgtggatttaacacttatttatggcccgctttgtgcttgggtggtggtggaagaaagggagatacaaagaggagaactttctgtttcttgccttgagataatttttaatttaattggagagataaatagctgcaatgtaaaagacactgctcattgttggtaat

SEQ ID NO: 125803 - DNA, 1048 bp, Homo sapiens
attatggagatgaagatgtggagtttggcagaggggttgggttgggagattaatttggagattagtttgccacagggttatagtttacatcatgtgagtgcatttttagaggcaatatagagaagagagaggaatgcctaggagagatcctaggtaaatgtgcaggtttggatggtgggattatgagaatgagggaggagtcaggtaggatagtacagtttcagtgaaacttagggagaaattttgagaaggaattgatactgttatgttgcagtgaggtccacggaaaaaagggctgagaagccactggattttttagctttgattagctgtgttagcgaggggctgtgataaatcacttctttcccatttactgtttgtgaagtcctttctcttctttttactgtatccttcatctccttcaatttttattttagtgtatgtaattgtaatcattttgtaatgtaactgcttttccttctgcttcaaattctttacatttctcttcttctgccgctgcttgttctctcatctatttctagccatacattattcctggaaggaataatgtaagagagggaaggtggggaatgtcattgttgtcgttcagttcagttgatttcatggactgcgttattatggtgtgaattatggctcatggctcatattcagggcaggcaaaactgtgatggtgtgaagcttgtttgatgtttgtgcagcaacaatatattgtgactgaaagctgtagtatgaaattctaacatttctttctctcttctttttttttttttttttgagacagagtttcgctttgttacccaggctggagtacagtggtgcaatctcggctcaccacaacctccgcctcctggttcaatcggttcttgtgtctcagccttccgagtagctgggattacaggcatgcgccacctcgcctggctaattttgtatttttagtagagatggggtttcactatgttggccaggctgggctcaaactcctgacctcaagtgatccacgtgccttggcctcccaaagtgctgggat

SEQ ID NO: 125804 - DNA, 1065 bp, Homo sapiens
tttgtgtttccttgatgacatcaggtgtggagtatcttgtcctatgcttatttgctatctgtatatcttctttggtgaggtgtctcttaaggtctttagtgttttttttggtttgtttgttttttttgaggcagggtctcactcgttcatccaggcttgagtgcagtggcacgatctctgctccctgcaacctctgtctcctggactcaagtgatccatctcaacctctcacctaaaactcccacctcaacctcccgagtagctgggactacaggcacgcaccaccgtgcccagctaatttttgtacttttagtagagacagggtttcatcatgttgcccaggctggtcttgaactcctgggctctagcagtccgcctgcctcagccttccaaaatgctggtattacaggcttgagctactgtgcccagcctggtccatttttaattgtttgttttcttattattgagtttaaagagttacctttttttggataataaccctttattggatacatctttaccaagtattttcttatagtctgtggcttctttttagtcccttgactgtgtcttctgcagaacagaaaattttaattttaatgaaatccagctttatcagttcttttttttaatctattgtgcctttggtgctgaatctaaaaagtcattgccaaaatccctggtcatctagattttcttctgtgttattttctagcacataccacttctcctagtttagacttttttttttttggtatgtggatatccagttgttccagtaccgtttgttggaaagacttctatctccatcaagataagttgattgtatttaagtggatctgtttctggactccctattttgttccattgatctgtttgtgtattcttttgcctataatacattgtcatgatttctctttttatttttaaataaaatgtgtaatccttatatttagtttgacttttcagagaatttcttgcttttatggtgttagaattcttacttttattctgagaattatgatgagaagatcagttacgaatttttcccaagcctgagattaa

SEQ ID NO: 125805 - DNA, 2464 bp, Homo sapiens
ggacctgggttatggtagtgtttatagaaaggaaagtaaggagtgatttttaagagattatgcagtatgcatgtatactatataatctctactatattccaggacatttcacagttcttgtatacttccatcatggttttgtaatcagtcgtaagctttttgagggcaaaggtttatgtcactatttgtatatccttctctgtattttgtcttttgctgggtgcataggaagtcatttgaacaaagaagaatttaataggctatcaaatattttgtttgaagttttagaatgcaaatgaatgatccctagagttattatgccctttatttaaatatcacagtatcaccaagtagtcagattgagtcatactatttttaaaaggagccaagggtaagggaaccaacatctagtcttatgtatgccaggctctatgtagtcattttatatattttttcatttagtccttatagtaaccataatgaggaaggtatcaattaccatttacagattaggaaactgagatcaagtaatttttctgttatgctgctaatccatagatgctcaatttcaacactggcacttttccatcgtagcttttgcttcacctaaagttagttattttaagtgatttgaaataaatttaatattttggttgacacgaagtgaagaatacttagaataaaatgtataatgatacattttgacaatatgtatttcatattcaataaaaagggaaatttagaaatattccccaaaacctgagaggaaaaagaaaaggcattatttgttcctcattctgattttctttgtgtattgtaattccagaaatttacctatagtttgtgcagataaatgaagttgtaattttttcattttaaatatttcctttgttttgtcttccagataaaatcaaagacaaaattaaagagagagacaaagaaaaagaaagagaaaaaaagaaacataaagtaatgaatgagatcaagaaagagaatggagaagtaaagattttgctgaaaagtaagttttattcagtgattttagttctactttattatactgttcagtatctttattggctaagtgaataaaataagaaatgttatttggtgctgaattttgcggagaatgaacaatgatgaggaaatgaaaagtaaatgtaacaacggagagttctaatctgtatggtaacatgtcttatagtatatttagtgagccattaaaaagttaaaaggttaagcttcgttaaacttaatttcttaaattattttaaaataagttaattctatgtttgcattactagtcttactcatatttagataatctaaaaggaagaaattaagaaaaattgccaaagcaagttttagtatgatagggatggtgaagtaagtgatcttcttaaaaatatttgactgtcatcaccataccatagtctagcatttagagggaacattttactctgagctaaatcagaagcggtatgtttcttgtatgtttaagaatatccttgttttattcttttttttctctgttacagttgcattcatttgctgtttatatatgagggtggggtggagagaagaatttggggggtaggtggttgggtaataagtatactgcaaatcctgtcaataagtctgaacttgtaaagagagaatttgtggtagaatagacgtaaggatagtcttaaattcactcagatgtcaaggtaagaagaatccgtggcattcggttgctagacaactagcgaattcactagctagcaaatttactagtgctatcatgttgatagttgatgatgagaatatgttgaccttgattaacttcatattgaatttaattgttgataaggctttatatttgcttgagggggaaagaccacgacactgcatatgtagcaaaataactggtagtttatattatctaagataaagagtattagattctgtattttcattgcattctttgtcatgttttcagatattcgttttctattatctacatgtcagaacttcattttctacgatattctttcaaccttgaagaaatacgtcagagcttaagttgatggctgcttattagttaatgctcatgatccttttgttctgtttcttttgcctgcatattctatctgtgttgtctaattagattgtaagcctttgaggcaggaattgaatataaccacactagttatttatagcagctagtgatgaatgcttgaaaagtctgcttaaggccaggttcggtcgctcatgcctgtaatcccagcaatttgggaggccgaggcgggtggatcacttgaggtcaggagtttgagaccagcctggccgatgtggtgaaacctcgtctctactaaaaatgaaaaattagtggggcatgatggtggacatctgtaatcccagctactggggaggctgaggcatgagaattgcctgaacccgggagacaagaggttgcagtgag

SEQ ID NO: 125806 - DNA, 1128 bp, Homo sapiens
ggcgacagagcaagactctgtctcaaaaaaggctgactaaatattgattatcaattctgtaaaaaatgagtcctaaatatataattctgagtaaattttcagaagtaaacttcttacttagacaaaactgttcctaaagcatggtttttaaagtaattaaaatatggagtttcaaaaaacattttttccaacaggtgggaaggagaaaccaaaaacaaatatagaagacttacaaattaaaaaggtaaagaagaaaaagaaaaagaaacacaaagagaatgaaaaacggaagcgtccgaaaatgtatagcaaatctattcagaccatctgctcaggattgctaactgatgttgaagatcaagcagccaaaggcatcctaaatgataacataaaagattacgttgggaagaatttggataccaagaactatgattccaaaattccagagaacagtgagtttccatttgtctcattaaaggagccacgagttcagaataacctcaaaaggttggacactttggaatttaaacaactcattcatatagagcaccagcctaatggaggtgcatcggttatccatgcctacagtaacgaactctcccacctgtctcctatggagatggagaggtttgcagaagagtttgtgggtctagtgttcagtgaaaatgaaaactctgcagctttctacgtgatgggtattgttcatggggcagctacttatttacctgactttttagactatttttcatttaattttcccaattcaccagtgaaaatggagatattgggaaagaaagatatagagacaacgactatgtccaattttcatgctcaggtaagaggtttttagttttataaaataacttttaattatatatttttagatgagtttctgttttttgttcctaattatagggctgaaataaaaaggtaagaatataatgaaaccatttgggagtattaagagtaaattactttcttgatgtgagcatcagaatttaaaattcaattttcacttatgtatgtttttttttaaagacaattaatgaaataattaagattctgtgtttttttttttttttttttttttttgcaaggagtggtcttgaacctaaggaaatgaattta

SEQ ID NO: 125807 - DNA, 1056 bp, Homo sapiens
ggctatttttttagttaatggaaacgtagttttaagtattaagattttataaaaatatcttcattgctgaacatatgcaacataatgtcactttattttcagtattggtttgtcattatgatacaatactgatgccttagggcagctgcagctgtgcttaccctttttccttccttccccttctaaatatgtggtttcttgtcctttatgattttagagagtagttacgattgtgcctaatataggaactgataggtaagaagaagaacttttatgagccatggtctttgtgacatttactgtgattatttagagattcttttaatccttatctgttacctcttccacctcaccgcccttgagttcttcgcagtctggcatagtctggataggtgatttttagagaaatgaggcttgatttttttgtaataggtgaattctgcatatttggtatatagttttgcaacaaaagaggtgtcaccaaaatcaagaagtatttacatttttgtgaaaagcgtgtggattttattcttacattttattttaacaacttaagtaccatcatgtattttatcaagcagtatatactttttaaattggaaacattgttgtgtgtaacttgccatgtttataacatttaagttaatggttacaactgatggatttgaaatattgtgttattaaactagaaatttgtatgaaatgatatatagttaaaggttatattacaatatattttaaaatttaatacttttacagattaagattttgatgacttcaatttaattttttaaatttggtctaagtttaaatatgtttattcaggtgggtgatcatcattttatctttactgttggagaataaaggttttggaagatcattgccgttttgttttaaacatgtgagagctaagcagtttttataaaggccaatttcctaataggatttatttttggttttattagtgggcaaatggcatctacctgtacattctggttacaagggagagacttatacttttgttataataagttatgtgtgaaagtgaattttaca

SEQ ID NO: 125808 - DNA, 2388 bp, Homo sapiens
aatttgacttttttttttttttttttttggtctcgctgtgttgctcaggcagatcttgaactcctgggctcaagtgatcctcttgcctctgccttctgggtagctgggattacagtttcgtgtcaccacccctaactctaatttgactttttagatatatttcaaagcacttggaaaatttgtgttttacaatatcagttgtttgatttcactttctaaatggttatcgtctctcaaaaccccttatggtcatttgcagacacaaaactcagaatctcagaatcacttaacagacttgatgtgttctattctggtaaatgtgctagagttgagattgatacccttagcttctttgatagactgcattacagaggtgcatagactgaatttcttactgtgctgctattaatgcatctagagcctgaagactgttgtagagttaggctttaactgttagctctcttgatattggagatgataggaatttttaggcgacaggaaaaagatgagacaatgagcatacaatgggggcataagccccagctgttcttatatttgtttgtttttttgagacaggatctcgctctgttgcccaggctggagtgcagtggcctgatgacagctcactgcagcctggacctgccaggctggagatatcctcccacttctcaaagtgctgggcttacaggcccttaattttctaacttgtaggaatggtttgtggttctgagaagtcaatttgtaacagtttaggaaaatttaggcttagaaatctggtgaatttattaaagaattaatgtcattattaaactgctttgctgattataataacaaatgagattctcttccttaaatgattttgtatgaaaacatgtgggttggggtttactttgttacgttgtgatactcttaccagctatgattgtaaggattcaacttttgatgtgactatcttttataatctgtgtctgtgatgtgataaaagttgaccatccatgtttgcctgaaatacaagactttcagttttaagactgatagtcctgggcaaactgggacaaattggtctcctaaatttgttgtccacaaaggctaatccagagaaagagacaattacagttttgcttataatttggttatcaaaacgagttgtttcgcttgaagacagactcagcttgtttactagtgttagtatatgaaaacacataggtttctttgtcaggatttaaatatgctggcaagaaatgtagttaccaatcaatcttgaggtgcacatggctttgttttggctctttgaatgccacccatttgctagcattatggcaggtgagtttatatcattatcaaattttcttcagcaatctgctgtaaaacattccagttaaggaaaccacagctcaaggaacgcaaatgatttctgaaggtcatgtaactggtagatagcaaaggcagatttggattttaggattcctgattcttaatttctttctttctttttttttttttgagacatagtctcgctctgtcgcccaggctggagtgcagtggcacaatctcggctcattgcaagctccgccacccaggttcacgccattctcctgcctcagcctcccaagtagctgggactacaggcgcgcgccggccaccacactcggctgatttttttgtattattagtagagacggggtttcaccatgttggccaggatggtcttgatctcctgacctcatgatccgcctgccttggcctcccaaagtgctgggattacaggtgtgagccactgcgcccggctgtgattcttaatttctagtagtttctcatgagagttaataataggtatataaactggtttctagttaatatggtaagatcaaaaaagaagagcatccctggtggccttttagtcatataagccactgttgatggttaaatgttttcagagggtctaattttgaaaatgttgatgaaaagatatgaacttcatttcactttagaaaaatgcaggtacaccaacttttgaatactcagataatgagttcctctgttctaaggagatgttagttgtctagaattaatgcttatttgtcttaactctgttttcataagcagtgtgtaggaatagttagagaaagtaaaatagcttgatttagtgcaagttttatttttaaaatgccttatctgttactgttagtaaagttttgttttgcttgcctcattatgatataatattctgagataataatttattgctacaaaatgatagcaagcattatcttatgtgtaacttttaattaaatccatattcttcaggtaaaaagaacgtatttaacttttaattaaatccatgtttcttcaggtaaaaagaacgtattctcatggtacttacagagc

SEQ ID NO: 125809 - DNA, 1013 bp, Homo sapiens
gcccctctatttaatttatttttttgagacagcctcactctctgcccaggctggagtgtagtggtgtaatgtggagccctgacctccgtgggcttggatgatcctcccacgtcagcctcccaagtacctcggattacaggcacatgccatcatgcccagctaacttttgtattttttgtggaaatggggtttcaccatgttgctcaggctggtcttgaactcttggactcaagtgatcctcctgtcttggccttccaaagtgctgggattacaggtgtgagccactgtgcccaccaccacaggcccctttaaatagtttgtagccagattccttttttttttttttaaagcctcttgattttcaaaaagtatttcttattgtgaggtgctagggctatcccactgagagaggaatctctgagctgtgtggttaggttaattatttaatcagtaactcaaaggtcaatgctgcaaacctacactgaaattcagggtccaggtaagctgtggaatgtgacaagatttctgataccacataatctataggacatctcttcttttattacttctgtttgcttggtgtttttaccctatatgtacatatatctttttcttccctttctctttaaccttgttccattcctttttctcttttccttttaaactttttgttccttttctacttctctctagtagttacatcatggaattaggttgcatttattattggactatatttaaaaattaccaaatattacttaaatggttgcttcaagtttaattttcaaagcacatgaactaaatgcattatttctcctttcctttccttccccttccccttccctttccccttcccttccccttccccttccctttccccttcccttccccttccccttccctttccctttcccttcctttctttcgatggggtcctgctatgttgcccaggctagctttgaagtcctgggctcaagcagtcctcctgcttcagcctcccaaagtgctgtgat

SEQ ID NO: 125810 - DNA, 1032 bp, Homo sapiens
gtccgttaacatcatatgatctatatggtagaaggaagaataacaaatgatgaatatagtgaatcatacctctagcagggtatagggacagaaccatccaagcataattattttcttggtgtgtttgaaacagttttttgaagcaaagtatatcaatatatagggatatattcaatattatgtatttcagatgcttaagtataaagctgtgtatgaaagtgtgtttgtcaggggaacaatattattattaacatacacttgaagatacattttgaaaataattgcaatctgcataattatttatctccagtgtacactgccatgggggacgctatctagtctaaaattacagagtcgaaaagatagtgatgatggtcccatcatgtgggttcgtccaggagaacaaatgatccctgtggctgatatgccaaagtcacctttcaaaaggaaaaggtatgttgtatacacatttttattggaggggatgagtgtttgtatgttggggtgtgtatgttagttgaaaattggaggaaggaggaatgcaaagtttagagcataattggaatataaatttaaaaatagcgatacatgctaatacaatttgttataaaacctaaaatgtaaataaagcatgagaaatgtaggcaaatgacaagaaattgtaatgatggatggaaaaaatgtcataagatataaactattttagaataaatgtaatattcagaacctatactaagaagactaaaatgttttgtggaggatataaagtaagatcagaacaaatggaaagccctgctgtgttctggattggataaaaatgatagttctttaaaattttctgcatttcaattggactaacacttccagtcctggataaaattattttaaaattcataaggaagtaaacttttcagtgaaagagaagattagtgagaggcagcttatgatacaggatattaaaaattactataaagttcaaatagatcattggaataagagtccagaaatagatctaagtatattgggaactta

SEQ ID NO: 125811 - DNA, 1141 bp, Homo sapiens
ttccctcactagacagactataaactcccacgagagtggggtcctcttctgtcttatttgctattgtctcattcactggccccagttcttagatagtacctagcacatagtatgtgtcctatcaatattgaattaatgcatttttaaaagttacccatttgtttcagatatatatctatcttgtgttacccaagagatctgagtgggggcatggtacccaaaccccaggtaaagattctgtgtatagggaaacttgggtaaacaacaccatttgtaatttaattttttatccatgtgtttccttacaactgttcctgttgtgaaggtatattagaaaaatgagggtatcgtatttgtgtttttgtttgttcgtgttcattttaaagatagaatttgatttgagagcaaatttcatatatttttgtctgaattatgtgattattgaatgtttgatagcaattaagtgtcactatataaatgtaattttctttttttaaaaaacagaactaccaatgaaataaaaaatcttcagtacctacctcgaacaagtgagccccgtgagatgctctttgaagacaggacaagagctcatgcagatcatataggacaaggttttgaacgacagactacagctgctgttggagtgctgaaggctgtgcactgtggagagtggtatatataactaccgctattttaatgaaagaatttcttggcttctacaatttttcttggaaaatcttagtaattcctccttactgtgggaaaaaagtttcattttttacccgtatttggatatcttaattgtataattgtactaaagattttaaattgctagaatctggctgggtggggtggctcacacctgtaatcgcagcactttgggaggccgaggtgggtggatcacaaggtcaggagatcaagaccagcctagccaatatggggaaaccccgtctgtactaaaaatacaaaagttagccgggcgtggtggcgcacgcctgtagtcctagctattcaggagcctgaggcaggagaattgcttgaacccgggaggctgagggtgcagtgagccgagatcgcgccactgcactccagcctgggtgacagagcaagactccatctcgaacaaaaacaaaaacaaata

SEQ ID NO: 125812 - DNA, 1096 bp, Homo sapiens
atctaccttcaaataatatgagacttctttatgtaatgtgtaagaacctttcaatagtatacttccatttattccctcccccctcacatttctggcctttgtgctaattgtcatgtattttactttacatatgccataaaccccatgatgtatgttattttgctttaaagaatcatttctaaagagatttctttaaatttaaagagaataaaacctctttcatatttatcattaggtgtgctgtacattccttttcatagatctacattttcatttaagtatcattttccttcagcctgaagaaattcctttagcagtctttgttatgctgttttctcggtgacagattcagcttttgtttatttgaacatgtttttatttcacattttttggaggatattttttggtggatatagaattctagattgactttttcttctaatactttaaaagtagtccattctcttcaggcttgcattgtctttgataagtctatggtcagtcttatccttctttctctgtatataatgtattacatgattctcagattttctcttttatcactggtttttagaaatttagttatgatttgccttcatatgattttctttatgttgtttggaattttattccaaaatccattttttagcatctctttaaaaatgtatttatatattcctaattaattgaagaatttgagagttttttagaattatatttaaaggcatgagtaacctcagcaaataccaagtttattgtattagtacttttccaatgaagtctcttaatttataaagttatttaagagttttatgcatcagtatagttatatgtatcttctatggaaataaaatactcccttttcctcatatttacttctaatttttatgtagtgttttcaactttagcacttaaatttatgaagcattgatcttattcttcaaatagaacacttaattttcttggtttgtataatttaccaattcagatcatttcaattttccaaactcttgtgacaaatgtttatataaaaacgaagtcagtttttaatctgtgtctaggttgaaagtcatggtgttggccctttctttaaata

SEQ ID NO: 125813 - DNA, 2408 bp, Homo sapiens
aagatttcttagaagtagttcaacgaatgcagttagatttacatgaacctccactgtcccaggtatttttaatacacttactgtctttggtttagtttttattatgaagagagttatttgtatttcttgttttattattttttagtgtgtccaatgggttgatgatgcaaaactgaatcaactgaggagggaaggcattcgctatgccaggattcagctatatgataatgacatttattttattccaaggaatgttgttcatcagttcaagacagtttcagctgtatgcagtttagcatggcatattcggctcaaattatatcactcagaggaggacacttctcagaatacagctactcatgaaacaggcacatcatcagattccacatcatctgttcttggacctcacactgacaacatgatttgtgctgtaagcaaagcctccttggattctgttttttcagataaacttcattctaaatatgaattacagcagattaaacatgaacctattgcatctgtaagaatcaaggaagaacctgtgaatgttaatattcctgaaaagactacagcactgaataatatggatggcaagaatgttaaagcaaaattggatcatgttcaatttgcagaatttaagattgacatggattctaaatttgaaaatagcaacaaagatttaaaggaagaattgtgccctggaaatctaagtctagttgatacaaggcaacacagttcagcacattcaaatcaagataaaaaagacgatgacattttgtgctaaatttgcatataccatctaaaatccttttttaaaaaaatttaatgtaataaagattcatgaattctgaaagcaagccaaggacttgctcctatgtctgttacaaaacatagtttatgtagctttgtaacattcctcagtgcctgtccataactgtgaagtattaagcacttagggccagatgcactgtaaacattgcaggtttaaacataaaggagtctttaaaaaaaaatcatttacgttggaattttaggttttagaatagagctgacattaacatatatatatatatataaatatatatatatattttgtaatatgagccagaattctttttcaacaatttaaagcttttccatagagcttatttatatccttttttttcattttaaatgtgtcagcactgtagtgtaaatagcttttaaatatctttttagtgtgatttatactgaaatgtgagccacttaataaaggttcatatgttcatattaataaatatgttttctgttgagtctgtaaagacaaactgacaattcatttaagtcatttgataatgattctctgctggtatatctatttagtgtggtattgtagtgcaaatgtacgtaattcaaatctagtaaatatttaagttcctcacactgtgcaggcttttttttttttttctttttttcttttttttgatacggagtttcattctgtcaccaggctggagttcagtggtgcgatctcggctcactgcaacctctgcctctcgggttcaagtgattattctcctgcctcagcctcctgagtagctgggactacaggcacgcaccacaacacccagctaatttttgtatttttagtagagatggggtttcatcatgttggccaggatggtcttgatctcttgaccttgtgatccgcccaccttggcctcccaaagtgctgggattgcaggggtgagccacagcgcccagcctatgcaggcatttttaacaaccaagactcagttaagaaagtgtgcatctgcgtgtgtgtgaatgtgtatatatatgtatatatatatcatattttgcataattttcttaaattgctgaataagatcaatatgtgaaattccttagcccttctccccaaaatacattgaaaaaagttttatattaaactattaagaaagcagtttaggtaatagaaacagttttagaaagttgggagaaacaaggtatgttaatgataacaaaggcttctaactaatagttacgtggccagattacatagcctaccatagattttttttattgtgtatgggatgataagaagtttagagaattttcttactagtaagtacctttactaagtaatagctaagtataaaatctttagttacagaaagcttgtgagcaattaaaatccttttacatttttcttgcagaatgggagaaaaatatggcaaatacaaaactgtaaaataagggcaatgacaatgactcaactgccatatagagatataattaacaaaatactttgtggtacctcttatctctcaggatctcctccctaccctagcaaggcaaacaacttggagtacttccttttcgaaagaagttctagaaattaaattgaggtaggagacggattgaca

SEQ ID NO: 125814 - DNA, 1056 bp, Homo sapiens
gaagacaaaagtgccattcttttcaaaatacttttaggctgctaaaacatgatgggttttaggtgtggtagaatagatctcactctttctcttacttgatgtaactacatttatatgtaaacaaaattttactggttttagaatgcattgcctgttttatcaaagagttatgtttgaggtttggcactgacagtacacttcagatatgataattaagaggacaactcaggagagcttgtaagtccttttgtcttctgtcctggcttttcttttctttctgtaacccagtacatactacagatggaaatgattgctttttagaacatcaagcacacacagcctaaaaacaaaaatgtcttttccttgtagctttataggcgttgtatagcagtcatatctctgttgagagagcagggaaaggaggggaaaacatcctgcatttcaggttatcttcacttccagctcttcttggacttcagacccaatcagagaatatgaatgagctgagaacaaaatatggtctgggcgagtagaatttatgttaactagaaattaaaatttataacttgtgtgttttattactatgatctgcctactaagaactgcactgtgaacatgtgagaactcgatccttctgtacattttgaaattcagaacttacgcatctatgttgttagaatgttaaatctacacttttctgtaaagttcattgctgttgtactacttaagactacttggccgggcgcagtggtcacgcctgtaatcccagcactttgggaggccaaggcgggtggatcacgaggtcaggagatcgagaccatcctggctaacatggtgaaaccccgtctctactaaaaaatacaaaaaattagccgggtgtggtggcgggtgcctgtagtcccagctactcgggagactgaggcaggagaacggcctgaacccaggaggcagagcttgcaatgagcagatatcgtgccactgcactccagcctgggtgacagagactctgtctcaaaaaaaaaaaaaaaaaaaaaaaaaaaggactactaagtgtgc

SEQ ID NO: 125815 - DNA, 1048 bp, Homo sapiens
ctttcctcttaacgtctcatacagaattccattatgcttttattgcctagcacaggggtcagcaaattacctcctgtaggccatatctaacctaccaccagtttttctattgtgtgtgaggcaagaatggtttttatgccattaaatggttgaaacaaaagtaaaaatattttgtgatgtgaaaatcatttgaaatttaaatttcatgtccataaataaggttttattgggatatagccatggtctgtggctgctttctctgccataaggactgagttcagtagttgcaaaagaaaccacatcacctaaaagcctaaatatttactgagaagccctttacagagaaattttgctgactcctggcctagctgattgtttgctgtggtgccatcccttcttttccttttccctgtactccaaaatcctcttggctggtttcttagagagatgtaagctttcttctactttgaatttatttaacgatagatcccataaaccaaagtatgcatctctcaattgagttagaggtatctgatcaagcctggaacattccgttcccagtactaactgttctcaatcctatttttacatactgaaaatcctaattattgtcaattataagatgaaaactttgcagttgattagtttttatttatttagcctagctctctagtttcaaatgcctaatgagttaagctgtattaatctgttgtattgtgaaacttatgttatctgtcattacaagggagaactagaccttctgtatcagtagccagaaatcacttttttgtttgatttttttaaaacggagaaaaaatcacttgaggtttctcttaaagctaaaagtgagggttgcatagggtaagaacaatcatcgtgcttcagggttataagacacttcaacctctttggaatttttataagtactgtcacctctgcttcattggaattgattagtaccttgggagggtgataatatgctttctcaattcaagacacttctaattgtgagggggcactaattccttgagaccccaggacaataggt

SEQ ID NO: 125816 - DNA, 1034 bp, Homo sapiens
cccgtacctgagggccggggtcagccgcgaccccttctcatcagtcggccggtggcggaggctcagccgccttcctcccgagctcgcgcggtcctcaagtcttgatggtgacgggccgaagcccagcgcgccacccgcccctcgggccccgcttccaggcccctgtcctttgcttccttcccttggcgctgtgctgaggggtcgtcgggtcctggaagggcgttcaggggtctcgggtggctagcccggctggcggggagatgtcagctagcggccggaggagcgggctcgggagggggcggcggctcgcgcgctggaggaggtggaaggagggtcgctgccctgccccctctgagcaggcggcagtcgagttttctgatcccaacacggcggagtgggtgcttaaggcatgggccttaagggatagttcccgtctggaaacaataccgtgctccatcagcatgcttcagcttttcttatttttatctgcccagtgttgacagccagcattctggtattgtccttcgagtcatggctttctaactcagcacctccttgtgtaacttcagggatcattctgtcactaatctgtcacccttcttatttttagcgtggcgaaaacaaggaactgccttatactaacctgggcagtgcagaatctggaacaatttattaatctcagtgtgtactttacatgccaagtaattttgaaattcatggtgaatattaaatattttgtagttttcggttgctttctttgttaatagtatatcctccttgctttgagactacttttcaggtgtgatactttaatcttaaggtttttggttagcttttgccatttttaaacgtttctttcattttttttttctccaagactttggcaagagacttagtatttgatcttgttttcaggtatttttgtaaagtttattttctttcaaactgggcttttttcaccatatttttaatattggaaggggaattctgaaagtctggaaactgcacactttagcctaaagagtcacaaaaca

SEQ ID NO: 125817 - DNA, 1044 bp, Homo sapiens
gaattttgtgtttagacttgagtcccatctctaagatatctctttatgtatatgcaaatattacaaaatccaaaatccaaaatgcttgtggtcccaataattcttgagacaagaattcagttaaagtatagacagtctggatttgaattcctatcaggctttgtgactttgaacataacaccaaacctcttttagcatcagtttccttatctgtttaatggaaagggcaatacttcaaagaagacattaagccttaaataaaatatataaagtacgggcacatagaaagcagtgaatacaaaagaaacaataaataattttaagagagaactagttgggtttcaggggagctaccactgaagccttaaaggtctgaaggtggtgtttgtaggtggagaaagagggcattccatgcagaacaggaagaggcagagtctcagaacagaaatatggattgtttagggaatggtaagtaattgtagctttgtataaaatgtatgtgtgaaggccagctttaaatgataatggtatgtaaatgtggttgggcaaagtgagtactacccaattttgataattggaaattgcatacttagatactaaaattataggaaaacctcagcagtttgtccattattacatgtttatttaatattcaccttccaatacttactttcccagttcaaattaagactcaaagaagaattccaaaatgatggttgccatcccttaacccctttacctagcctgtagccacatggagtcattattgtgaactcccctttgcatatattttgactgtcttttcttaatccctacttgatacatgatagtgggacagagtttttttattttgagacagggtctcattctgtcttccaggttggagtacagtagtgtaattactgtaaccttgaactcccaggctcaggcaatcctgttgccttagcctcctgagtagctagacctgcaggcatgcaccactgtgtccagctaatgttttaatttttatttttttgtacatacagggtcttgctatgttggcca

SEQ ID NO: 125818 - DNA, 1021 bp, Homo sapiens
tcttggcctaccaaagtcctgggattacagatataagccaccactcctggccagtgtgttttaaattgggactgcccttgaaaatctgagaaagtctcgtgcttctatcttcttctcagattaataccaaaccataaatacgttaaatttacaaatctgaaacatcacttgatgaccagaatcatatgactaagtggaaaatattaagtgacatttaggaaaactgcatttttagtccactttgttattctcatgaaaattgctaatgtgacacaaaatatagaagtgagttttcagatgagaacaactgattgcttcctggaacaggtagttttagagcactaggaatgaaaatatgctggattttattctgggtactgaacaggaactggggcaggaaatagctgtggctgaaccactacctgataataatcataacatgattaaatttgacatttaatgagaggaagtaaagggaaaagtgcatagtatgcagctttccagttgcaaaaacagtacaagaaaggggctgttaaaagtatatctacagaaattttaaagacatgtaggcattcatatttgttgcatgaatgaaagtacttttgtaagaccttttgtataggatttgttacagataccagaaaatttatgaaaattaggtggcacaagttttggtgctctgtagacctaggttcaagtcctgatactgccatcactggttgtgtgacattggactcattatgtaatatttttgaggttcagttttatttattctttaaatggagttacctactttgcgagattttaagaattaaatgagataatgtatgtaaagcacttgacatattcttgatttctaagactagctcaaaaagtggttgttgcagttatttgactgagttgaacaggcgtgtgtgtgtgtgtgtgtgtgtgtgtgtgtgtgtgtgtaggttttaaaataacaatttccagatagaataagagaagccagaaaatggcaaacaagcaaataaaaccttaa

SEQ ID NO: 125819 - DNA, 1047 bp, Homo sapiens
aagggattcttctgcctcagcctcccgagtagttgggactacaggcacacgccaccacacccagctaatttttgtatttttagtagagatagggtttcaccatgttggccaggatggtctcgatgtcttgacctcgtgatccacccatcttggcctaccaaagtgttgggattacaggcctgagccaccgtgcctggcctgaatcttaaattactctttaagtagtggagttatttgaacaccatggcttatatgttctcacaatttaatttccttagaaggaattgaggtaacttttcaaatagatcagaacaaggagaaagttattttagacaaggaatattacctggagtagaaggcaggcatgaaagtatatggtatatttgtgaacctgtgtagctagaatgtaaggtatgtgtagctagaatgtatggatgggaggttggggagggcgggtaattgaaactgtgtgaaacaaagtagagacgatagatgctactgactggagaaataataaatctatggtcaaattgtaaaagaagggttttgaatacagtgttgattaaactcttttctttggcagtgggagactagagatttttaagtgatgaggtcagtattttaaaaagataagtagtgaaagtaaagcaacaataatagattgttagtgtagtcctggtattagatatcagcttgtaccaggtgtatggtagtggggctggagagggatcatatgagagaagtttggaggtatgacaaatacgttatattaatttattccttcataattattgagtggtttctgtgtgccaggtatagaattgatagtggtgggaggtgggaaaggggaggaaacaagaaagattctagggttctttgttggaaaattgagcagatagtaaaagataagatttgaggagggaaaatacatcctggtttgttttttttttttttcttggaggtagttgtaacaaattcacggaagagcttagtttatgatcttgtgttttttgcttagtatcttgagtttataaaaagaattgaaac

SEQ ID NO: 125820 - DNA, 1087 bp, Homo sapiens
agaccaggagttcaaggccagcctggacaacatagcaagaccccacctctaccaaaaaaaaaaaaacgttagccgagtgtggtggcacacacctgtagtcttagctacttgggaggctgagaaagggaggaacacttgagaccccaggagtttgaggttgaagtgagccatgattgtgccactgcattccagcctgggtgacagagcgagcctctgtctctaaataacaacaacaacaataatataaatgagagatttctgagtaaaaatgaagtggggtcacagattttttcttcactaaaaccaaattaaggaaagagtagatggtgggttgaagaaagagggcagaaatggaaagaagcagacaaaaaaggggtatctgtagctttataccaaatacttcaaaaagtggaaggtaaagaaagaatgagaagatactagttgtatatgacaaggcttctaatcccagccccgtatcccagaaacaagacaaaggaaagaggaagcctacaaaatattgcgatatctcattcatacttttagagaagtagacctaggaggtgaataggaagcaaaaagtcaaggaaaaatccttgagaagaccctacataccagcgctgagcctcagcagaggcaacaagcactggcattttgaatggtactctgagttaagggcaagagccaaagcccatgaaggtaggctagatccctaactagggagatcagtcttggtacaggacatttaaggacacctcagcaatgcctgtgctcagtccaattttagctcttccttttctgtgtcgttggattatagaaaagtagattaagagtagttcctgattctcaaactgaagtttgtgtgtgtatgcataaagacgtgtacacaaaaataaaaatggccccaactaagatgagaaaggtgttaggggtggccgagcagaatcttggatatcagagtgaataggagctgaggatagcagtttctgtattaaacgtgataaaaaaaatagcatggcaactctacaaatataggagaaaaataaacgaaagaagtaactctgaaaagactgtcctaggtaagaatagc

SEQ ID NO: 125821 - DNA, 3989 bp, Homo sapiens
cagttttcaaggtctaaaaatttcttgttttggttgtggtgaaggcaactgagttatatttaactttagcatttaggaatggtgttagactagactttaacttattttcattagaccttttagatctgcaatatgtaaaaccttttaaatcttaatgtattggtgactgagtgacatgtcagtaaataaatgaaccatgtttattatacttcatgatatctttgtaccctttaatgttatgaaaaagtatgtttgtttatgtgcatgttgggggagtacaggagttggacaggtagagttttcaattctagccctcaaattcatctgtggtggtactttggcaactttttaatatggtgtgtaaacatttgtgtttaatataggcgaaaagttttaggaaaattcagagataataaagacattggactgctctcaaagaacgtgtgggtgggaggtgggggcacatacagataagtacactaaagtctatataaaacaatatagtaagtacacagcagtcccccttatctgtgagggttatattccaagatccccaatggaaacctgaagccacagatagtaccaaacctatatttgctgtgtttttttcctgtatatacatacttatgataaagtttatattataaattaggtacagtaagacagggtccccaaccagttggtctgcggcctggtaggaaccgtgggctgcactacgggaggtgagccagtgggcaagtgagcgaagcttcatctgtatttacagctgcctcccatcacttccattaccatctgagctctgcctcctgtcagatcagcagcggcattagattctcataagagtgcgaaccctattctcagctgtgtatgtgagagatctcggttgcatgcttcttatgagagtctaatgcctgattgtctgaggtggagttgaggcagtgatgcttgcgctggggagcagctgcgaatacagattaacgttagcagagaggtttgactgcacagagatcataataaataaattgcttgcagacccatatcaaaaccctgtcagtgagttgagtgcttcatttgtacagctgcatctggtgacaggctttaagtcagaatccaacacttaattttagtccatgcatgacccgcccattattttacttaccttatccgtccacatttctttgtcacactgggcacttacctcagtcacagatttggttaagcccacaagctaaccttagccaaaatgagtaaataacaaaacattactagagagcttctttgtaaagggggaagacccaatgatgagacagcagaagactcttaagactgccaacaaaaagaaagctgcatttaaaagaaaacaccaagagtcccacttaaattatgggttcattgcaacaggtgattcacattctctaggcctgctttgtgtatgtggtgactggctatccaacaagccatgaaaccttcaaaagtgctttgtcacgtggagaccacttatcctgcattgaaagacaaggctttggagtttttcaaaagaaaaaaacgtgaacatgaagaacagaagcaattatggaaggccaccacttcatcaagtgtgtctgcactgagagtattattcttagcggctaaagcattgctaaagctaagaagccgtttactattggtgaagagttgatcctgcctgcttgctgttaaggacatttgttacgaacttttaggagaggctgcagttcagaaggtggcacatgttcttttttcagctagtaccataactagattatttgatgaaatagaggatattgaggcacaattgttaggattaatgagtcaccatggtgtgtaatccaggttgacaagtctactgacgttgacaacaaggcagtaatgcttgtttttgtgtgatacacttctcaggaggacgtgcatgagggtatgttatgtgcccttttgttgccaaccaataccacagctgtagaactgatttggtaattttgtgttggtatatgcatgaacagagcacggctgccatgactggacagctttctggtttcactacttgggtcaaagaggttgcttctgaatgcgagtctacgcactgtgtcatccgtagagaaatgctggctaggcacaaaatgtcaccgaaacttaaccaacattttgcaggatgtgattaaaattatccacattaaagtacgtgcccttagtttatgtctgtctgtgcagctctgtgaggaaatggatgcagagcacacacagcttctcttatatgcagaagtaagatggctttctaaggtagatcactggccagaggttttgagttacaaggtctctccagagattttttttttttttttagaaaaatagttatcactggtagcacatttcagtgatgcagaatgggtcacaaaacttgcttacttgtgtgacatattcaacctgctcaaagaactcagcttgtcacttcaggggagaatgacaaatgtgttcgagtcagtagataaagtggctgcattcaaagccaaactggaattgagtgaacattgagggattttttttgacatgcttcaaacattaacagagatttttaaagagactcagccaggaccttctttctcccagctggtgcatgatcacctatctcagctttcaaaagagtttgagcattacttcccaaccacagaagacccccgaactgggaagtaatggatccacaagctgtttgtgaataagccagctgtatcgactttgtccgtgctagaagaggatcaactgcttaaggtcacaaatgatggtggccttaaaagtatgtttgagacaacttcaaatctccatacattctggattaaagtcaaggcggactatcctgagattgccacaaaacactgaaaagtctgtttccatttctaacatcgtatctttgtgaagcagggttttctgtagtatagttaacagcaaccaaaatgagattatggaatagactggacataaacaatacactttgggtgtcactgtcttccatcatccccagatgggaccatctagttgcaggaaaacaagctcagggctcccactgattctatgttatggtgagttgtataattatttcattatatattataatgtaataataatagaaataaagtatacaataaatgtaatgctctcgaatcatcccaaaaccatcccccctaccctggccatggaaaaattgtcttccacaaaaccagtccctggtgctaaaaaaggttggggactgctgcaagtaagagatagataataactaataataaaataggacaatcgtaacagtatactctaatgaaaagttatggaatttggtctctgtctccaaatattttactgtactgcagttactgcagtaactgaaatgtggaaagcaaagccttggataaagggagtgctactctaaggggaacacagaacaggatgagaaatattaaatggaagaatttgggagaaacttatggagaaagtggaattttggaagtcttgtcaaaatcttccttgttttagaaagagaagtgttaattttggcacagaggtagaaaaatgttgaaagtatgggatggttgaaacaagacatatgagaagatgatgagcaataatgttggacaattaaggtcagattgtagagagtctaaatacttgtggattttattttgtaagcagcagagaatgatacaaggttgttggaatggaataataatatgagagtctgaggagatttataaaaactacctttaaaaaattaaaagctctttagggccaagcgcagtggctcacacctgtaatcccagcacttggggaggctgaggtaagaagattgctgaagacagcagttcaagaccagcctgggcagcataatgagactccatctctctctacaaaagatttaaaaaatagcctagtttggtggcatgcaactttttgtgtgatatacttctcagcaggatgtgcatgaggat

SEQ ID NO: 125822 - DNA, 1003 bp, Homo sapiens
gagcatatgttggtgctagaagagagacattaagcttcagcattttttagtccaaaggaaagctggccgggtgcggtggctcatgcctgtaattccagcacttttggaggccgaggcgggcggatcacctgaggtcaggagttcgagaccagcctggccaacagggtgaaaccctgtctctactaaaaataccaaaaattagccaggcgtggtggtgggcgcctgtagtcctagctactgaggaggctgagacaggagaattgcttgaacctgggaggcggaggttgcagtgagccgagatcacaccattgcactccagcctgggcaacaagagcaaaactccgtctcaaaaaaaaaaaaaacaagaaaaaaaaaagaaagcttcatcttggaggaagtaggatttgagctgatttagaaggatgtatgagtggagaaaagaatggaataggaataataataacacacgcaaagtgtcaggggtggaaatacattgttttctgagcctagtgagagtcatgccagaacagacaaatttgtttcagaataatgagagatgtacatggtaacatttatgtagtatttgatagaatttctgtaacatggggattggttaaaaatctgacaatgtgggagaccatatttgtacaaagaatactcataggcattattatactgttgacccttgaacaattggggttagggatactgacccctgtgctgtggaaaatttggctgtaacttttgaatcccccaaaatttaactactaatagcctactgttgacaggaagtcttactaataacataaacagataacacatattttatatgttatatgtttatatactgtataattacaataaagtaagctagagaaaaagtgttattaaattgtaaagaagagaaaataggccgggcacagtggctcacacctgtaataccagcactttgggaggctgagacgggaggatcacctgaggtccggagtttgagaccaacctg

SEQ ID NO: 125823 - DNA, 1058 bp, Homo sapiens
tgcacgtgtatacctatgtaacaaacctgcacattctgcacatgtaccccaaaacttaaagtataataaaaaaagcaaaaaaaaaaaaaaaagaatttcagatattttgttaaggtgtgacaattaaatctatgtcaaggatagtgttagcttagagttaactgcctaatgttatgcctgcagttagccctatggttttaggattggattatttctaaataaataaagattatgcatcataatacccatccttgtatcagatcagttgatcaaaaaagattaagatcctctattaaaggtccccagtaggttttttatgcttttttctgtaaataaactttaatatgatcatttaacattaaacctgagctatcatgacaatacagtctatgaacctgtattcctggactgtcatagaatcaaagaagttggaaaggctttagaaataatcttcattattcctgaaataatttgacttgttaatccttgttgattatacccacgtgtaattgggtatctttgagtgctttgtcagatagctggttcagaaatctatcttagcatgctgtaaaacctgttttaaaaataggtatgagccattcagtgtgactgaaaggttgttgacacaatggaaaaactattaaatgagtttgcacagaaaatcaccattactgaagaaaggtttttttattttaaacagaaaattcgttgaatttttatttctatagacccaaataaatacagtttaaaatatttagaacactttatataactagaatactgttagatttttggtatttatctaagtgtagcttggtaaacaaatatataaagtctttgcgattattttcttgtgaggcaggcagtgtttttcaaactttcatttgagctttttcttttaaaaaatactattatttatatgtgaacatttaaatattccctaaatatattaaatatctgatatgtttaatagagtgataaaatcctttcacgttttgtgtatgaaatgtatattatttacattgttgggggttaggaaagaggatctttattttgtt

SEQ ID NO: 125824 - DNA, 1034 bp, Homo sapiens
atactttttggctcttgggttattttaattcagttttgtgtttactgagtgtcagggaaaattaaatatcattataaattctgtcatctctgttaagccatcctttagcaatggtaactgacactggtttttagaaacaaactacattactgattgaatgaattggtttcttgtatgtggatttttagatgaacaatttctggtataacctaggaaattctgaaatttctttaaaagattaaaaaaaattcaatctattttgtaagaaaacaagtgttatttattcatgcaaatagaactttctattattgtggcaactgatttttgtttacttaagagaacctgttgctaaaatagtaatgaggaagagtgtaatataagtctcgtcatacaccccttgctctgcaagtaaccagagtgctatgtctgcatgctgttcagtctccttttggaaggtgggaaataaagtcatttgtatgtttttctctcttgcacagcctaaaatgaccaatgtgtgatttcagtggaataaatggcgtccaaagtcacagatgctatagtctggtatcaaaagaaggtaagttgatagtcaaaacttttagctttctaaatgtttgaatttcaaaaatacatgtttatttcatgctatagatgttaggattttgagtgggaaaggaagattatttttatttttcttgtacttattttacttctaaataaattggaaagatgatgcttaaacatattttttctctactttttactctacaatagcaaagtagctagattaattataatagaaagcaaatctccaggagtggataaaattagcattttataaaaacattaacactttccttagtttaattttttaaaagaaagattagcagagctgttacataacttatatcaatagtttttaatttgtttcttgtaagttacaattcaatagctgaatgtttcagtaaaataaagttttgggaactctattttacaaactgaaatattaaagtgtttattttgatgttttagga

SEQ ID NO: 125825 - DNA, 1004 bp, Homo sapiens
atgttgttttgtgtaataccttagatcttttgtgtacatagtggattatatttgtgttcacattttaaaacatttttataccttattcttcaggtctctattaacaaaatataatgatacatttaaagcttttcttatataggagaaaaaacagacttttttttttttttttttttgagatggaatctctctctctgtcacccagactggagtgtagtggcgcgatctcggctcactgcaacctctgcctcctgggttcaagcgattctcttgtctcagcctcccaagtagctgggattacaggcatatgctaccatgcctggctaatttttgtatatttagtagagacagggtttcgccgtgttggtcaggctgatcttgaactcctaacctcaggtgatccgcccgcctcagcctcccaaagtgctaggattacaggcttgagccaccgcgcccagccaaacagatgatttttaagttttgttcaattgaaaataagtgataattaaaacactttaaaagttagacaaactaagaatatggcctttttaaaaatattttttgagacaggatctcactctgttgcccaggcttgagtgcagttgcacactcatggctcactgcaaccttaacctcttgggctcatgtggtcctcctacctaaacctcccttagtagatggcatgggattatggtctgtttttagatgtgttatttgttttctgggtagaacatgccataggtatacaattatatttttcatatgaggtactttattggaagtattgatattgatatactattaattgtcttttgtgtttgttagtgcctccttttaaacttttaaacttccaatcaagttaaaaatcagtctgcttagctaaagagctaaagaaaattgtaagttaaggaaaacaaaacaaaacaaactttaaaaattttcctgtctatatctttgaaagtttttctctttcctaatttctatctacgggagtaataaacatt

SEQ ID NO: 125826 - DNA, 1025 bp, Homo sapiens
ggcgtgagaaaccgtgctgggccaataacaggtaatatttattgaacacttcatgtgtgccacacaatgtctgaaagtactttatatacatttcatcatcacaaaaagcctattaaatatatattactgctattatcctgattttataactgaggcaactacggtttagagaagtctagtagttttcttaaggtcacacagtgcctgtgtgcctgagctagaattcaaatctagttggtctgggccatagtatctgcactctttacttaacagtgattccactccccactttacaaccaaatctagcctatttcttttacttttttcttacctggctttgggttcttaggtggttgagagaaatggcattaaatttgtcatctgtgtctcattccctgcctggactgccatcaaggaccagcaaatgcttaataaatggtagcagcagttactgattattaatacaactatcactttttaagtgtttttagtctattagaagtcttgtacatttactgactaggtcgattttggtcagtgttatttaactgagtaaattcaatttttataaatgcgtctgtggccaaaagaattatgaccagtgttgattaatgtcttagattaggtgggaagatgaagttcatgtcttttgaagtttttttctcttttaagtttgatatataaaatatgagcaacacttttattagtggtaaaatgaagataatgtttatatcccatctttcactgtgtttctttgatttagaagctaaagaagtcagctgggcttggtggcttacatctgtaatcgcagcactttgggagggcaaagaggaaggatcacttgcgcccaggagttcaagaccagcctgggcaacaaagtgagatcctgtctctacaaaataaataaaataaaataaaataaattatccaggcatggtggtacacacctgcagttgcagctacgcaggaggctgagatgggaggatcactgtgattgcaccactgcataatttaagagtgtgttt

SEQ ID NO: 125827 - DNA, 1019 bp, Homo sapiens
ctagcagggtcttcacagttcatcatccaaggttaggttaagtagaaaagcagaagttaaattatctttgctaaaatgactttttggaaaaggttattaatcacatagtagcttgataaataaatccactcagaacatactgccatgtaccagcaagttggaaaatgaacagtcttcataaattatgcagaatggtattggtttgcatgcattaacagcaatgttctcattaaacttgggccaggaaaaaccaccatggtgttctgcttctacttttcaccacatgcgtaaactgtgccaacatcagccagctaagacatgggaaggaaaggaaaccaaggctgtgtagggccccttagcatcaggatttctggaaacttctctcttaggatctgtagttaatgttaattttattcctctgtctcagccgtctgtctctgtttctcctattcatgtgatgtctagaatggaaagtctggctccacttgagttgtgtgtctggctttgaatcactgttgggggaaggggatgtgcaggatcaaataacacagatgtggaggttggtagtccctctcagagtatagcaagacttcagtactttatgcttagtgatgtagttgcccaattaattcatcttgcctactgcccggaaaaaccaatgcactgagaacagcaggtttttgcagcagagagttgaaaaatcgcagggccaggcaaacagaacaagagaggttattattattcaaattggtctatgaaattttggagactgggttttgttttgttttaggataatttggcaagcagtgggctagggaataggaaatgctgattggttggatcagggatgaaatcatagggtgttaaagctgtcttcttgcactgtcagtccctgggtgggattacaagaccagttgagccattttatgggtctgggtggcgccagcttgtccattagaatgcagggtccgaaaaatacctcaaacaccaattttagttttacaatagtgatgttatct

SEQ ID NO: 125828 - DNA, 1010 bp, Homo sapiens
ttgttttttttttttacttcttttttctttttttgtagagataggctttcgccatgttgcccacgttggtcttgaactcctagactcaaataatctgctcacctcggcctcccaaagtgctgggattatagatgtgagccactgcacccagccaaatggccttttttcaaacctgcttttattccaggatgtcatggttaatagtagcagtgcaatcccaggtacttaagccagaaactgtcatctttatttctttctcatgcatccatatccagtgagtttcctactcttgtacattttatcttacaaacattggtcctttcagaccatctttcagcggtatgcaacagtacttacttgattctgctttgaattatgactctttgaatatttttttctttggatttataacttctgagaggcagattctaccataatcacttctcttcattgaaataaaaaataccttcaagacttttttctaaacttgagtcagtgttttactatgtcattaactggctttccttggcaataggagcttgatcaggattcgtgatttgatgataggtatgtggtctgtagtatccttttttggggattcatgcagagaatcgtgtcattttagatgatgttgggaatattttaattagctttagcttttattactcataatgaatggaatctttgataactagctagcttttagtatctgcagatgagaatgtgtttggtgttttgatccaaatggctagctagatatataaattgaccgaattctagaaatctgttttcttccttgaaaagtcacattgtcccccaaccaaaagatttcaaatcttaaaaaaaaaaaaatttatttcttttaaaatttgccttctactcaagtagctttactttttttagtaacactttttaattatattccgataatgatttatagaaaaataaataaatgattggttaaagcaaagagatttgcaagtggttgcagagcaaactctttgcttata

SEQ ID NO: 125829 - DNA, 1029 bp, Homo sapiens
ctgttgtctttggtacttctcagaggtaatcattattaatgattttcatgtatccttctaaatatctggtgtatatatttacatatatttaatatagcatattagctatgttaatttcagtttttacagcatgtataaagtgttcattttcctgttagaacagtcttcagtaggtcagaaagcatctaaagaatattcatttagttgaattttcatctgtttgatattactaaattccagtatctcaatttctttttttttttccttttgactcttacccttcttactgctttcaggttgctgttccataattattgttgttgtttttttttaaatcagttttgacctctgtaatggctcaaactttagatgagaaaacatactagaagtggagatgacagaaaatgatgtttgtatcttaagacttcagtcttctcagggaagtagtaactggctagacattcttccaggaatggtgatggtcacagtaattaggaattaaagcttgtgggaagaaaatctttaattgaccttgttgtcattaagaagaaggagttattctaaggcattggtataggattgccagacatgttaccaaagatacaggatgagtttgtagatgacaaagtgcttggtcatctggaaccaggaatggaaaagctgactgtaggtcagctctgggaatgagtgcaccagaggcttaagctattcagggcgtctctgggagtaataacaagaaccttgataaagttgcttaccatagccaagcaccagagaaaggacttcacattctcacaatatacaaaactattggctacagaatataaatcaggatttcagagtctcctcttacatgatggaacaatgtttttccctccttgaaacagatcattacttatgaagaatatggttggatatctataccattacttgtacgttaattaccttggtatatctctctctgtgtatctatcaacaaaacattatttgagtatatatcctttcaaaatgttaggtactttttttttt

SEQ ID NO: 125830 - DNA, 1067 bp, Homo sapiens
actaacatttctcagagtgttccatctttcttcctaaataaatttctcttcttgcatatactgtctgattaatggttctaccaacttttccatcttctttcacctaatttatcccccttttcctctcccttctcagcccagtctgattttcatgaacctttataaatacctttccagtacattctctcttccttatctttgagtttctgacattttcaggatatcaagtaacaacttcacttggtctttttccacatctgcaggttgcacagtgttcaagggagaggtaaaggagacaattaataactaatgtttctatcactttctttcccagacagaggaagtaacaagtttcctctgcgtcttttattttctattttttgcccattttcctctatcctataattcatgttcctccctctctccatcctctttatcctatggcttattgttcccttggtctctccatgcttctgaggatcatacagaaagtaaaggatctggagatttggcttttcagtcttgcaactctgtggagatgtgctctgaatgactaaaaagcactggagctctgtagagcatatgggaaataatggtctttctgcccctttaggaaccttggagaagaaggacaaggaaggaaaggggcctgtttgcataagacagaaactttctaggttgatgagtgtgttaaaaaatcctaacaggcagtttcccagagagtaggcagtttgaggtagtatggagaatataattaacttaatagtcagaaggtctgtactctagtgcgagctttgcttctaactgactgcatgaccttaaataagtcacttagactggttcttcgtccttgtttccaaaatgagcatgtagaataggtgagttttaaggtcctgctcagttctaaaatacagattccaatagaactgagtaacttagtgttaaaactaatgtggggttttttggtatgtgtgcatttttaaaaaacttttggtttttgacctaactgaaggcaatatactatttttatttttccttacttgcaaaattgatacctctaacaaaaa

SEQ ID NO: 125831 - DNA, 1019 bp, Homo sapiens
tatattaaaatgagttgtatactaaaaggaatttatcaaactaagttaaaccatgaattgcaacttaacctgacaattagatcatttcttaaataaaacttcaaaatatatttttaaccataataaaatgggcaaaattttgtttctagattttgttcaaagaccagatgatttactaagaattttttgataagttagggcatgtctcctagaattgttatctgtaagacctcaaaacctttaagctgaaataggacattaatttacatgtttattttagctgttagatatatttctaaattattatacaaatagggtggtcattaaaatttagagaaatagctatctgatgtaattattaacagattataatttctatcagtaacctatccaaaataagctaagtccaaacattcttctgcatattttaatttttagatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagtacgtgtgatttttaaaatagtttgcctatgtgattttatattagccaatgtaaagtgacttagatatagtagttgcccttgaactaagtattttctccagaattaattctgtgagcgtttataacactgatgaaactgtaaatgagataaagtgttgtgattaaacttgattgacaatataatctgacaccttctgaattgatggcttcagtttttccaaaatgctttttttgagacggggtcttactctgttatccaggctggagtgaggtggtgcgatcttggctcacagcatcctcagcctcccaggcacaaacgatcttcccacctcagcctcctgagtagctagaactacaggcatgcgccaccatgcccggctaattttttttttg

SEQ ID NO: 125832 - DNA, 2579 bp, Homo sapiens
ctgattttttatttttattttttaagagactgagttttgctatgttgcccaggctggtctcgaacccctggcctcaaacagtcttcccacttcagcctcccaaagtgctgagattacaggcttgagccactgtgcctggcatatttcttatttttggatgctgtttcaaatccttttctgaacagaaatattacaggataatatttgacaaatggctgttgaagtacttttaaaagtaaaaatgccttaaaagtatagtcactgatttaagatattttttcagaaaatcaggtaatactaattagttactttgtggtagttgaggatattttgaagttgtgtgtatatatgtatgtgtaatttcaaatttcatagtttaaaagctaaaaggttggttagaaattacctataatcctctttgtgtactcccaacttaggatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggtatatactttgtccttaagtgtatacatacgtatctattttatatgttactaatttataacttctttcaacaattaaaaattgttgaaataaatatttcacattattatcaatatttattattgttgtatgatctggatttataaaatagcagttttaggtttacgtattgcacatgtattgatagatagccacacatttgagctcattttatgcattatctttgaagactcatacattgtttgttgtttgcttttaaagaagaacattctggagagagaatctgcaaactcctgtgttcactttttccacaatttgaaaggctttatacatttgatcatagcaaagttattttaagtaacttccttcatattgctgtcaccagttattaagtccccatacttcaaaattcagttcttttttctttgtttctatttttccttattaatctttattttctctaaacccttttcaactatatcatatctcttgagcttcaaattgtttaaataaagaatttcattcaattgtattttcagtttctaatctaagggtagaacatttggctttaaggcaaataaattacactgtttatcacttttttataaacattaccttctactctttttgagctatgttagtaattttttccttgatggttttgggttaaacttgtaaaacaaacacatgttacgctgtgctggaatatgattgccttcagagtattaagattagaagagttactattctttgcacactcttctttgtggttgtgtctctggttaatctttctggtgattgtggttttgtttcttttcccagtggttgccatacagacactaatgccagtgtgtctgctctattgcctcttcacccatgtcatttgatgtagtgtttcttgttcctaagccagataaccaagcttgtaaaattttgtcttactgtatgtactgttagaagtcagttggtgctggaagggagacggagggctgtttgacccctctcccagaataaattatttagcagtagcagtatttttctcactccatgatcttggcttttgttggtttgcaactgtattttaaacgattgagtttcttgaagcgcagaacattattctacctattaacttttaaattaaaaggttgtttaaaatcttgatttccagctaagtaaggctgatagtaagcattgatttacatcttttttaatgatataagaaattacataaatataaaatatggctataaaattcttcgtctataaagtgaagaatgtagactaggtgatattttaaaagctgcattcagttctcaaaaatttttactcttaaaccagctttaaagggcgtttctaaaaaaaagcaaaataaagcctcctttgaataaataaaatggaaacagaagatttgtagtgctcttttgcgtttttatttataaatttaaatttattttataaattactgtactctctccaattgctagtaatgttttttctttaagagtgaggcatgaaaaaatcatttggacccactcaaacacaatgagcaagcatctctagtacctagattgtgccatttatcactaaataaccaaaaccaaaaaaaacaaaaacaaaacaacttcttgaagaagtggctgattcctgattgtcgtttgttgcaggaaatatacaaaatgactgtggaacctcttataatatgatagagggcaaggaagctatcaaagactaccaaggtcttttcagaaagacttgggagccaaagatagaatagtttgaactttaatttttcttgataaaagtattccaatgataaatgaaaaggaaaattctttggggaagtattttgtgcatggatgggattggtgggttttattgtaagataatgggtcaggaacctagccatttgttgtaagcttcccagatggcaatatctgtagataaactttttaggggcatctattttttagggaagacttatccagt

SEQ ID NO: 125833 - DNA, 1009 bp, Homo sapiens
ctttattttgtacattgcaaactcccaggataaagtaaactgattagaaattacttaacttgttttaattttttacttttataccacagattatctcaagaacatgagttggcagttaccttcttggtttaaatatcaattttatgttgatttcacttccatttgtgaaacaaaaacagtagataaatccactcttgcttaaaaaaaaaaagactagaataagaaaatacagtcattcctgggtatccacgtgagattggtagatatccggcccttctataaataccaaaatccaaggattctcaaatctcacagtcagccctgtggaacctgatgacacataagtcagccctcgccctccatttctccaaaactgtgggttctgcatctcaggaatattgtattttctatctgcagatgtggaatgcatggatatgggaggccaatggtattgccattaataacatcaattaaagtcagttaatgttcaccgtgcagaccgtatgaacttagactacttagactactctctctgcctacctgagttgtgaacttcatataaaatttaagagaaaatagatacaacctttgtatgcaaagtaatatctgagctgaaatatgaaatcaaataaattttgatgtgaaggtattttgttactgaataaaagctaatatattttgtaatgttttgctgtctcactatcttttgagggtgtatttgttgttttagcaaaaagtatcaatatatgggttctgatagtatcctttgagttggaaagagtacataaattgtattaatgtcaaagaatatcttgatttcaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtga

SEQ ID NO: 125834 - DNA, 1058 bp, Homo sapiens
tccagcgattctcctgcctcagccttctgagtagtagggattacaggcgcccgccaccacacccggctaatttttatgttattagtagagacaggctttcaccatgttggccaggctggtctcgaactcctgacctcaagtgattctcccacctcagcctcccaaagtgctgggattacaggcataagccaccctgcccagtcggactagccacatttcaaatgctgaatagccacatgtgaggagggtactatattggacagcacgattttataggatatctttatttgaatgtcccaccaatacctcaaatttaaccagtcctccctcataaatctgtttttcttattccattcaaaattttggtgaatgacatctccattcatctactcactagtccagaaacttggtggtcatttaaaattcccctcttcttcaccttctctctcttatccaactccttatctaatcctgtcaaaccaagtaaagtcagaaaactcgagaaaaaaaagagaactttcaatctgataaaagggtgatgcatagctatcaaagaaccttctgctataacaatcccagaggctgggtggcttaaacaacaaacatttatttctcacagttctgaggcctggaagtccaagatcagggtgccagcatgattggttcttggtaaaggttctcttcctggtttacaacagctatcttatccttgtatccttacacggtggaaataagggagctctggtctctttacctctgtctggttttggttggagttaggctgatttaaagtccatattaaagagcaaaatatcaagaatagcaaaaacaattttgaagaacaacagggatctttccctactggatataaaaatttactttcaatttaatactcaagatagtatagtatagacatataaacatatataccgatggaacagaatagaaaactcagaaatagacatttgtttataatggatcactaatacatgacaataagtggcattacaagtcagtagaaaaagaacggactatatggttgtgagtcaaatgattat

SEQ ID NO: 125835 - DNA, 2975 bp, Homo sapiens
actaaaaatacaaaaaattagccgggcgtggtggcgggtgcctgtaatcccagttactcaggaggctgaggcaggagaatggcgtgaacccaggaggtagagcttgcagtgagccgagatggcaccactgcactccagcctgggcaacagagcgagactccgtctcaaaaaaataataataataaaataaataaataaatagttgctcttcaagggacaggagaggggatgattgaaatggtggatctggtggcagtctagtcattaaattgttagattgagaaggaaatgaaatcaggaagggactgataaatttaaggataggtgtgttcaagggaacaagtgtttcagaattgaagctttgagagaccaggtaagatgggaagttgtagtagattcctttcagaagtagagcagttccgtatggtgacaaggtctagggtgtggctgtgggagtagcgtccttgggattgaagaaatgaaaaagtgaacaatccatgaaagcatagggtgttgaatgagtcatctgcatattcatctaagtcactgagactaacaactggagttaagattgagggaaatgcctgtgagctattttcccagagataactataagcagcataaaagcagggaccatgtgttttttttttttttttttgctcagtgttgtatcacacagcgtgaggtacacagtaggtatttaataaatattgaatgcctgaaacaaaattaaattttttcaaaacatgccaattaggcctttcttaaatgatttaaaaaattgttttatgatgtctgtgcagagtaaattgctcctaagtctgtcacaccagtcggctacctttttggtaagataaaatttgttaatgctctactctgtatatctaattatggtatcctaggcttatattggttttgcttttagattaaagacttgatcttaaacagatttttaattctcaggtttcaaaaaataagctcatgcttttagttttactagtagctaagtaatggaaattagctcccttttactaaaaagctactagttttttttcttgtttaaccagtctgttaggtttggaagacctttttctgtctgctatacagatggaaaaatcccttctcatgaaaaaacactgagcatttgaattagtatgttctaatcagaatattcccaaatgtgtatctttatttcattgttttattttgtttgtaaatagtaattgaaacatttccacagaagaaaatttttctcctatagccctcctctatagctgaatatatactaaaatataaagctatattcagctgaaattcagtttttagtaagtgtaaagctttaaatggctgcattcccacagttggaaacacgagtatgtggttggcatggtgaatttatttgaaataaaacatgccaccatttaagcaataaggttttcaggtagttttgaatgaataaggagcaaagcagttgagattttaagtgaggataaagtataatcattttagaagttctaaatttttggatctgtgatgctgtcttcaaaggtaaaaaaaaattttaagttctaaattttagtttgaaaacatatatagcggccgggcatggtggctcacgcctctaatcccagcttgggaggccaaggcgggtggattacttgaggtcaggagttcgagaccagcctggcaacatggtgaaactccatctctattaaaaatacaaaaattagtcgggcatggtggtgggcacggtggcaggcacctgtaatcccagctgctcaggaggctgaggcatgagcattgcttgaacccgggaggcgaaggtttcagttagccaagaaccacactccagcctgggcagtggagcccaacacagtctcaaaaaaaaaaagaaaaaagaaaatgtatttagagtaacctatgtgataaaattataaaatgaaattatttgctctgatgttttccctgaaccttttaaaaaaaatttcatgtgatgctgttctccacactgcagacatgattcaacaagactgtttttcagtgtacattccccccccccacacacacacacagaggaatatagcagtcttttttatttattttttcaagtttctacacacaacattgaacatgtaatttacccttttttttttttttttttttttttttcagacggagtcccactctgtcgcccaggctggagtgcagtggcgcgatctcggctcacttcaagctctgcctcccgggttcacgccattctcttgcctcagcctccccagtacctgggactacaggcaccagccaccatgcctggctgatttctttttgtatttttagtagagacggggtttcaccgtgttagccaggatggctactatctcctgacctcgtgatccgcccacctcagcctcccaaagtgctgggattacaggcgtgagccaccgcgcccggcgtaattaactcttttaaaattcaccagtttctagttgctgtcttctcttttgccttttggcattctagaaataatgtaatatcagatgctggatagagtaattggcaaggtagctagatgtaaaaggagtgcttttgggaggacaatgagaatgtcctgatttcctatttctgtctctagatgggctttcttggtattgatattcctttcttcatgtaattaggaagaccttaattcactattccagactgagagtttaaaaatgtctgtaaatcagtggttgaaatctgttggctctcaagcttaaacttctttccttttagcttcttgcacttcctgtttctggctttttggtttccttacgcttaacaattgtaaaatttctagtgaaagtttgatacatattttggtacagattatttctttcccaaaacagaatattttgtttggagataaatgaggaaataacatttgagaaattaagttggtagttaataactagtatcttagcactcttcaggac

SEQ ID NO: 125836 - DNA, 1543 bp, Homo sapiens
aaaagaaaacagaaagaaaacctcaagttacaaatgtacaaacgtatgaaataagtgtaatgctgagttttttcttcaatgaactgaatttcagtggatatgagatctcattctctttaatattgcagtatttatgaatatttctaacttgaaataatgaaatacataaatttttttcaagatctggatgacagtccttttgccatctacttagtaaattagcgatctgataattgtttttaagatctgaagaattaatgacattttatatgtagtaggctctcaaacttgaatgggattcaaattactcagaatgagtatattttaacaaatgatttcatattgctataaataattctactgtagataaaatttatggtataattttatttttcttttctctctcttcccctggctccctcaaggtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacaggtgggtataatgtagacttccgaataagaatattttatcgttttcataatattaaaagtattcctgaagtactttattatttcattatatcatttttacctaattattttttattttgcttttatagtacctaaccaaataaaatcttaacaattcatattttgttaattttgtttttctgtggtaatctacttgaaaattaatcctcatcttaatcttttttagcgattactttttgcaaaactctttggacatttaacatctgcaaggagggctcgaaaatctgaggttcctcatttccggttgaagaaagtacagaatataaaaatgtggctatctctccgttcctatcttaaggtagaatgggagtgataaaagtagctttaacatgctggccctttctgatagttccagtttctttatcaatatatatttgtctctagatgtatagtaaccagcttttactcattcaaaaactggattagggattttgtttctactagcctggttgtcacaagccagcagagggagcccactacttaaaaaagaatttaaaaaaaataaccaatgagtttcctcacagaagtgacctattactattttaaaatattagtttgcaattcagtgtcattcttttcatgtcattattttcctttaatcttttgagtaattttcctaattatggaagtatgatataaaaactctggagggaagagggaaacatctaaattggttttaggaaaacactttttttctgaggattacttcttgttattgcattaagtagcagtagaatgtcattatatatggagtaatcatgcaaattccaatgatatttattcaca

SEQ ID NO: 125837 - DNA, 1039 bp, Homo sapiens
ctgacctcaagtgatacacccaccttggcctcccagagtgctgggattgcaggtgtgagccaccgcgcctagcaagaagtatttatttttactaataaagctttaatttaggtgataaaaaagaaaaaagccttatttctatttttggccaaaagttgtattatttatctgtatagcaatgcatacatcttccaatatatgcacaactaactgttaggaaggtgtaagataatcatattaaacaagtactgtgtatatatatatatatatatatatatatatatatagccacttctcaagagaaagcaatagaaatctgattttcacatttttgtttgtgtttaaggtgagttcttcttaaaaggataaaggagttaaaatattagaaactgcacttgtttgtgaatgaaatttgaatttaaaaatggtgttatatgatataatttaagctttgatattaaaactggcttgtcaccacttctatttttttttttctagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacc

SEQ ID NO: 125838 - DNA, 1858 bp, Homo sapiens
gaacaactgaagaataaggctaagaaccaataaaatatttctctaattgctagttgtaaaactgtatccaaattttcagaaaagacagcttcagcttgcaaattctatcctctaaacttatctggtgcattctccccaccccacccccattatataagggctattttagatgcttttaacctccccaacaaataatttgccaagtgtccaatgagaacttatcatgttggtgtgttaggtaaatcgggcaaatatgatagtgtcttacattgggccttgattttaagttgttatatttgtacaatcgagtattttagaaattacatgaaacatgaaacagtttttgcaattttttttaaactgggcatctggtttctaaaaatttatttgaaacaatctagaattttcttggtgcaaagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgtgtagtatgttttttctttctatgaaaaacaacagaaagcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgactgacggtgtttttttttttaattttcaggtcatatacatttctatggtaattttgtgtttacttaacataaaatttagttagatttggggggagtgaaaataaattttttataactttccaacattttagattttgttatgattcttagaacatgaaagaataatacacaggtttttcatcaccaaaatgatattatatcattaatgtttgtttgcttctttgtttttgaatacagcaaactggctgtggcctgaaatattaaagctcattgtgaaaagatagtggtttttttggtttgtttgtttgttttgagacggagtctcacactgtcacctgggctggagtgcaatggcacaatcttggcttactgcaacctctgcctcccaggttcacaccattctcctgcctcagcctcctgagtagctgggattacaggcgcc

SEQ ID NO: 125839 - DNA, 1038 bp, Homo sapiens
acttctaaatttcatttcagtaacttgccacagtggtcatgtaaaattccatctaggaagaggatcatgagatgctttgttccataatgcctgaggatccgaggacccaacttctaagaagcaacactagccacagctggccactgaacactaatatccaaagaatgctttgtgtcctcttagtccatttctttacaaccactgcctcctcttgagctgcattaagcgacacctgagagtgtctctgacagttctgcaaaaagtgctgaggaaaaagaagatttttttaaaaagagcacagaaaaaataaagaagggaacagaagagtaaaaggatggggcacagttaaacaacatgcaaagcaactcaggtccaaataggtgtctaccagacaccctcatctaacaacctccctggtgcatagtttcttgaaacaagagaaaggaatagtgattgttaactctgttgcagtgaggtaaagagatggcccttggatttcttcactttaagttcttgcattaataaggaaagagacaaaacctgatacagtaattgaaacatgtcgtcgggccagaagagcaactaggggaaagtcagaaacatcacaatctgcgaagagagctaacaaagcaggaaggaaaaagaatgatgtctcccagctttgtacatataattttagttattttgtaaagccagactccaaggaaaaaaagaaaccaaagaaaaattatcttcctaaaatgttcttattttccctaaaaaaaaaaaaaaaaaaaaaaaaaatactgctgcctcaaggcacaatctatcatatgaactttttttccagttgactatttctgtaaaatagtccagaccctgcagcctctgaatctgtgttcaaaattaacaaagaaataaaaaataaatcacatctaccagcattcttctctaaggggtctctctttgcctctgtttcctgctcatgaaccatgaagctggccacccctgctgggaagaatggaagagtgaagatgaaataaatggctggcacatacc

SEQ ID NO: 125840 - DNA, 1058 bp, Homo sapiens
ccagtcccaggtgggcagggcaggcccctggtgtctctggtgttacacagcacatgtgcacagtttaaaaaacactggagtatatggcacctcacatcccttccagcttgaaaatattgatgatggacagaccagaggtggaatcagagccccgacaaaaatatagctagtgtgaaaactaaagcaggacggtgccataggggacagaaagttacaatcctgccaagttcaatgtagtgtatatcaaaactgttttttttaagtggccatattttattcactcactaaatgtactttttctgagtactaactatgcactggtaatacaacaagtagaaagacgcagccctgtttgcgtctgatctgtttgagacatggctgggtagactcgtggtaatcacagttggatgtgaggaagtggtgcgaggggcaggagggacagggcggtcagcaagagccctctaggaaaggagacacctcctctgaatctagtagctaggtgaaatgagagaggggaaggaagagtggaaaatacatgtagaaagagaaatgaagtatgcaaagtttcagaagcagaagagaactgggtgggtcctcgggaatgagaagccagcccatcagccaatatgaggaaggtgagcagacccaggctcaaaaggagcccgccatgaccctctaggaagtttggcctttgtcctgaggaccatgcatactcagagcagagtttcagcaggagggcaaactagtctaaatcttacatacgctgccggtcaattcaaagcaggaaggaaaaattgagtttgaatgaggcatcagttgatgaatgaaggtgaagttggcagtgccaataggtggtctcagggagtctggcttcctccttgataaaaaatggtattaatctctgccttctctatcttatggtgctatggtgaggatccaagaagatcacgtatgtgaaagaacatgataaactgggaagtactctgcaggtctttaaattatagcagtagcaacatcagtagcagcattctgggggaggaaccaccagatccacagta

SEQ ID NO: 125841 - DNA, 1030 bp, Homo sapiens
gaaaaaaacacttggcaaagctcaaagattcatggtttatcagctcatgggccagaatccctgattgctcatctgctgtcctatatagtttataaaatctgtaaggattgaacagtatttactcactctagggttataatttaagtgcttctcaagtgcttaataaagagtttcacattttcttcaccttagttgactctctcttggtttgtaaccaagtttaccatggctttttctagaactttattgattttaattgacagtttctactgaaacaaaaggaaagaaaacaaaattatctactttgtaataggtggattctgtaagactgcattgataagttaatagtagattattttatcaactctgttttatcacatacaaataaaggcttacagagtactttttcttgtcagctaagtaaagcatcttttctgaaaatgtcattaacaccacttggagttcatgtagaaatcaacttaaagatctcagaatgtttaaagagcttcatttataatcccttcaatataaaggagaggaaagggcaggaactcactgtatctgtatcagcactaaaatgcagtgtaaataatgaattcttatttatatacacccagttttattactgggctaaaatttgatgaaagagaaaagaatacacacatctttattcattgtttgcaatgcaccttgaaaaatattgagtgacacctttacatctgaaagcactttcatttaaagtagtagctgcaggggataaaaggacactttgtaaaagagacagcaaagtatcatagatcattctctgtcactcacagacggacagctaagacacttcccagtggactctgggatatatttgaagaagtgcccaaacccagagactcccgatggattgagaaaatggcaaatcttccatcatgaaaaggtttaaaggaagaatatgttttggagtaagccagagaaagtataggaaattgttgaagcaaagcaaatcaatactgagaaagaaaatgaccgagagacaaag

SEQ ID NO: 125842 - DNA, 1024 bp, Homo sapiens
tatttttatacctcttccacctccccttctgtcgttctgaaacaaacagaagccagagaagaagaaatgagtgggatcgagtccattttcctcagtaaacaggttgcatgtgcattgagtacccaccatgcatcaggcatcctttcaggtcctggggatctgtggatgtgtaataccagtctctgccataaaggaatgtacagtctggtaaagccacagaggaatgtgagtaatttaaaagggcacctggagataagtgctaaaagagatgtgtacagactgcagagcaaggacagaggaatgagtctctcataagaggagatgtcatgtggagagatcagggtggatttcacagaagtatgattcagagacggaagggaaattaagaatttattaggcaatccaggttcagagaatattgtgtgcaaaagtgcagacatccctttattcagcaggcacatgtggagcatttactatgagcctggggctacgtcaggtacaatctcttcttataagatgaaagcagtgtggtccttgggagtctctaaatctgggagacatggagaaccatcagcttgtctgttatgcctgaagcctaggagacaacagagaaggaaagtggaaacagaacttaaggtgaaaggctgccaggaggttgatcaggaggaaactataaagtctgcttaagaggaatggaaagattataaaagtaggggagcaacatgatcaaacatgtaacattcaaaatgattttgatcaaaagatacctctggagagagagagaaacagaagtcagaaaagaagttaagaaatgtgtggaatcaagttcatcttcctctccagactcatcccttctagttctctttattcactgcaccaatgggctcccttgccctgtggcttccacttgggttgggtcagtgggaagaagtagcaggtgatcacagggcaggatgagagtggggtcctggttcttaatgcattggtttctttgctgctagtttgctgtatcctggtcatctac

SEQ ID NO: 125843 - DNA, 1192 bp, Homo sapiens
gagggaataaaagctactaagagtctacgtatgttccaaaagcaatgtaactaaacctttaatggttttgctcatagtttttactaaaacattttctttaatccacatgtgcttttctgacgtctgtgttagggcaatcaagggttaggaaattagctttatagaatatagccaatgtcaactttttcttctctcctctaccccaaaccagcacactttggaaaatacctgaaatgcggggcaaacagcaaacactctcaccataagaatacctaactgaattaattattaaagagcataaaatcacaacaaaggtattaatatcacaggaagccaaaattccgtgtgctacccaaatatctgtctagggttgctcttctgagaaaggtacaacattttatctctcccagtgccacagcggacacatcatctcattcattccgttaacacttgtccgtgttgagcacctaacagtaggttccaggaacacaaagatgagtaagatatgctccctatcttcaagtttctcaccacgaagaagacagaaaacagatggtcataatatattcttcagaactcaatagcagtcccctttctccatggaatagtacattctttgtgtccctcgttgttttctctttttctttgcctcccatggagcgccttccagtctgtcttgtggcatctggtcctactgagtttttcaactctcgcttctcactgcagaaccataaatcacagcagttttagaactaatttgtgtctctattaagttgctgagtacatgttaattttattaacactgataaagtagctttcatgttcttcatcttttatttattttccaactggaaaatatcctttgtctagcactgtaattctaaaacacagattttatctttcactttcaagtattatctctgagtaacaataactgattgatctttgagcagaaatagattttttaattacttaaaatttttcttgaaaaagtcacctgatcaaggagaatgttctaatgaaaatatcactattatcttaattatagttgttatttcacggactatatttgtagtaccgacgtgattctgatttgtgaactaatgaaataattgtcttgcttgttactctatttttctttaaaaaggccatatctttaaaaatagtcatttatgtgtatattaaatagaaa

SEQ ID NO: 125844 - DNA, 1048 bp, Homo sapiens
agtctcactctgttgccaggtgggagtgcagtggtgcgatctcagctcactgtagccccaaactcggagattcaagcaattctcccacctcagcctcccgagtggctgggactacaggcacccactaccacgcctggctaatttttgtgtcttttagtagaggcggggtttcactatgttggccaggctggtctcaaactcctgacctcaagtgatctaccctccctggcctcccaaagtgttgggattactggtatgagccaccacgcccatcctctctcaggtactttaaacttgactgtcaaattcatctttctccccctacatatacttttatatgttttctatgtgtttttatgtatttgtttgttgatacctgtttcctagccaagaagctaggcatcaggtctgttttctttgtccttattccatatagcaaactggccaatgggatgtgttaattttgccttcacggtgtctcttcagttcatcctttcttttccaacccaccacctttcatttagcccagaccctcatggtttctcataggaattactacagtgtaacatgtgggtgtatgtcagattgcccgagttcaaattctacagcacacttcatcagccatatgacctctattcacttcagtttccttgtttgtaaaatgtggaaaatgaaagcacctaccttaaatgaataaatgaatgcatgcctgaattataggaggaagaagaaaaattacatgatcaagccttagctttatcgaggtatgaatccagatagtcagaatctatggcagggctgtctgatagaaatataatgggagtcattacatttaaatgtaactttaaatataaatatatttatatttaaatgtgactttaaatataatgggagccattatatatatatgtgtatataactttaaattttctagtaaaaaaataaaaatacgttaaattaataatatttatttagtccaatatagccaaaatattctcttgtggcactagacacgttttaagtgctcactaggcacatgtggctggtg

SEQ ID NO: 125845 - DNA, 1040 bp, Homo sapiens
tgtatccattttgctgttgagataactcataactatttgcctcagtggtatatatggacaagtcctttttatgagaaactagtgaaatgtttaatcagttcagatccttctgttcacacctctctctctcatttttatatgtccttccaggatatgttgattaccattgaaagtcccacatcatatttatgccagtttaagttgatcacttccatcacagaaaactttaaaaattttaaaaattaagtcttgagaacatctactgaagtatggccgagtaaaaaggtttttattccactctccttccttgtatctcattaaaaattgccataaataaatacatgcgaaggagaaaagtaccatcataaaaaataagttaaacatatagtatttcaaattcaaaaaattcagagaaacataatttctttaaaaaaaaatctttaaaaagtacctactagattttaaagacgaaattacaagacaaaagaaacacaaaatagaaactggcagagcttggaaaagcaagagaagaggaaaaagcacaatcattctaaaagcaatagtaaaggcaataaaagtagcattaaaatatttttaaaaataaaaaagacaatataggcttaaggaaacaaatatatgaaagaaatacaaaaagaaaaaaattgtatgaagaagatacatgtaagaaacatggtatacctcacacatgtataattgatgttttcaaggaagaaaatgcattaataaatgaaatagaaaactgtcctgaaattgtcacatttaagcttacaaataaaaagagatggatctaaaaaatctgatataaaataaacattaaggtgaatcccagtaaattattataattttccagaacatgaaattatatgtgcgtttcaggaggaataagtgccaggtgaacctaaacttttgtggtagcaacagtcaatattggaccatagaataatgtctactaaagtttgaggtaaagtaaatttgacccaagtattttgtattcatccaaattattttgcaagggtata

SEQ ID NO: 125846 - DNA, 1051 bp, Homo sapiens
aaaggtacaaaatgtagcatattacttacaaagatagtgacaatatctctaagttcagttgtgtttgggtcaacagttatttctccaccagtgtcatgctaggcactgtgctagagacttgggtgtgaaaaatgagaaatgatccttaaggtggtttttcaacttgacagtgagaaagatgcatgactggagtctttcaaagaaaatgcaggggctgatttccacagcaggcttagggaacacagaggaggaagactgcatgtgtctacggcatttagcgaagccacattttatatattctgcatgagatttattgactattccttggtttaaaagcaccgtgctaggcactgggtagacatggaagaaaaacatgcacgcaaaaataaagaaaggatttcctttcgttttattatcccatcctgcgatgattacaggaaagatgaggggaaggaaaatcaggagtatttgagagtgggctgagatccagtattctcaggattctaaattggaatatcaggaatctcatcccagaggtaaagttaatataatgcagtttttcccacataaggccaaaatagtaggctccagacctgcactactattcaaggtagtctgcctctaaaaagataattgggagaaacaaaattaactatttcataaagagaagtcttcaaatttgcatgtggcataaccagtctttttttttacctgggctaatcccaaagagagaaaagcaatactgtctcattagtatggactaaggatagcttttcacttaggcgactttgtgtacagttgtgtagcacatgttcttcaattcttcttgactaaagaaacatgatgttaagtggaggttatttcatatggcacagcatcaaggaccttgtctcatctttgagactctctctgctctctagagtttaggaaggtgtccacacagaataagtaaataaaaataaaatgatgcagtgctttacttcccatttgctccatatggctaatgattctagttctaggctatttcatgaatagtagtcagttacgttag

SEQ ID NO: 125847 - DNA, 1051 bp, Homo sapiens
cttttcaagcataattctgactttctcagatactgtccacattcctatgttataaggtaactgttcacaggctagggactgagttaaattaaaaattagagattgtaatttatatgaacatatataaatgtacaaatatccagttttagtctatatttaattttgtattcatagccatatctgtacctttctgtataatagtacaactgtatgcagttgaatcccataaaattattgtatgatcagaactttaaagcatgatttggttatatttcattgacaccaatgaaacgtgttacaaaatgtgatagtctgaaaattaacatgacctgttctaactgggagttatgatttacttatgccacagttgtaaaaccttaatatatcctaattaaagtgaatttaacaattttgcagttctgtgacatatggaacttctcagctgtcttgcacctttgagttgttctttttattataaaaagctattaaagtcaattttaaaatcctgagagagacgcaagcataacatattgcataattataatatttcaatgttatttgtttttcccacatctctgcttatcagacttaacaggatggtaggtgcctaaaatatgatgctggtgtcctctgaaccaaatgtcattgagaaacaagttctagaattcagtttatagatcaggatgatttgtaacttggtcaactgctatttgttttcattcactacaaaataaataattcctagactctattctttatattatcggaccgtttttacagtggaaactaacatctagtttgttagaatgttattattctggacacctattttaagttttcttgccaagaaaagtgcttttaggtaatattgttacctgtgttttacttttctttaaatgacatagattagtattacttatttacaacactggatgttaatggattgctattgaacttgccagttaagtcatgattcttcatatgtgccacacttcggctcagacaaaagttagtacagtaattttctgaatgcaggaatacatataaaatg

SEQ ID NO: 125848 - DNA, 1046 bp, Homo sapiens
gaaatgaccacaagcagcaaaataaagacatttattttccccatcgatgatttgctattgcctcttatttagttttagaattctttttttaatttgttgtattagaaaccatttgttataatgctttcatcttttaaatttgcaatctatatacacttccaaatgttttgaaaacaagtagacaaatagtggtaagtcctgcgtgccaggactttgccatatcagaaattgaatgttagaaatatctggaaagagcccatgtctacaaaatgaaaattttaagttactatgaaaaatattctattcttagaaaaatttccaggtcttgcttttgataccagatgtttgaggctagaaactaactcattagacaaagcacaaattgtaattttaatatcaacaattatcattgctttctcatactcatttttcttccactttttctttttcttcctcctatttttctttctctttattattgctgttatttccatgatcaaacctaacatttcaagataatttaattttccataaaatctgttgaatgtcagttgtctcactgagttgtccttgtcacctgaaattataaccatccatccaacatgactattaaaaatgactgaaagtactttgcagatataagatgttctataaacacttttccccagtagcctacaacccattgaaatggtatttgatctggcataaattgctatttcaagcatctttgagccgtcataaatttggatgctgtcattgctttctgagtttcatattccccaaatgttctttattgaaatccaatattcattccaaagggtattacattgaattcaagttaactgagaacaggagccaaagaggccccattccctagtcattcttttcttaatgataagaatgagatccaggagttcacatttgattagattattctctctttctcaaatgtaatgctattctacaggaaacttaagaggcttctttataatttgcatgttggagaatgaaggtgatgataattccaatacacaccagggaaacaa

SEQ ID NO: 125849 - DNA, 1013 bp, Homo sapiens
ttagactgcattactctttccatattgaagacctatatttaaagtaatcaaagaatgctatatttcttgaagtgtaataaaaccccagcaaatttgacatgtaccctttctaccatggctacgtgcatggagcatttgcaatgcaatttagatcacacctggtattgcttctcggccttttggctaagatcaagtgtagatcacacctggtatctttggggctctattcttccctgccacacctctcactcacggaattagggtcggaaagcagattcaacaaattatcttaatatgaccatcaggaaaatctcctcatcctaatcatagagtggagtggtaatataggatagcagttgtttgagaggaaatatggcatagcagttatgtgcatagactccagagccaggctggctgggtccaaatcccaaatccatcacttatcaaccatgtacattctggacaagctgtttagcttctctgtgttcagtttatctgcaagatattgagaatggtacctccctcactggggttttgtgagttaatttatgtaaaattcttacattagttagtgcctgccacataatcagcaccgtgtaagtgtgaaacatgatggtggtgatggtgatgatgatgatgatgaaacgtagatttgcttggtgaatttttgagtatctacttcaaaacatttatggccagaccgtaaaattatcaggaaacagctctgtgataggctaggagtttgggaatacaatagcaattctttttgagataaaccacataggaatcctggtttaagaaatcactggtgtggccttctggactgagccctttcctgatagttaagaagcttgggaattcctacttgttcagttcctgacagtgggcaagtcatttctccccttgaacctctatttctttatttgtaaaatgaagatagtgtattagatgaattcggaggtgcttttcagctctaaaatcctatctttttaatcagctgtttgtaaatctga

SEQ ID NO: 125850 - DNA, 1032 bp, Homo sapiens
aatggcctacagagcttgcactatttgctctctggtcctttacaggaaaaaaaaaaaaatagtctactatttactctctggtcctttacagaaaaaaatgtttgctgactcctggtcctggcgctctgaaatatcacaacaatacctatatagagaatactttttaaaaatatatttgtttcagatatgcaatgaaatctctccatttgaagatgtgcttttagcaccggaaagtgctatatttaaaagatttctttgcaactttctttccttgtgttcactgttctgtctggaacccctattagtgagatgtgatctttctggactaatcctctgagtcacctgtcctccctcatatttcttttctctttatcacttcactcctcaatataaggaatttccttgttcttatcacacaactctttaataaaatgtctttacattttttccatcagattttttaaaaaagttttcaagagtcttctcttatgctgcagcttttattgtttgtaacatcttgctcttcttatatttttgtgactgattcttatgttcttatcttggtctttcccttttatgttttaggtttttgtgaaaagaaggtttattccttatagcctatttacatttgggaatgaagcaatagagacattgactgtgatctctgtgtacacattgatggcctcattttagggagagtgggtgaggagccagactcaatttttcaagtcccaaatgcttccattaggacaggtttacccatattccaactcagagactaccttcctaattctgatcagggagtcctgcttatttgcttgtttccttagctagaggctacgtggatgttagggctccgccattggcatcatatatcatcctgacctcatttacacagtgtctctgagtcccaagcctctggagttctgtggaatagagtactccccgcacctccagcttggattcatccctttctcaatatattcttgtctacagctagatgtggctacattagataccactgcatcaatt

SEQ ID NO: 125851 - DNA, 1090 bp, Homo sapiens
atttaccctatttccctttccaaaacgggatgactcgctttgctcttctatttgtgcctccttgacttcactttccttccaaccatgatatccatcattctaaaccagtgtttcctaaagtatgcttggcagaacataagtcatatgaaattctatcccccaaagagggaggaaacctgtggtcaaacaagtttggaaaatatactgcctaccatattctctttggaaaattcatattacggattgaatcttaaaaatttaagttctgcaataaagaagcctgtttaaatctgtgcttccagcatttttcaaacttcttagaccgtggaaccaattgtcatggagctctattaacatctccccaggactcatgttctggagcacacgttggaaagcaacaatatcattcaaccctccaggtctccactgtgttccctgtaaagccaagtggttgagctggatgccctttaagagttctaccagcactatactatgtagtgatggttttctgtccacacagccaactctgccacaagcagtcactaggactcagcctctagaaaccaagtcagcctgtcctcctccaaggccagtgttccctatcaccctgaagcaattggattgatagaacagtagaatggccttttgaagtcacaattacaatccaactaggtgacaatactttgcacagctggggcaaagttctccagaagaccatgtatgctctgaattagtatccaatatgtggtaccatttctcccatagccaagattcacagatccaggaatcaaggggtagagtggaagtggcaccactcaccatcacccctagtgatccactagcaaaattttgcttccagttcccacattacattctgctgacctagaggtcttagttccagagggaggaatgctgccaccaagagatacaatagttacattaaactagaagttaagatggccacctggaaactttgggctcctcctaattcaagaggctaagagaggagttacagtgttggctggggtgattggcctggacttatcaagttgaaatcagcctactacataacagaggtaaggaagagtat

SEQ ID NO: 125852 - DNA, 1044 bp, Homo sapiens
gcattaccttgaatcagggtatttcaagacctctcattgccttagatcatcattttattctaattaagttcaataattatacatatagaatatacataatctattctgcttttaggatagaatgctaattctttgatatctgattatcaaaagaatcatattattggaagttattttctgggagggtttctaataacatttatgagttctctacttcataaggtaaactgtaaaaacaatgggtaaacccagactgcattttaataagaaagggagctaaaaacaaagcacagggggtgcttcagtgggtgcgctgaaagaatagagtgaatatccaatgaatcaggacaatgtagacattgaaggaattaatggaaaaaaaaaaacttacctcatctctattatccaagtaagacaagcacaaaggcagaaagtttatagggcatgtgtgtgtatctgtgtttatattttgtgtgttacatgaattatcagaaagcaacttaaagtgttcaccaagaggctggagggtctgtattatcaatctctattacagtagaaatactactactggatcaaaactacttcaaagcctcatggaggggctgtttccaggatatgtaatgattgatttgaaataacatgacatgagagacactactaagaatcttcaaggataacagagtatttttcaagcttcatgaaaaatgatgaagttaccatgtcaaggattgctaaaagcctactcacaagaacgcctcaaatcaccactgagaaagcatctgtttcttgatagtttttgaggagctgttttgcagtgtgaggtgacactatctgttcggatacaaagaaataaagtgactattgcatgctgttgttcttgttagctggacatcatgtcccctcaaacagaatactacttacagccgagtagcacttaattttctttcaacatatttggattggttatatcttattgtgtttgaaatgattaatagtcagcagaaatacttagtgaagggaggacaaagactactgctgaatatc

SEQ ID NO: 125853 - DNA, 1065 bp, Homo sapiens
agtaggtatattatatttatggtatacacaagatattttgttacgggcatgcgatatataaaagtcacatcagggtaaatgaggtttctatcacctcaagcatttatcctgaaacagcatttttatgggtgtggctagaggctttgtagcagctaaaacagacccgttcaaggcacaggtcttgaatttgttgttttaaataacatttttctattacattgaaatcagcacacttggtatttatgtgaaaccctgtataggaattctgacaaaacagagaacaagagagcagtagagcaataaatacaaatgttattaaaatctcaatttgtaacctcgttccagttgcgatgcaaaatatatgctatatatatatatatatatatatatatatatatatatatatatatacatatatgtaaaagtacacacaaataattacaaagagtagtaacaggtaaacaattaaaattgtattaactcgaaatggggctatgggctagtaacatctgttaggtaggggaaaagtgtttaagcacagaactcaacttgggaaacgttggcataattacatttaaacaagaatttctggctatatgacctttcaaaactttataaatttatattatgactccagaaaatgcaacattccccaaacctatttgatatgtaattatagagagcatcttgtgggaccaggttcattcaagactcaggttgggaggtgctgatatatctatttaacataatttaaataatattcactgtgtgccacatactattttaggcaatttataaatgttaccaatttaatcctcataattcctcatatgaggaaggtagtatgttatcccagttttacagctaaagtaactgaaacacagagtaagaaatttgtccaagcttgcccagctagtaagtgatagagccagggtttgtacccaggcagctgtctcaagaattcatgctctttatttctatgcagatacacaaagtaagtgctattaaccttaatcctagggatttaggataattctggataattaaacatcctagttttaacca

SEQ ID NO: 125854 - DNA, 1074 bp, Homo sapiens
atgaaaacccctttggatttcgaaattagttttccactagttagttttccactattccattgtcttcttagtccagctacccaataaaaagcattctctctctgatcggtactgcctccctaagcttcattagatcagttctacttctccagtacctgaacttgaatatgaatttttcctttgcccctttcttggaagttttctgtgcatcccacacttgcccgtgactaggacttagattttggttctgttttttggttcagtctgtgccctgaggctatgcaccagccctgtctcctgacagctcccccagacgctgtactatgcagagcactagcttttctgcttgattgtaaggggtgatcagaaagtgttaacttcaggcaactcatttaatatcactggacgccatgttgtttctcattccaaaaactaagaggattggacgaaattatgtaataaatgccaaagagttctaattttctagtagaagaatccccagtaaatccataataatttttatgggaagacttcttaactcagaagaaatcatgtgaggttgcaaatgccagtcatggtcatcaaacacaaagccttgcatgtaatgccttagacatggtaattggttgataaatgcttattttttttaatgataggaaagaccaatcttcacatagctatgtgcctgactcatttaaactttaagtaccattcttataaaatgatgtttcattttaaaattttttctttaactgaaaagaaagcataaaaaatatactttaatatatgtcatttaaaagttttctgtaaatctaaattatgttactataaaatagagaaaaaagataggcttccatacatttatataattatatatataaatcttttatataaaaacctgacatgtactaaagtattaagagacttagtagagccagatcaacacaattgataaattataacacctacagtatagcaaagcagtatgactgatattactatgtaactgcaaataatattttgggccatgttcaaagcaggccctatgtaatggacctcaacttacattttcct

SEQ ID NO: 125855 - DNA, 1070 bp, Homo sapiens
tttgatttcactgatatagcttattggaaatatgaatataatttcctgtaacttcactgtagtggaaagcattcgtattagtattttttaaaaaaggaatactcagattctctgaaggtaaacttaaggcactttggtaatcatggaaattatttctagattaatctaacagaggcaggctaatagtgaattcttaatagtcctcctaacatcctaaagaaatgaacttgtacacatgtacaatagaaaatcctttaacaatcttataaggagaagtgaataggtatactttttttctatagctggaagaaaataactatagtatatctcagagtttcaaaaagtgtattcatcatttaaggatgagagaggatggggaaaggcaatgtagacataataaaaagggagagaaatagtatcttaaagacctgaaaaaaattgcaaagctcacaaaattattcattacaggaaatggcagagcattttaggaaatgtccattgtattttttacagtgaggttaaaaaagacatttgctctacgagatgaggatggaggtttatttgtattcatggcaatctttttttgtattgctattatgtgtcagacactatgctaagtataataggtggatgatctcatttaatgtttataacagcccttggataaatactagtagcatatccattgtaaagatgagaaagccaaagctttcagaaatttaataatttggttaagaggaaaaataatgtaagtggcatagctagaatttaagtccgtgcactcagtctcaaaagtttaaagtatttaaaacttatttcataatacttcctatcaaaatgagaaagcagactgagaagcagtctgaagtgaaatagaccaagcctcaataagccagaccaccatacaaataaacaacaggcttaaatttccatgaatagaataacagacaacactgcggagaatcaactcagtgatgtagaggacaaacttccaaagctctccctaaatgaaaagaaaaaacatgtgaaaagagattaaacactaaatatcaaaaatgttagagagatga

SEQ ID NO: 125856 - DNA, 1149 bp, Homo sapiens
taacccgtatgaggccaaggccagtttccaaaaaagtaaagtttatgaaggaaggaaggaggaaagtaaggaaggaagaaaaggaagaaagaaaaggaaaaaggcagggtgagcttgttttgattcctattaactaacctggattagagaaattcttagcacaaataccaccttttctgtgaacttagtgttcctacaccctacgtaagattccaaacatgaattatgtatcccttggcttctgaagagcaaaagaaagaaaatcatcatcaaatgtatttaaaaactgtggtcccacatgtactctaccttacattttattacaaatatgatctgcatttcctttccacattttgaacaaaacaatattttattaaccaaatctctcaaattttcccaaccccatgccaaatgtacccagtgtaataattcacctcctggaatcttgtttacagtcaaaatcacagagtctgatcaaaccaaccagatgtttatatagtgaacatactaatgaaggccccagatattgatatcgttaggtgaaaatagatttaacctttgattttatattctaatttataattaatgttcagtctttcttactgtaaaatttttataatggaaaaactgaagaaatgacaacatggatttttatcagtctccacatttcaatgttatagaaacaaaatatattgtagacttcatggattactttttagatatttatattaaaatttaatattttatttataatatactttcatatatttaaattatatgtaaatgtaacacacttactatactaaatttatttaaatttaatatattacttttaagtattttttccatttgcttaagtaaaaattatgcccatttgacagagtgtatttaagagaagttgaatctatacaaaggtgtcagagaactgttgaaaagtgtcacgatgagaaatgataaacctcaatttggtgatatgactttagggtaaattcaactcaattcataatcatgttttttgtttattccatcacaagcaatatatatcctaacagtcagatatcttcaatctttgatcaaacagaaaattgccaatatatatggtaggtatactgatttgttcaaagtggttgagaagaattgactagaaga

SEQ ID NO: 125857 - DNA, 1049 bp, Homo sapiens
atctggtttgggctatttgctgacagtgcatggttcttgaataatacagataacgtacaacaaacacactctgctccctggtacacaggaaatgaagatgctcacagtacccgcctccatgaactagctcaataaatttgaattgctcattagatttccaatgcctcgttgttgcctatatgtgaagagcttaagtgaataggaatcagatggaaggtgggggagaacacacagagatttcacataattcctgttgccagagaaaccattttcttgctgtctgggcatgcaccgagtagcttagatgaactggaggctcagcacagcccttgctgtgactttagtaaagaaaacaaacagaagggagaaaatgcttacaaagtaaagcagaattggatattaaaatgttattttaattagaatggttttgtagactgagctttgaaaccttgccccctaaggacactgatccatctgactacacatgtgtttccacactttgtgttcatttatgtatcttttttcttctgtgtctagaagaccatgtcttcatatatgtttatgtacactattcatatttacacaagtatattctcttcccccctctttctttcacctcttccccccacaacacatatcacacaactgtgctcttttgaaaacatgggaaactattctcagtggaaaaaaaaaagaatgtggcagtaacagagtttgcttacccaagccgaaaagaaataacagaaaacgaggaagcacaaggagagtacaaactgtgaattctagacttgtttatttaacacttggatctttttgatgaaggatggttgctaaaaacaaaagttagaaaatcaattgagaatacgtgaggtaaaacgttctgtatgcatggttctccatgcatttttccatgcattgtgagtatacaaactatatactgaatcaacatagtacctccttttgtgatactattgaaggaaagcaagtaagagtagattttgtatttatttgtgtatgacagctctgaaaagagctattacatattttga

SEQ ID NO: 125858 - DNA, 1043 bp, Homo sapiens
ttatatatctaaataaattatacaactaatggttaagatgactgattttagacccatactgtccagatttaaatgtcagcttcacttactagctgtgtctaggagcaagttaattattctgtacctcagtttcttcatccataagatgagatccctaatagtttgaatctcataggtgtattataaggattaagtgagttagtacacactcagtgttgtatgactggcacataggaagcattcagtgttagctattactatttatagcttaggggaaaaacaaagtcatacttatcagatgtcagtactgtgtttctccaaatgttgcttctaaatttatccctcttaggaaggcaggatttatttgtaattttatatatagttaattagatatattttgacatatttacaaaagaatttatctgcattttaggtaatcttatctagccacagtactatgatatatgattctggaaaatgtggaaatgcagccatttgatatatttttgtagattatgagttcatagttaatgaaagataaccgagtagatttaactaaatatttataataactaaaattatagatgataaattatataaagtgaaagattagtgcacacattaaactggagttgcatatcacctctatttaaactttttacttatttcaagaaaataatcacaaacaactaccctctagaaaagatggttcaaattaaattctgtccacaggaaaggtatgtttggagagtaagtcccctgtaatgaaactattgatagtactgcagccaggcccctcatatgtcaaacacctgctttggtgagacaagtttaatgcatagaaagagctcttaatagcagcaataggattccaaacccttggcatgacctttgtcgttgaaagtaaaagaaagagggttgcaacttgcttattttcttcgtgcaagatcctgcataaaccccaatacacgatcataattctaactaaatgatttttttaaacgtagtggtttctatcactcactcctttttcagtagacata

SEQ ID NO: 125859 - DNA, 1055 bp, Homo sapiens
agttttatgttagtgttattacttgattaatgtctttctctgccaggaggcaggaccttctaaagtgagggtccaaattcattttgctcacaaccgtatctatctgtaggacttcaaatcatgtcaactcagatataagatatgcactagggccgggcgttatggctcacacccgtaatctcagcactttgagaggccgaggtgggcagatcacaaggtcaggagttcgagaccagcctggccaacatagagaaaccccgtttctactaaaagtacaaaaattagccgggtgtggtagtggacacctgtaactccagctactcaggaggctgaggcagcagaattgcttgaacccgggaggcagaggttgcagtgagccaagattgcaccactgtactccagccttgttgacaagagcgagactctgtctcaaaaaaaaaaaaaaaaaaaaaagatgtgcactaaacatttgttaaatgactgactgaatgaataaatgaatactaaggcagcaatatagtgggaaaagatagtgtaactagcctggctcaacaaagagcaattctcttcactgggttggctagtttggaaacctaataggtggatacactaggacagtcccaggatctcccttctgtcaggattttccatgtaagaaatcacacttgagtgcttgctattacaatatttcaaaaaagaaatttactacccatatcaacaagtatttagaatcagtctggcaaaatcatagtctgtctttccctctccgttcctcctaaggtacctcttttcctgaatctcccactctgatcatcctttagttctttgcatccaggcccttctaggtctcatccgaagatggctatgctttgctaactaagctggtaataagttgtgaggcctgaaaacccatctaaggtgtgagctttatttgcattttgagcaaaattatcatgtagtggttagcactctgcttattaatatggaggctgtgaggcataacatagcacgaagcttgcctgtaggaagctattttcggttgtggagctaagact

SEQ ID NO: 125860 - DNA, 1046 bp, Homo sapiens
tgtttggagaacagttagtgttttgctccagaaagctgcaaatgcatgattaggttattgtgaaatgtaaacagcagatatctgctgacttggcatttcttctaatgtcagaatagttcagagaaccaagtgcatttgccttatctttatttcccacgtaattgacttcaaatataataagtttgaaatggcaccccatcaacaaagacacacaccaggtattcttccagcagagtgtgttttacctcctattggagccgaagcttaaaaaattaattttatggggacctggtttggggaaaaaaatacaatgtgttataattaaaataggtttaaagccttttttacaaccagtgggtacagatgtgtgtaaaacaaacacataatttctcttgtttcttgctgtgcagatagagtgtcttttgttccagcatgtgtattttcctgtgtttttacaaagaaagcattgcttgtgctttccgtgatagcaaggggcttgtatgccaatttgccattgtgccctggtcaagaatctgctctattctgaagtaaactgcccagaggtattagtcaagaacgtggagaagggtggggagtaggaagagatgcttttttctcttcctcttttttttcccctttgactcagaagtgtctaattcacatgatgttaagaggaaatggggggaagcatttagttctgaataggatgcagttcggtgccatgcagttgccacagactataacaagaagatgctcggagctgagggaatcacatttgtaatggggactctttaagaaaatgttctgtgagggtgactggctgagtccctttggaccaaattaagatgcgctctggcagtgcactagcagctgtgagctgacattttcttgtgaacctagtgaaaaatggctccatatctctgtctcgtcctgagggagatggtctttgagtagtcgagccgttcctcagcattgtgatttgctctgatctctgttttctgatggggacggactgacttgtggttcctttcagttcgcctgccttt

SEQ ID NO: 125861 - DNA, 1031 bp, Homo sapiens
tttttgctagaaaatttatcttgttgaaatccatggaatcatgatgaactacccagaaatcttacaacacaacttcctgattttattaataatcaatattcccgaaatgacagaagttttgtaaatgctaagtttgaagggagcagctgtagtttttggcaaagagactataaatatattccatttatatctaagtttccacatatatcatggtaagagaatgcaagaactattaaacaaaaataaacttatttgagtctaaccatgactgtaggtacatctacttatttttcaagattttttttccagaaagtttacaatcaacagggaataatggggataaactttctattttagtttaaaaaaataaagtgacaggaagtagggagagtcaaacttcataaccaataaaaagaataatatcaaatatgagccaggcaaaatttggtatatcatcttgccacctggcccacagaatctggaggcttctattgttgggatcaagctacataggaggatgttgtagctaatatactggactttgaaaactgaaacaaatataacattttttctttccaccaacatatggtatattgatctgcaccaacataacttcaaattcaattttagtttcacaattttcacattactcaaaatatgaaattggaagcttaataggcaagtctggtttgggggatggagtagagaagtcaaagggattatgtgatggagatgagttttatgccaagataaggcttgatataggtgttgaaaggtgacaatttgaccattgaagaaaaggaggggtagggggaaaacaggtgttttttaataagcatgtttattaacaatggaaaagcatgagtaaagagaagtgtgtgtgtgtgtgtgtgtgtgtgtgtgtgtgtgtgtgtgtgtgtgatgaaataggctcaggaaactgttttaaaacaaggaaggctggatgagaggtttttccctgggatatagtagtctaaaagattagaaattatcagccgggcagagtggct

SEQ ID NO: 125862 - DNA, 1035 bp, Homo sapiens
tggtttcaattccaggatcatatttaatatgacttttagttagcaaacaatttcaaactagaaaagaatgattctgtttggcagtttattctgttgtgttttggcttacttttgaacagcaatgatcttaaatgctattagaacaataaatttcctctcctgttcactccatcatcacactcacgtaacaatgaatttgggatggtagagagaggacaagcaacggagacatcagtgaccaaacataattattccaaatgaaagcaattttaagttatgaaaactgatactgacatggttctttatattttttccaaaataaaaaatatataattgtatattatatattagtttactttttgaagactacatatctgtttactttttgaagggaggcataaaaaataaacaaatgggataagatgtgcccagccgttacctcctcactagactaatctagagctgtgagtacctgcctaagaagagatatagagaattcaacgagagttttgaacacaacagacatgaagaaagattggaaaaaagagagttgtgagggaaatgtcgaagaaaatgcaattgtaaaatagaaagcacgggacaatttaataatgtccttcaagtatatgcaaagctgctcaatacagctgctgaccagctgttcctaatcttccttgaaatcataagttggaaggagacaaaaattgtaatttaacagattcatatcaaagaagagataagaacagcagagaaagaacaaattagatttctagatcaccaagtgatcactatgtaaaataatgataaattgcacattttttgctggatgttgcctctgccagtgtgctctccacattgagaatacatgccattgtcccctattccccctttccttagaggataaattgtcactaacaggaggtgacataggctcccattgttttcattcattcatcccttttcttttttttttttttttcattctgataaaccaccactttctcctatgttcctttcattccaaacaaaccaaac

SEQ ID NO: 125863 - DNA, 1057 bp, Homo sapiens
gcaccgctaggtttcaggaagccatttatggtgtgtgtaccagttaggcttagatgggacttcatttaacaggaagagcaaaataaaattagttttaagatggtagaagtttatttgtccctaacagaaaaggaattcataagtaggctgtacaggcctcctatgaccacttaactatgttatcatggctcatattttctgctttgtcattcttagcttgggctttccaaattcaagggttgagatgatgactagagttccacctattatgtcaacattcaaggctgtgctcgctactcccttttaagaatttcccatagacacatacatacttctgcttaaatgtgattggccagacttagttacatgaccatagccaactatgaaggtgaggctgggagcttcttagcagaacacattgtccaggattctattactaaagaagaagtaaaactggatattgaaagacaattagcatgaaaagcaagcatctgaaatagtcatgccatagaaattacagggtgtttattgcattacactgcactatattcactcaagcatttgtatgtgttagtgtcctctttctaggtgactttatgagtctggatgtgtatgaaggaaaaatggtggcaaacatcccaaacttacctgtctgtaaactgagggtagatagtcaaatgcaggaaagtcaggaaagaaagttgaataaatattctaaaactagcctcaaaaatcagagattgactgcagacgctgagataccaatagattcacatctcgctttaagaaccctttcatatagtaaatctgagatacagtggcaaaaaagaggttgcgaatagcagctcccaagcaaaaaagtctatttaatgcatatttataatgcaaatacttaatgggatatggggaaatgatgatgacccagctctcttactgtaattcatatacagagagagtgtaccccatgagcagcagtagtgtgcttgaactgatggtaagtagaattaaagatggaaggaaaacttactggaaaaagagaaaaactacagcaaatttg

SEQ ID NO: 125864 - DNA, 1028 bp, Homo sapiens
ggtgaaatgtataatatgtatttcatcacaattaatattaaatgaaaagagaactttgaaatcagatgattttggatctggggcaaattgctgactgtttctcagtatctgtgtctttatctctaaaacagagatgttaatgtctaattcctagtggtgttgaagattaaaatgataatctgtttacaaataataaatatagtttttattgatgatgtgtacaacgatttcaaaatacttctaaagagactgactaaaaagtaccaatacgtatatttatttttacctttttatgttggttctaggagagtgctataatgttagaagacattatggttattacacgacatacaaattatggcaataatttaattgggcagccatgtaacgcaatcttgtgaatttatctacctgtatttctttttcttttttaattcttatgtttcatgagtttgtttttcaccatttatggttgctcaaatttagaaagcttcaatgatgtataagacattggctctggtatgagagaaaatcattttgagtgccaagaacccccttccttttgtttcagcattatacaggtttgtctatctaccttggcattctatatttattgccattggatagttccaagtttggtttctgactgaaccttcccagagtcgggctgtgtttttgcacactgggaacctggctttattcccttgaacaaaattgttagtagaaaaaccttcctaaataaaatcaagcaagtgaaaaacaaaccacaaaaaaaataccaaacaaaaaatgcaagtttattgatatataccttactgtttgaaattgcatgaagccataaatctgactgaattttattttttgtcagtgtggaatgcttaggacagctttagtttatcacttttttaattgcaaggggaaaatgtatatttctgacattttacatttttttctgatatattgtttgatattataattaaatttcataaagtacctggattttgggggaaaataaaatataaagtatt

SEQ ID NO: 125865 - DNA, 1046 bp, Homo sapiens
gcatgacaccttgaaaaatcatttcgatagatggcatcttttttaaaaaataatttaattaattttttaattttactttaagttctgagatacatgtgcagaatgtgtgggtttgttacatatgtatacatgtgccatggtgatttgctgcacctatcaacccatcatctaggttttaagtcctgcatcttatctactgttccatagaatcttcaagtttagatattcaagcttctatatcttcttagtccctttccttactaacttcacagagtaagtactcggtaaatatttattgaatgaagaatatacttgtttcaaggtgtaaatgaaagtttgtgtccaaaaactgccagttaaagtctagattacgtacaatacatttatatccaacttcaaatcataacaatattttatagtttagtgctttgtaataaagccctgcaatcagacaatagtaaagttggtggaagtaaagattttttttccttttttaggactaaaactaactgcagaaccatccaggcatacaggttgaagtgccctaattttcaaaagtacaattatgtcatttgaataggggcaaaggtaggaaggcagttcaaatcaaggtacagaatagatttactacatttgcagctcaagatatcactcatgtaaactcctgatatttgaatctgtagtgcaaaagtaatttctttgcaaagagcaaattttaaggggaactggcttcaaaactaaagtgtaaaaagttcatctctgacattgtgcatccctgattaatttgacatatttgtagagataggatataaatgcccaatgttctttgatgattctagttatatatgtagtaacttacccaaatcagtacacctcaacatataaataaccaatatcttcgctttaactcctcaggagagaagataagtcagaagctgtgagaaaatgagaaatttcttaatttcataatttctattagagatgcagaaaatcatttttacctttagattggcatagtgtaatatattacaatgacaattttttat

SEQ ID NO: 125866 - DNA, 1061 bp, Homo sapiens
tctacattgctctccctcctactgctcctttcaaagataccttcaaaggaaagtagatccacatttattaagagtcatactttcttcttgactgacttcaggcttagaataatagagtcagatctctatactcctttgtatctgaaaaggtaaaaacaaattatgtcaaattttctgaaaataaagattgactttttttctgtagaaatgtgaggtatatgaatagtgttgtttaataaacaaaacattgtttaaacattttgatcagtttattattttagaaataaagtaccattaatgttttgaacaaggttaatgagacggttctcttggggcataatttataagtgataccactgtagttttctggtacatgtagataatttaaatggtatgacctcgaatgttaaatatgattatttgctttttatctgtactgtccctattcttaacatttacactgtttaatcttttggcatgtttattatgctcactttccttttcattgcttgtaactcacaaattcactttcataatgagaaaagcatattcacatttgacatctctgattgattatagtttaattaatgactttcaaatacatacagaccctggcagaatcattttcctcagaaggtggggtagagcaatggttaaaggtacagtctcctaagtagaccacctagttttaattcctgagtatgtcagttagtgctagctatatgtacaagataactaacctggggtagtaatggcaccttaagaatattagataagttatgtatttaaagtgtgtagtgtctggcaggtgataagcattatgtagattttagtaaatgctattgcaaacatattggtcattttgagctagtgacattatgaggtgtttttaattttcaagatattttactcaattcaaattaactgaaaaatatgaaatgattgacattaatatagagtattttgcaagttgtattttaaggtttttttgcagaatgaaataaatattttatttgaaaagaatttatttgaagaataatatcaataaatacaatggaaaa

SEQ ID NO: 125867 - DNA, 1115 bp, Homo sapiens
aaatagcgggacctggacttgtggcgcgcctggtgccacatctcgggctctgcgagcgtcctggcgcgggatcctgccgtgagaaggagttggggcgggggacccggcggggcattgcgggagaaggcctgggatccctgggagccttgtagcgtgggggagttcactgtgtagagaggtttcatgtcttcatctatatagtcacttatttgtcttaaagttctcgaaattccctcttagagaaggagaaagttagagaactggaggctgcgtaccctgattacgcagaagggaagcagcctcgcattccccggggcaggcccccgcccgcgcgtcccgccagtaggggaatttagcggacggctgcggttgtctggtgaaaggctatccaaggataaggggcttcacttttcccaagtaggggaaagagaaggggtctacagggctaggggtggagggagcggatgcagtgagcagcctccgcagagaaattgacaatttaaccagggacctgcggcagagacaaggcggagacactcccttgcccaggaaagccgccagagtccggcttgtacctggggaagaatccttaagacggtctggcccaacactcctttgctcacagagaaaggggagaagactcccgagggtgaaaatggtacattcggagctggaactcagctcgctgaccccaagcagtgttcccttcttttcgccaggtttgcatccaagagaggggaggacaggggcaaaaggatgcagggaggctgctgatttccactgaagagctaatttcctgtgagacattaacagtgatttaagaaaaagattcctgtaactggtaaatgaatttcatttgcttaacttttagatgatatgtttcaggcaaaaaaaaagttgtgcacccacttatctctttaaagcggaggatgaaaagcattgaataggtaggattcttaatgtctgagatgaaggcgatgtaggaggcaaacaatacggttaaaaatgttgagtcgacccaaacagaaagaccaggtttcaatccagactctgcggcttactgagaatatgatcttgagtaaactgcttgaccttcctgagcctcagctttctta

SEQ ID NO: 125868 - DNA, 1053 bp, Homo sapiens
tgtttttagtagagacggggtttcaccatgttggtcaggctggtcttgaactcctgacctcagataatccacctgcctcggcctcccaaagttctgggattacagacgtgaaccacggtgcccggcctagttcatgttctttaaggacaattatgaatatttttatgcactgttaattttcattaagatattgatcaattaatagctatatatgttctataaattaatcctatctagtttcaatcttaaattgtttgcatataccaatctagtttattgtttgcatatattttatagtgtagagattaggcattttaataaaattttaaaatttccaggacatactgttaatgactatgcttcctactataggccataattaatttttttctattgtcaacaatattttggtagggatgatcaggaaataaggaaatgtttccttcatttgttaacaataggtgtttggggattttaaaatgaaaattgaagaagtaaaagacaccatatatttagtttgtttgatttcgtggcttcaagagttcaataatttattgaaatattttacagaccaaagaacaacagatatattacgtttataagcccccacatattttaaaggataatggtttatatatgaaaattccctgaacctacacttcatcaggaaaagctaaataaaagaagtttacatttcctaggactaatggagatttatttcccagtcctcttctctggagacaaatgtaggtctctcttgaaaagcagaaagttttgcatatgaggtatgatttagtgggctagaaacatcttttccaccctccccaaaatgtttcactatgttttatcatactatctgataattttgcactaaagttttctttctgtgttaagaaaatgcaaatatctctgaatgggtctctttgctttagtcatactcatatggctactactgaacaaaatatgttcattacaggatgaagggaatgttgccagccagcaaatccctagagtttgcactacaccaaacgttgcttagcaatttccacgatt

SEQ ID NO: 125869 - DNA, 1055 bp, Homo sapiens
ttgaaagtgcaaaataattgtaattttacattctccagtccctcataatttatgtgactatcatggtaacactaaaagcaccagtttcttacatgtcatattgaacccatggtgttactcaagtcgtaatgtgaaagaataaagcttttctttgcctcttctttattgacatttttcctgatcatccagtctaaattagtcttccttcgtctcccttcctactaataccatattgaaatcatcttgtacttttattttttattgtctgttgcctttctctatggcattggccccatcagagcatgaatcttgtcagacttatcatctgatgggatggcacatagtagctgtttcataattgttggttaaattaatggataaattgttgaacattaattttgactagttttcttttaaagggaaaaattggtacatattctttgtgccttgggtattttgagtgaattttagcccaatatatatcttgctggtttagagtaatgaaaacctactacattattcctaacacatttctaaaaagtaaactaattttggggaccatattcttgttgcatgatcaaaatcatgattcttggtaaataagtggtagagtgaaatgtgattttcatatttgaatattctgggaactttgtttttaacagtattgctgccttgctgtttcacatgttattttgctgctttcttaaaatgcatacactattgcaatgtggcatttaatatatactcacaactatatatttcacacaggatgatgtgactctggtaaacctcagctttcaggagccagcaggctgctcagaggctcaccagcagactgttctttatgtcttgcttgttcctatgtggtgaggatgatcactagtagcatttgtaagatgtgttccatgcttttcctgtcaaattacgcattagccttaccagatccttaagagaatttacagtctacttggggaaatacaatatatacataaagataagtcctcataatgtcaaatggggaagaaaaaataaaatagatactaggtaggggaggt

SEQ ID NO: 125870 - DNA, 1306 bp, Homo sapiens
ttgagtactcacattttactttttaatgagttgtcttcagaattggcagaagttgactctagactttacctaattttatcactgcctcttttaatttggggcatttatccatctctgctcttctctaacatcctccatgatttctcaaatttcctttgatgagtttacaaagataccagtaattggagaagcaaaaatgatgatttaataatagctgattgacatttcagagcattagtataccacttacttctttactcgacctttttaatagcaatggagaggcattggaaaaaaggatatatgaaaagttagaaaatacgcctatgagaaaaagctaaagatgacattatttgtctccaaaaaagagaaagctcagactttatatgtgaggatgtattgtagtagccagctcttttgtatgttccaccaagaccgaactgaagggaattgatttaggctgcattattaagggatgtatattgagtattaataggagttttatgattctgaatattgttcatctctggagggactttttggtagaagttgtgattcctctcccctcttaaatctctaaaaataacatcaattttcatctctcagtaatgttgtacagtgctcccaaaggctaaaagagatattaggtgacctttcaagtcctttcttgctcagtgactttgtcttttcacagatctcactccacagctagagatctgttgcattagattcacttttgttctttctttgtcatttaaagggctgttaacattccatcatgaatctgctaatggaagggtgaccctgcagtttaatatactatcctagtgtaaaaataaaactccactttgtatgtttatgtaaaatacagatgctttatgtggtatttcagttatttaaaaaacatgagatatttgataaattatttttaaagacagtctttattttcagtttaccttcagagttttggcagaatgttttctctttctcttgtgaaattgaacatactgtgcatttatttttattttttcattcaagcactttatttctagttcttttagttaacatattctgtaactagaagtagtttttagtataatagtttttaaaaactagattaccaaagaacaaatgctatttgagaatataatctctcaaaatttctgatttggaaataaatcatagataaaaaatcaaggttaatatgtaaaatactttgatagcagttactgtaccatttggacaatattatctcgtttgatctttgttacttttacttcgttgagaactaaatacagagagggta

SEQ ID NO: 125871 - DNA, 1049 bp, Homo sapiens
gggattttgtgtggggttttttggtcttatttatttaagttttttttttaaggagggataatatgtattttgttattaagtctgacacttgatggacttcttaaagttaaaaaatttaaataactaaaatttatgatgtagctaaaaattgacaggccaggcttttaagtgacagtcgaacactgattatttgttaaattgaccaaggcattaatacagggcaaaccatcagagttttacggctttatattaaacagttgactcaacagttgagttttacagttctagtaagcagtcggcaaagctttgagctttacggtttatgttaaacagttggctaaatattggatcacatgagattattcacatttcatatcagaatagattattataatataatctgcttataattcttgtaaaattattatataatctagagtagctaaaaatcaacaatgctactgcaggtaatttatttgttagatgtctttgcttatcctataagcatgtacttatctttgaaaaatcactttctgacattctctactatgtatatgattacataaaaataaaactcaatctgagtaggaatttattttaaggtattctattgaatgggatttattcaagatgttagtctctatcgcagttgttataatttctcatcatggttacatatgagaccaggtggatctgtgtcttcactacacacccatagcaaatggtctaaccaatctttcccttgtttctggtcttgaaaacagagaatggtagatacttgcagacaggaaggatgtgcacagatgtcttactaagtctcttaaatcctcacaattaaaaaacagaatcaaaagaatttataactgtaagggagccaagctctccaaatcatcagaatcattaataccattatatactttctactaaatgtgtgtgtgcatttgaaacttcaaatgcccactagataattctccgattatttaataatgtaattcataaagccatcacaataaattctgtcactagaatcaattaaacatcatatttta

SEQ ID NO: 125872 - DNA, 1368 bp, Homo sapiens
gccctatctgactctaattacttgccaaaggtctcgcttcaaaataacattatattggagattagggtttcaacatttgaattttgggggtacgaaaacagtccatagcacttaccatttttaatggctgtcctataggcgagagaagaagcctttcttaactagaacaccctctttataagcattctatctttggtgaagttgtaatgaaatttccactcaatggttttggaaattcaatcaacacactttgcatttatagataggagagctaagttccaatcttagttccaggttttgtcaatatgcaaacaggtgccactgaggaagtcttcagctttttaatgctttagtttcctcttctacaaaatgaggatacttagctggatgatttctaagaaattcctcacttttgaagctctgattatatgaatgaaaaatgtagagatattataaacaggcaagtgaaatattttgctttatcagtgcagttacttcgcttttaagtcttatagaaataattttagcaacacatattttttaaaactacatttctgagacaatattttcaaaggaattttgaaaaaagatcttaaagtgtagagatagagatgaaggttttttcacttgtagtaattactctcgaaaatactagaaactctcctcttgccaaagagccaggcattctgcagactacaacatagcccagtctgcactgtgaaagaatcccagtaagcacagttctggtaggaggtttgtatttctctttgtaatgtggctctggagatcttataggattctaagactgagaaataattgccttttaatgccagtgcaatctctggcaggaatgccaagcagagaaaacagcacagggcaatttgataaggatgaatatcctctcagacagggacatataatcacttgagctttccttccccccaaataacttctagtcaaagtataaaactcgtctaaatattactgaatcttggtaagtcaacaattcagactcatacaagaaacaaatgaaatctaagttttctacaatgtttttctactgcatgtattctcaaactgtgcatcagagaaataaaaattttccttattggaagtccctcagcatacaagcagcaagtccagacactttgtgcatataagccaccatgccccctaagatgcctgtgtcatgctttccagtgcataccccataagcatttatttaataatcaaaactgacaaagatattaagattccttagtggctttgctaaaggttttcacatgaatagggagagtacaaaaatatcaagtgaaatatgagatgccagcattaatctaaactgtccactttgtcagtaaatgtcta

SEQ ID NO: 125873 - DNA, 1059 bp, Homo sapiens
atcagctgcatgagcttggataaattaaaatattttccaggcatcatatgttatgtgagaattaggagagtaaaaacccaaaggggttattatgtatgcaaagttattatatatgtgatatataataaatattcaatttatgtttactactgctctggtttccataggaaaatttacttctcagagaaaaaaaaatcatacaataaaatcccagggaatgctattgtgagttcgaattgtttgggagcctcctggagcaaccagattatacagaccatttccatacttctgagaaggaagaaataatcatttctacctcatgaaaatatgctaaatatgctgctaaatattttaaagatggtttcatcttaatagaatgataatcaggtttatttttcactagtaaaaaacactgttgaatatattttataaaatcattcacaataaaaatattattgtaccttcatttatagaaaattatttttgtgtccctataagttcataatgtaccgagtgccttatgtctctatcagttgctgtcaacctgaccaactttgttccaacagacagattttcataaatattcataggtgcatctggtatatatctgtgggacaaaatgatttttttttatcagtcagtataaacaaatgtattttttcatttatgtcacacagcaaatattttacatttcatataatatgtattgtgtaacagtttcaagtctggccttcttaatgttttttcattgtacattattaaatctattagagaatgttcacattttataaaatgaacttaaattttcttttacctgtatccttttttcaagtctttctgctgattggtaaatgctactttattccacattacaaaatactacagacgtttttgcaatgattttcattatttttgtgtttggtcatatgtccatatcagcaagtgttttttgcccaaattctcttaaatacctacattgactttgcaatatgaacatatcaatgtacattttctagaatattttcattattaaaaataaataccagaaaaatatgaagc

SEQ ID NO: 125874 - DNA, 1037 bp, Homo sapiens
cattacatttagtatttttctgagttacattgacaagaacttaaattatagcctgttattaatattgatttccaacgactgaacagtacaacagatcaataaaaaagtttatacactgctttaactaatttttgttatactcatgtggcttagtgtagttagtcactaaaacagagttcaagtgagcttggcaatggtgttgagtaacaagaaagaattttgcattaatgatttctttttattttcctcatttaaacaaccagcattactgccaaacaccaaccgtggtccatatttgtaacaggtttttaacatgacatagttagcaagtttgattgaagagatttttaggtcctgggcctataagattttagtatgatcttttttcatgtttctaatgcttgaggtgttactgcttaacttgggaaaaaaaaaaacaaaaaacagtgttcctgccatttgtaagttttcctataatattccttttattaactttaaaactggacttatcgggttcaaataggcagtatcccttttaagtgacctttgcaacccaagtgttacttgcttatttgatgctctcttgtattttaaatctcatttaaatctttgtctgtgaccaacaaagcttaagattttgtcttcatttaaaactctgaatctattccattgatcatgttagacgttcaaatgtttaatggtatagtctgacctagtgaaacaaaatggatgttgttactttttttaaagaatagaatgaaataactatttcacttgcccaaaattttaaatattttttcatctaaacttgtattgtttcccatagcagaatgtcaatattcacagtacatttctgtaaagagcaaaccaatataatgttttgagtgttgaaaaaaattccagatttttgaagaattagacaactcttcatctaccttatttctagttcacacagttatctcaaattccactgaaactaatgggatactgtcttgtgtagatgccagttgagtttataatgtgacctagtaaagctg

SEQ ID NO: 125875 - DNA, 1014 bp, Homo sapiens
ttaccatattggacagtgcgaacaacttttccatcttcacagaaagtttgcttaatagcactgttccagacttttctctgcccttaggttgggcaagatgcctagacatttttgtattccctgttgtgttatctgtaaaataaggcaactttggcataagcatcacaattctttgtatgtgtaaagaaaaacttttttctatgtacatcaacaactaaattgtgcttattttgcaatgaggattaatactttaaaatggtcacacataaaacatatattgcaatttttttattcatttgacataggtaatacgttcatgctaataaatgaagcatttttttcttctaaaatcatactcctattgtgctgggaatggtttctgtttcagatgtcatattttgtctttcattttaatatgtaagaatctttgaaagatttccatttattttggaaaagatactcattttctatgataccatatttattttgcagaatctttcatggagaaaagcttatgaacaccaacttaatattcataatggttgagagcaaagggacatgtccatgtgacacacgactgctcatacaagcggagcagacttgtatcctttgacatcagagctatctggaaaggaaaaccatcttaatgcattttgaatcttgtcacattgtttatattcataaagagaaaactattagactgctctgatcacctcgcaaaggcagaatcgattcctcactcaaaatttggttggaatgtcaagaataattatgctacacatgccccagaaaaggataattcacaatttagttctttaaatccctatgtacttgaattgtgttggatgagagtaatgatgtataagttatctctctcacatgttttgggaaatacattgcattgtatttatttttaatcatgtgaaaaaaactaacatgagattccttaacaagtctcttttagctgacggtccaaatccttgtgacatggttaagcaacccagataccgaaaa

SEQ ID NO: 125876 - DNA, 1038 bp, Homo sapiens
aatcattcttttttatatctgtatctatttattttgttttacctaaagggattggaggcaattagaacatttactttccaaatgaactgttttttaaatgattcagtttctaaaacaatatagtaaaaaagagtgtctagaatgaattaaaatgtactccaaaatagggattacattgatcctttaatcccaggtgtaagatatattaacttaaaataattaaaagcaacaaaaatgtttccagcctatctcaccaccatgttgtatagtaataggatgttaagaacatatattctttatctgaaaaagtcaaattttgtcgtaaatgtgcaatttcagagggtacctgttagggtatttcagagcttaatgggtttagaggaacaaggagaatgggaagaaggcagaggtttttgtttaagaatacataataattggcctttgatcctcatcacctgtttcctcaattatctttaaacttgggctaatatgcacttcagttattctagaaatgacaacctattatctacttaggtattggttctttgaccaataccagtagatttcaaaaacattcttgggattgtactgctctgtgatgctcattccattccttgctcctcgatatgcggcactgaatttttcatagtcttatttactccaagattatcctatgttttgatatttgtgatagaaaagaatgaaaatagcttttcttataacaaatgaaagtgaaagtagacagtaactttttgttgaatgtttttacttgataatttcagtggtagttctgtttctatatatataaattttatatacatatataaaattttatgtgtgtatacattaaattgtcataaaattatgatggttgggaatcgccatgctaccatacagaaataaacaaaaacacaaaagaaggactatttcctgtttcttaacatagcttatttcttattttgataaagtttacaaaataatttggctcatttagaattgatttttctactactaaatccattcatttcctgaaaaact

SEQ ID NO: 125877 - DNA, 1062 bp, Homo sapiens
aaatattcacagaattgaagaatttcaatttggagaaatggaagaattttccaactgaagaaattttcaatctgtctcatcctttcaaattcatatagtggtgtacagaacttccattgcaatatttaagtacggaagtctctttaactacatattaatatacagttaatatgtaggctgtggtgaactcaactatttctctcctaataaaaatcaaaccaactccccagaacatacacataagcttttatgggagcctatgttattatcataggaacttatctcctttagtattcctaggattgcatgtagaatagacagaagaggagagcatattgcaaaacaccagaatggctgttttaattattttacttttttctatcaactgattcctatctctaatttctaggcatttctttatacatgcacaatctttatgtgtatacacaagttactctttttcctccctcttccttattgccacctttcaatttttggattaacttgtcaaaaggtgcaaaaagagaggaaatcttgaaggtctgtctcttgagagatgattttatgataaaacaaagtatcagggcatcgtatgagaatgcattctgtgtctttgttgcttagatgaacaaattctgagaaaaactgggttcttttgacccttacaatgtgatagttggctctcctacagttataaggacacttttggggtgttttacgtgtctcacaaatggcctctatgctcaacctcttttccgcatgcacccagtgataatacacagtgtgagcaggcgaatgttcttttctcgagttcatgtcactctttgttgacaaaacttttgtctccttccattttcatcatcaagtttaatttgaacttccaagtctgatagtcccttcacacatttctaacccaatgtatctgtcctgtcatttctgccacttccatcaccatacatatcactgttctctgacaaggccccaactttcccacctttgcgtttcctcacacattcgctttccaagtctccaactttgggccagattaaatctatttccatt

SEQ ID NO: 125878 - DNA, 1087 bp, Homo sapiens
agtggtactataatgaggactcagcatcacactattcccgtgggttggttatttaccagtggcagtagttgcatcaaactggaggagcttttaggcccatgtgtatcctctctctctactatcaagctcctccattcatgggcctattttgcaagcagtacagttgacacatacagagctggatgatctccagtggacagatcatcttatctacccaattgtttagtgccttttctgtgacgaatgttctctagcacacattgatgcaaaacaaagacatctttatgcttcatgcctacctccataggtccatcctcatgttgcttctccaaaactatgtatgaggaacatcttctaatcttgatccttttaggactttggacaaccagccatgccatttataactgtataggagtccatgagttttctaattgtaggttacttattttccacaacatattgatggccagttatattttgcctcaataaccctaaacatccattccctggcatattatctcagtatcttctggttcatattaggcagatcctgcaactcttttgttaaatatcttcttttgttttcttggagtagagactgtacttttcaaggtgggccgtgttgatacttggccttttttttttttttttttttttaacttttgagtaggtttattgtcatgtaaccttttgggattctttcctttttttaaaaaattatatatatatatatatacacacacacacatatttattatactttaacttctagggtacatgggcacaatgtgcaggtttgttacatatgtatacatgtgccatgttggtgtgctgcacccattaactcgtcatttagcattaggtatatctcctaatgctatccctcccccctccccccaccctacaacaggacctggtgtgtgatgttccccttcctgtgtccaaatgttctcattgttcaattcccacctatgagtgagaacatgcagtgtttggttttttgtccttgcgatagtttgctgagaatgatggtttccatcttcatccatgtccctacaaaggacatgaactcatcattttttatggc

SEQ ID NO: 125879 - DNA, 1036 bp, Homo sapiens
cctccaatctaaaccataccaaacttgtttcatgaacaacagtcaaataattccaaaaaatatttttttatttgatagtttcattgttaccatggtagaaatcaaaacaggctttcaaccaattgttctaaattttacaggatgctgactcattcttgttaaaattgctgattagtctaacaggacatgacttacatgagctgccatatatgaatatcctcaccgtgacaaatttcctaacatatctagtgctcagatgaagagctgaaaaatccactacacttccaacccactggtatttttcagggtaattgttttctatgcttggtatttgtcacaagtgtgaatctggatcacaatagaatcataaaagagttttcatcagtaggaccttcttaagttttgtgtttattgattttttaaaaccagataatttgcaaaaaaaagggttctttaattctggaaagtacatcattatatataatatatagagttgtatgttaaatgactaaaaaagtgaatgtttttaaagaactttcagtaaaatgttgtcatggttctgatattagcagagtagcttttccttttttcttttaaagagctatttaaattataaagtcttgattctgactcatgcaaccagaaatctgattaagtgctaagaaagggcactttttaaaaagtacaattgcttctgtaacaaagtgattgtctattgtaataaagtgattagcttacataattaacattgtttctcattaggtgcgagcagggaaatggtaagaacatcataagacattgaggacaagcctgagttagagaatataaattttaagctaggctaatttgaccataattaataagtttggcacaaagagaaacaattctacttctgaggtaaagatggcctttactttcactatctttttaaaataacatttatgtaatacatgcatattcatagagaacaatatactattgactttctgataagagaatattgactacttatcaacccaaatgccaaagatacagt

SEQ ID NO: 125880 - DNA, 1026 bp, Homo sapiens
aaaaaatttttttaaaaatgtttacataggcatacatatatcttagtatgctacaatttacatacacaaattaatttgtgtaaacaatgtttttctttccaatttaaaataaactatttgtaaatagctacagataattttaatagtctcagagaatacaacttaacattttgagaatcaataaaatatttaatatgttttcagaagtcataggcattctttgggatatgtcataattaaaagaagctctgtctttggattatttatttagtcccattcatcttaatattggcatcttcatctttgctgaaatctcatcagtaagactctaacctttcctggcctgtactcctttaaaattcatgtccaatgttataagctgcatgaataaatgacaggaatgaaatcagaaatgtccacaagatctggaaaatttaataattaccagtattcttcatgtggtgtgtgggaacatatccgatttagaggattgttctcggcttctgagtttaatgaatatgaaaatgcactttaattgaaggcttaactgaaggaaacagcctttttcattttaagacagttgtgtagctacactctcataagaaacctcgtgttctaatttcacaaagatgattactttttaaagtcccttgaattgaaatgtgattatttctgctcaatgatatatttaaagttttagagtactgtatttaattagagccccatctcaaaatctccatttttgagaatttcactggttgctccttttcttttagaggacacccaaaccatacttaattttcagatctaatttatctgcttagaattatacaagacaagcatataacttagtaaaaacaagggctgaatattctgagttaatttgtttttaatctcagaactttattaatttttgaatcactttagactcaatgtagggctgtcttcatagaatattgtataattattttaaatggaaatttgtattgatagttctttgtataattatatttctataagaataac

SEQ ID NO: 125881 - DNA, 1044 bp, Homo sapiens
aaaaagacatgaataattttgatccacatatcaataaaatcacattataagccattttcatcaaactgcccacaggataagcatgaagagaacgttgtagaaatttagatcatgggattctctggtgtaggggctttatatggcctacttgattttgtttcttttcacagtattctgaaaatgtcaaggatatttcattgatgattataaattatcttgagccatgctctgttgactcacagtaaaaacagcatgacaagaaaagccaaggtctagctacaaaagcattgcttggccatgttgcaagctttgtgaatttagaaagacaggcaattgtaccataattcatagctatggctgagagagccatggagccgtatcctccaacagctttacattcctttagaagatgtaagattcaaggctacttgttgagcaaattaaattcatcaaaatatttttatttcaaagaatataaaacatctattgtgtggtttgataggaaatttacttaattatgttgatgctagtcagtttggtaatgtggaaactaaaacatttaagcaactttcatgacagattaataatgcatttataaacaggggcctttgagaaaaagttcaaccacatttaactcaagaaaaagttaaatctactcagcttttcatttcaatttacttgttcacaaagaaaaagatttaaaaaaacgtttaatatcttgattatacttgatattatgcacattgatctctcttattaaaagaaaataaatttatttactattatactaaaattatagttcttatttatatacttttaaagatatacagtcaaataaaatggggaggatatataattttcttttttaaaaataagtggactaacaatatattacttgcgaatgtagagcaaaagttgattacacagagagaactatttgagttgcttcaagattgatttatcacgttctcccttggaaaagactgatctatagcagtagtttaactgctttcaggctcccttggagccgtatttgtggcccac

SEQ ID NO: 125882 - DNA, 1144 bp, Homo sapiens
tgttttatactgcaaacctccaaaagttatgtggacctctgcatttttcacattttcacctttactcactggccagcccactccaatttgactttaaatttcatctatggtgaagctcttctttgtagttaacaactacctctatgtcatcaaatcgaatgagcatgttctatttatcttcacacttcatgtcttttcatcattttagtgcaccacttactgtatttcctttcttcaaacacttctttagttatcaggaaacctcactttccctgatttcctacttttcactacccattccttttcagtctttattggtaccttttcctttacagtacctctgtgtctttaatgttgtctaaatttagggcacagtctttgccctctcatctttaatgcccatattcctccaaggacacttgatccatattgttggatttacatgtaataacacccaaacctcttttctgagctttaggctcatttatccgatgacatgcttgctgttttcatttacctgtctcactggcatgtcaagactaacattcgcaagtgaactattatttctattacttttctccatcagcatcctgatcttctgttaagttttgcatctcaaaggatcactttctcctccagttaatatagctcaaattcaggagtaatcttaattcctttctctgccataactccacatgtagttaatctgcaaattttgtcaattccaactccaaaatttaccaagcaagcattcatttctcttcatctccactaacaacatttttccccagaaaacattcatatcctgcaggcagcataatcttgagattattaatcaaattatgaatcggaatccactccactattctttggtatccacaaaattgttttatagaattctaataatgaggttcagtacatgctaccccaaaatattttaagctgaaggaatcaaagaaaaccatgggggcagggaggtctctttgaccttccctcatgtctttctttcctgaagccataaaaccctcagagaaaggaaggaaaggaacatcctcatctctgaagatacagggatacaaagaaaaatctcaacaaacaggtcttgctgagtttcccccagcttatctccatcagatgaagcttt

SEQ ID NO: 125883 - DNA, 1067 bp, Homo sapiens
aatgggatgtggggatttcttgaatgaaatccaaatgtgttctttgttaaataaatagaaggacaaaaattatactgacaccaaaaaaaaaaaaaaaaaaaaagaaaggaaaaattgttaatatgcatagattagatttggccccagagatcttacatcaaatatgactgggtttgcttgctttaggaaaattgtaaggtaatatttagaagaaaattatacagtgagattcagcatttcaatctgagaaatagtgctttggttctaatgagcagatgctcaactgtggattgagagacctgatgcaattaaaagatgtttttaggtgggaagagatcattcagccatgtatcgcctgtcagatctaccttggccagctttctgtgtgacagatgcagttcgattttcctaaatctattcagccagccattcatttggcagcagttcctccaacaataacttacaagacctgggtttggacgaagacttatgtgttcttttttaatataacagaaacctgatgtgtcattgcagtgatatgaacatgcctgatattatgatgaaccccagtgactttttaggagacagaacagagtctgaaatgggaaacaatggggagatatctgattaggggactctattataatctaggtatatattttcatctgtaagtgtgtatttgtaaatatgatagatatagagaaagtaaataatcataaatggtgtatcctagatgacactaatattatttttaaaaatcgcaaatgaggaagcaggtgcatcttgagtaggaaagtgcagctgtgagacacaaagtcatttactgtaggcacaatttgattcaactgatatgctttccctggcccattcttttccttttctttcttcatttctcttcaggtcagaggctggcagcataattaaaatttgaattatttatgaagagccattaaagtgggtggcttgcagattagtcagagacagcagagctgacactaagctgcttttcttttactctctcacaataaacaataccttcactatatgccttgaaaataagcatatga

SEQ ID NO: 125884 - DNA, 1015 bp, Homo sapiens
atctgatttcaaactttctctcaaccactacattgcattcccctctcacgcagagctgctcaggcaccagattatttaaaataacatttataataaatatggccttacttggagggccattaaaagatgttgctaacaagttcatactttcactttctctaggctagtgattgttacctggaagacactctctagataaaggaatggcttttaaaactcttgcttctctcaaagaatatataaagtattaaaggaataaacattttgttttccagaataatacatgtgaaaaaatatcttcaaagtgaaataggcaaatgaatatcaaagaagcttattttagaatgtaatcctatgagagagagggcagtctcgaaagattaaaaaagattccttttatgattatgaatttgaaacagctggaatgaatgcagtcatgaggatcatttctgaaagtgagggatatagaaagttaaaagactcatcgcttggtactgagatcacctgcttcgtaacagacagaaatagaagagtacaagtgttaagaattcattctgccttccccgtgcttttgtcgctttatttttagagctctgctagcagcagttgggagcaggatttgcccttacgcgcctgctcagtcagactcgccttctctcttgcagtctgcctcccttgacaggtgtgagggacttcctaagtgtcgcaagccagccacctggcatcagccacccctgatgtagcgtgcaccttcagaccactgagctcatgaaagaggtaatttttctactgcctgttaacatgcgttagttttttcttaaggctaagccaatcagaatgaaagatgttggatagatagcagtacagaagtgataaacaatatttaataaaaatggattaggtaaaccgctatgatggattgattcataaggaaaggatgaaaaggtatattttagggcctcccctacacaacctaagcagatattgtaaaagtctcaaatcacacaaacatacc

SEQ ID NO: 125885 - DNA, 1040 bp, Homo sapiens
gggtttttttttgtttttttttagatggagtttcactcttgtcgcccaggctagagtgcagtggcgtgatctcagctcattgcaatgcctcctgggttcaagtgattctcctgccccagcctcccaagtagcagggaccacaggcacccaccaccatgcccagctaatttttgtgtttttagtagagacggggtttcatcatgttggccaggctggtctggaactcctgacctcaggtgatccgcccatctcggcctcccaaagtgctgggattacagatgtgagccaccatgccaggccattttcaggtatttttatgcaacttgcagacttcatgcctagggattttttctagcattcttggacaaagagatttgtatctgatgtgtcttcctgtactcttctgtggtgcaaccacaggggatctgctccaggtttggaaaatgtgtaatgggtgaataggataattcttgtcagacagatttcccaagaaataaagagaaacgttaggcttttaaagacttgtttaataaaaaagggagctaatttagaaagttgtttttcttcttcccctaaataaggtaatgtgagaatagttccttctattttgggacattttaagttaagataatatgaatttgttaatatgtgcattgtcagaatgataatgatgtgattataagtatgaatgagtagctataaccagtgcactaaacagtcaattttacggaggtgtccacttctagggtgtatggacatgtagaatcaaagtccaggctcactttgagctgttagtgctggctgttgagtgttaagttcaacttcttgaagaagatatttttacaataaacattctggacacatacacctccttcgaatggatcagaatcacttgtagcctgaatcaatgtggtgtgccttctctttcaggacttgacactatgtttaccctggcctccctggatggaatgctctatacatgcttttaatactcactgctgctcttgcttcccacaaattagtatgcaatagattattgt

SEQ ID NO: 125886 - DNA, 1096 bp, Homo sapiens
tctgacttgcctaagaagccagacggagcctctcgcttccacaagtctctctgcctgccattccccgattcctgcagccacccccaccctccagcgccgtcacccctcctccgcccccgcccccgcctccgccttcgcctcggcaatcgggggaataaatcagggaggaaaccgagagggagagcgagagcgcgcgagcgccggcgggctcgccgaggtctgtttccaaagtcgcccttgatggcggcggaggcaaggcggccgcggcgcggagcagccgacgcacgctagtgggtccgcccgccaccgccccttcctcggcgtccgctcccgcccttgccgtcccccgcgcggctccgcgcctcgggccccgggcgcagccagccctccagacgcccgcggtcccggcggcgtgtgctgctcttcctccgcccgcggtttccagcgccgctccttcccccgcttgggcagggagggggcattgatcttcgatcgcgaagatggctgctggctgcctgctggccttgactctgacacttttccaatctttgctcatcggcccctcgtcggaggagccgttcccttcggccgtcacgtaagtcggcgggccgggcagggagcgccggccgaggggcgccgcgggagttgggggtgggggtcggttcccgagtcgcggggcttttccgcccgtgggggtggggagcgagcggccggggagccaggctcggatgcggagacgccgggcaggcggtgcgcgccgctcgccgctggaatgcgtcccgaaccggcgtctcgggcgcctccacggggccgggcactgggggccgactgtcccgggaagcgcccgccgacgactcgcggcgtctcagcccgtctctaacgggattctctagacttcagagtgcagccgtactggggaaaaaagtttccagccagctcacccgctctgattcaacccagttcaataaaaagttatgttttggttgggtaatttacaaacaggtaatttcaggcttgccgaggtagcgtggacttcccccgcacttggcctcggagatgctctttaattgctgtagtgcccaaactcgttttatcc

SEQ ID NO: 125887 - DNA, 1062 bp, Homo sapiens
acacatagaatgagacatacaatgaactgtagccataaagtggcttttggcatctataccaatccttcaaggaaatactggactggattgttttagtggtcacggtgattagaaatcgaatcttatcatgataatcttctaacaggttggtccacaaatcatggctaattgtattcccttattcacactaagtatgtttaaaaagcatatctttgcaacagtcatatttgagtataagaaatattactttttctgtaaatcaaatgtaatcaagtccaatctttctttcatctgttggtaggaaattgaattgcattcatcatttggtgtttcctgcaccacatgccttgaggaacttcccagtgagggtattacacattctagaacactggagtttgggcctctgtacatcagtccacgccactaagagtgcaatgtcaaagctagcacactttcctgataatgagtagctcccttaactgtgcccaagttttcacaagagtagttttgcctacattgagagtcacagaatctagtgttcaactttctaaaggcacctcttggcaatttttattgaaaaaatatgccagacatcttccataggcaatataaacaagcaggatgctggtccctacttcctttggaacctccaaccaccatttcctccctagcactgaatctgcacctcctattctttcatccttcttacattatttttcttcccagtaagattcagcataatttttcatcaatctccctggagaaatacgacattgtcttctcttctgggagtgagatggggaaaagggataagagacccaatcaaattttattcatttctgtcactgtttactcaccataagtgatatatcccacagcaactttctcttcgttcaataatgtcttcagtttttgcatgtccaagcctccaaataatatcagcatgtaggcaattaataaaatttccaaattatcatattatgttgcaatttaaatggcattacaaataatatatgttatttttgctaagtttcacatatttgaacatagtttgccttcagg

SEQ ID NO: 125888 - DNA, 1032 bp, Homo sapiens
ccctgtactaggtgtggtctatttttagatactaatcgcctcattacatcaaaagtgttttaaagtaatgatcattagagtaggagataatgggccataaaatatgtacttaatcattttcattcagtaaaatattagacctagattctcaaaatacataatgaaaattttcaattgtcaatcagatagtatggtcatttccattctccagattctctaacataaatatagtttgcaaggttttgatgatatttttataatgaacattgtcacaaagtaaatgcaacctttttatttttactctaaatataatattatttgaaataaatgtttttctgtcatttcatagtttaataaaattttgtctgctgttgcttaaaaactttaatcatgctaaaaatgactcactgtgattttctcgaattaaatatattggaacctaccagaaaatgtccctggacattttgatagactattagaataaacacaaattagaagcagtatttattcatcacaatgttatgctggagccaggttgctccacatcaataagatattctgtacaaatctcttcccaacttcaaattcagtaacatcatgatgatagcttgaattggctatagtggcagcatttacaatgtggaaataggcaaatgctataactcaaacctttttgtttgcttgcttgcttaattatttgctttcagaatgccagcttaccagcacatcaccaaataaataactaaaagcatattgttggctgggcttggtggctcacacctgtaatcccactttgggaggcactttggaaggccaaggcgggcagatctcttgaggccagcagctcaagactagcctggccaacatggagaaaccctgtctctactaaaaaacaaaatacaaaaattacccggatgtggtggcgggagcctgtaatcccagctattcgggaggctgaggcacgagaatggcttgaacgtgggaggcggaggttgcagtaagccaagatcatgccactgtactccagcctgg

SEQ ID NO: 125889 - DNA, 1097 bp, Homo sapiens
taaaagaaaagagttcaagcctgtaattccagcactgtgagaggccgaggcaggaggattgcttcagcttaggagtttgagaccagcttggacaacatagtgagaccttgtctctacaaaagataaaaagaatagagctattcaaatatttcattatttgtcatgattaatatgtgtttgtttcttgcctttcaaaataatggtcttaaaaccactatgcattaaagtgtactcatgtgccacataatgttttggtcagtgatgagccatatatgcaacaatgtcccataagattacagtacagtacattcactgtagtttttccatgtttaggtatgtttcatgctctatatacttgctaatttttagctattttttaaaaaacacagaaactaaaaatataaacacttatatttatctcaattaggtttctcataataatattattcaccctggtcttttcatgtggctaattccagaagaacctgtactgcaaagtaagaaacagtttactaagatgttcatcagtcaagaataattttatcgtgtcttgtagaaagtgtcaggttaatacacaaacaatattagttggttaattaaggctgaaaaataaataatttataaattatgatcatgttttcactttataaattacaattgtatgtatgattggattgtgtcttctcaatttggaatagtcattactgctcttctataagtaaaatgttccttagtctcataagtgaattgtatgctctgggaacatcctctcataaaatttttacaaaatacctagtcaaaaattggcaagtcctgggtatattactgaatatggctgaattagaaaaattacttgttaatatcaggtcaatcattggagagtctaccaagatctcagaaaatcctattttatattatcaaaatcagaataacatactttggttttggtgttcatttccaatattcatgttatatttagcttctggataccagacctactttttgtgctctctgtaacttgtgataactattgtcccttcttaaattagtactaataatttgctaattgtttaatacaggtaatggattaggaatta

SEQ ID NO: 125890 - DNA, 1049 bp, Homo sapiens
caaaatctttatttatttatatagaattagtctctgcgtctagtttacaatgaaacttctagtacctgtgctcagcagaagtacaatgccacaataaatcaagaaacacaaacataaagtaatcctaattatgatgacagagatgtcaaagtagggggatcttctctattttttctcccccggcacaacttaattgctgaaaattaaaaatgcttttcccagactgtccagagcaaaatcaacagctggcaattttccaaatacattctatatccgaggtcaccaatattgactgcatactactgtagtaacaaacattcttcagaacctattgcatgcacttattaatttttcaaatacaacaagtcattttgcaagagcaattggttataaatgcaaacaccataagaactcagaaccagtaatatcattatatagtgttagtgtaagatgtttaaattgccatcatgtgagaatctcctactacgttccattgatttaatcaatgtgctttgaaatgaaccattctaattatgtatattgcactttaagtgtctttaatgctggttttttaccttactacatgtatgtcttagattatacagatgaacgggaaaactatgcactacatctttcctcacgcaaggataaaaataacaagagactcaaaggatcacacagtttcaggtaaagcaaatcatataatctaatattttttttgtttttttgttttgttttgttttgttttgcatttttttattattatactttcagttttagggtacatgtgcacaatgtgcatgttagttacatatgtatacatgtgccatgctggtgtgctgcacccattaactcgtcatttagcattaggtatatctcctaatgctatccctccccccttccctcaccccacaacaggccccagtgtgtgatgttccccgccctgtgtccatgtgttctcattgttcaattcccatctgtgagtgagaacatgcggtgtttggttttttgtccttgcgatagtttactgagaatgatgatttccaatt

SEQ ID NO: 125891 - DNA, 1086 bp, Homo sapiens
tttatttgaaaacatatgcataacaagaaatcatattcataaaatgctttggaggcaaaagtaataaaaccaataatactaatgcaaacactaatttatctgcttttaaaactagtttacataagacaaacattagaggcatagaagaatatttctgaaaattttttattagacacacaatcatattaattataaaaataaaccgaatcttaaagtccatatttgtttcatttcaaatatatgtgtatacttatatgtgtgtgtatgtgtgtgtgtgtacctatctatctatctatctatctatctatctatctatctatctatctatatgcttaacctctgccttcttcggtagaaattcagcactgctttgtgaattgcacagataacctaatctcttattttttaattttactttagtcacttactctataaataatgctaatacctttcacagggtggttgtaaaggtcagcacttcttgactattataaaatcccttcactttctgcacttaacgctcacatcatctgcaattcctacccaactgctgcattgaggtacattaagctcccatgaaagagccactctttctcttgattctaggaatttgaatgttctgttttcgctccttggacacttttcctccactcatcccttggcaaaccctaatcatcacccaggtgtccatgtaactgccccatgatgcaagaagactcccctgacactaccacccccacttccccagaaatctggggtaagtgtttttcctttgtgctccagtggtgccccatgtattatgtcttgggctgtgagcttcttgagagcagcagctctgtattccaactaccatgttatatatgcatacggtgctaggaactcagcaaggcactctgtctcctgcatctagaatgtgtagtatttaagtgagggaagggatgtctgtatgaatacacagtatgttaacaaaaaggacatgaaggctatctgtcttccgtgtgtgaagtaaagggctcaattccttccctttttgttaacaaactgtttatatatacaggcttgattcatgaaaataactctttgaaa

SEQ ID NO: 125892 - DNA, 1115 bp, Homo sapiens
ttttagttatttagagttcaaaccttcctgatttgcccatttagccttttcctttggtttcttgattttgttttttgtatcatcccatgtatttgccctaaattgacttgctagttttccatgttgaacaagtaaatacttaactaaaaactgatttaaagtagctttgtgtttaaagatatacaaccataaacaagtagtacaagtaaatacttaactaaaaactgatttaaagtagctttgtgtttaaagatatacaaccataaacatttttgaaaattatctagtccaagtctaatattgaagatgagggaggaatgatacaaaggtgtgaagagcctagcccataccaagaggattcatgactcttgactcttggtcctttttttttcacctcctttggtttacatttgaatgtagatgtagatggagttctggaaataaaatatttttgatcaaataaaagcattattatttccttcctttagagactccaaagaactaagctaacatgaacatctcccttttcaaacataacatctttcttgaggactcacaggaaaatacacatttttgtgaaaaggatttttttcctacatctttgtctagatgaataagattttaggaattcaaatctggattttaatagtttttttattgaactaaaataatcactgtatctgaaggaggacaaactgcttttgtttgtgaaattccaatagattagtcattttctgatttgttttcgtctctacaggctattggattgaccatttttattgacaattagttaattgaataaaatactcaatttgtgggttttttatttagatgattatttgaataaatgtacattgcaagaattgtgatatcatgtgggaacagtctttaatatttccttactttttacaatccacattttataaacattttatagatagaaaatgacaattgcagaagagtaaagagtttatccaatagtcatgtctataaaataacaaaataaaacaaaaaccctagagggtcaatggcataacgaaatgccttaagattgtgtgtacatcatgagcatatatctaaagagagtttgatttatcatcatagatattttgtca

SEQ ID NO: 125893 - DNA, 1025 bp, Homo sapiens
tctttctatgcagatattgatcaccatactccacgaaattatgtcctaattgacgacattggagagatcaccaaaggaacagcggcattaagcaccgcatttagccttcatgaaaaggatctgtcaaaaacagaccgtctccttcgaaccactgagacacgccggtctcaagaagtgacagatttcctagcacctttacagtcttcctctagattgcatagttatgtgaaggcggaggaagacccaatggaggatccttacgagttaaagcttctgaaacatcagattaaacaggaatttcgtagagggacagagagcttagatcaccttgctggtctttctcattattaccatgctgatactagctacagacattttccaaaatctgagaagtatagcatcagtagactcacacttgaaaaacaagcagcaaaacaactgccagcagccatactttatcaaaagcagtcaaagcataagaaatcactaattgaccctaaaatgtcaaaattttcacctattcaagaaagtagagaccttgaacctgattattcaagctatatgacttctagcacttcatctattggtggcatttcctccagggcaaggctccttcaagatgacatcacttttggcctcagaaaaaatattacagaccaacaaaaatttatgggatcttctcttggcacaggactgggcacattaggaaataccatacgctcagctctgcaggatgaagcggataagccatacagtagtggcagcaggtccagaccttcctccagaccttcctctgtctatgggcttgatttatcaattaaaagggattcttctagctcttccctaagactgaaagctcaagaggctgaagctctagatgtttcctttagtcatgcatcatcctctgccagaactaagccgaccagtttgccaattagtcaaagtagaggaagaataccaattgtggcccagaattctgaagaagaaagcccactcagtcctgttggccagccaatgggaatggc

SEQ ID NO: 125894 - DNA, 1028 bp, Homo sapiens
ctgcagtctatgaagcaacaccttctctttcagcaagaagaagagcggcaagcccagttcatgatgaggcaggagacgttagctcagcaacagttacagcttgagcagatccaacagctgcaacaacagcttcaccagcagctggaggagcaaaagattcggcagatctaccagtataactatgacccttctggaactgcttctccacaaaccactacagagcaggcaattttggaaggtcagtatgctgctctggaaggcagtcaattttgggcaactgaagatgcaaccaccacagcttcagctgttgtggcaattgaaataccacaaagccaaggatggtacaccgttcagtctgatggtgttactcagtacattgccccacctggtatcctgagcactgtttcagaaatacctctaacagatgttgttgtgaaagaggaaaaacaacccaaaaagagaagttctggagctaaagtccgaggacagtatgatgacatgggagaaaatatgacagatgatccccgaagttttaaaaagatagtggacagtggtgtacaaacggatgacgaagatgccacagatcggagctatgtgagtaggagaaggagaactaaaaagagtgtggatacaagcgtccaaactgatgatgaagatcaggatgagtgggatatgcctactagatcaaggaggaaagctcgtgtagggaaatatggtgacagcatgacagaggctgacaagaccaaacccctttccaaagtctccagcatagcagttcaaacggtagcagagatatctgtgcaaactgaaccagttggaaccataagaacaccctccatacgggcacgagtggatgccaaggtagaaataattaaacacatttcagcacctgaaaagacttacaaagggggcagtttaggatgtcaaacagaagcagattcagacacacaaagtcctcaatatctgagtgccacatctccacccaaagacaagaaacgcccaacacctttagagattggttattcatc

SEQ ID NO: 125895 - DNA, 1078 bp, Homo sapiens
caatggatgtgaaaaggcagatcacagcaaatgaagtttatgggaaacaaattagtgctgtccaaccctctattataaatcttagtgtgacatcatcaatagtgactcctgtatctctggccactgagacagtgacctttgtcacatgcacagctagtgcaagttacactacaggcacagaaagcctagtgggtgcagaacatgcaatgacaacaccactccaacttacaacatcaaagcatgctgagcccccatacaggataccaagtgaccaggtctttcctatagctagggaagaagcaccaataaacttatctctaggtactccagcacatgcagtgacattggctattacaaaacctgtcactgtgcctcctgttggtgtcacaaatggatggactgatagcaccgtatcccagggaatcactgatggggaagtagtggatctcagtacaaccaagtctcacagaacagtcgtaacaatggatgagtctacttcaagtgtgatgaccaaaataatagaagatgaaaaacccgttgatttaaccgcagggagaagagctgtgtgctgtgatgtggtttataaattaccatttggaaggagctgcacagcacagcagcctgcaactactcttcctgaggatcgttttggttatagggatgaccactatcagtatgatcgatcagggccatatggttatagagggattgggggaatgaagccttccatgtctgacacaaatttagcagaagctggacattttttctataaaagtaagaatgcttttgattattctgaaggaactgacacagcagtagatctgacttcagggagagttactacaggtcagtatgatgtggcagcagacctttccttgaaatatcattatggtgttcctcatctcatttcaggatgaaaatgtggcttcttttccagttttgttactttttctctttctttggatgttatagcagcatattttggagtacaagtgcgcttttgttccttcattttaaaaaaaatttgttctgctcaaaatcactgcatgcgcctgcatgttcaacattgctttcattc

SEQ ID NO: 125896 - DNA, 1040 bp, Homo sapiens
tctagtaaaaaatcaaagaaagacaaagatgaacttcgagctcagagaagaagggaaaggccaaagacaccacctagtaatctctctcccattgaagatgcatctccgacagaagagttacgtcaggctgcagaaatggaggagctccatagatcttcttgttctgaatattcacctagcatagagtcagacccagaaggttttgaaataagcccggaaaaaataatagaagtacaaaaagtttataaattgcccacagctgtttcattatactcaccaacagatgagcaatctattatgcagaaagaaggtagccaaaaggcgttaaaaagtgctgaggagatgtatgaagaaatgatgcataaaacacacaaatacaaagcttttccagctgcaaatgaacgagatgaagtgtttgaaaaagagcctttgtatggtgggatgctaatagaggattatatttatgaatctttagtagaagacacgtacaatggatcggtagatggcagtctgctaacaaggcaagaagaagaaaatggatttatgcagcagaaaggaagagagcaaaagataagactttcagaacagatttatgaagatcctatgcagaaaattacagacctccagaaagagttttatgagttagaaagcttacattctgttgtgcctcaggaagatattgtttcaagctcttttatcatcccagaaagccatgagatagtggacctgggtactatggtaacttctacagaagaagaaaggaaactactagatgctgatgctgcctatgaagaacttatgaagaggcaacagatgcaattaacacctggatctagcccaacccaggcccccattggtgaggatatgacagagtccaccatggactttgacagaatgccagatgcctctttgacatcaagtgttctctcaggagcgtctcttacagattcgaccagcagtgcaacactctctatcccagatgttaaaataacccaacatttttcaacagaagaaattgaggatgaatatgtaaccgatta

SEQ ID NO: 125897 - DNA, 1020 bp, Homo sapiens
ttctggcaagataaaattatataaacaaatttaaaaatattctttttggatatgttatggtctgaatggtctgaatgtatgtgttcctccaaaaattgtatgccaaaatctaacccacaaaatgtgttggggttaagaggtaaggccttttgtgtagtactgaagtgatgagggaggagccctcatgaatgggattagtgcccatatgaaagaggcctgaaggagcttgttggtctcctcccccatgaaaggacacatagaaggtgctgtctatgaggaatggatgcacacctgacaccaagtctgctggtgtcttgatcttagacttcccagccttcaaactgaaagcaatacatttttgttgtttataaattacccagtctaaggtattttattagagcagcctgaatgaactaaaacagtatataaaataattatttgtaaattgtatttgcaaaatttagttcaaaagtaaagtgacttaagcaaaggtagctggaaaatgatggcaatattttaaaggatcaaaaaataccaggacccgattcttcaggacaagctaggagtcttcccttgaagaccataggattgtttttcgaatcaccacctaatattgttggcaaatcctagccgagataaatatgaaaacaatatacactagctaaacactaaatgtgggttgaatgaatgaaacaaataatttacaatattccatattttctttcaaaatagacacgctgatcttttagatttatacagtagaaactattttagctgcaggtctttttttaagcctgcaatgaatgagttctttaaattagaaaaggttatagcacatttctttgccttgtgtaacaaacatgcaatagctcctaagtgcctctggcgtaaaaaaaactatctgaaagcctgaatatataggataaagttttaacttcttccctcagaactttatggacaaaagttgaaacataataagctaattctagatcttgcaaattatcctgtttttatttgatg

SEQ ID NO: 125898 - DNA, 1118 bp, Homo sapiens
gaggtacactgaacttactatacttacagaagtattttttccatagttaacaacataataacatttattctttctgaaaaaatacagcttaattctggctacctatagaatctagcctttaattattatttaatttttagtatcagcatgccttaaccattatataggcagaatgagacatggtgcttttaagctgggatttcaattaaaattaatattaaatgtaaagacagctgtgaattttaatgaattatttcatttgtatttggaaaacttctcccaatctcctgctaccgggcttcaaagatttttttatatacttgagccttaaaacggtcatttcaaaatattaatttatagtcattcttttttttttaaatagggtgctttcacactacctccaagtccaattccaaaattcataaatatatatgaagcagagcttataaaagttactatggtatcagctcacaaaactaagaacatcttcatgtatgaatttctttcattgatagatggtctagaattgcgtgttgtcaggatctgtagttgacaaagttggacatttggaagagatcctcttcattattcccacatcttcatccagccttcatcttcatctttcctctgaacagggctgctctgatgagtttcctacacagaggatgttctcttgtcaacccagtctcttcacaacttgttctcagaaaaagttttaaaaattatattcactctgttcttattcttacaaatgccaaatgagaattaaatgtattagctcctttaaaagatatatcaagaaaatacatcgccactggaggaatttcaagaatctgttccaatagttgcaaatatgtttgagtgggcagggtcatcactagtactgtctgaagtcatgacagcaacctgaatttctgctttttctacatgtagacttagggatatactttttacaatttttaaaacttattcactaataggaaacagactcatttaccatctgcttgaaatgtggtgattataatttatccatgaaaatattgaatgtttccttatcaacttgggagtcatcagggaggacccagaagtaaaggttaacagagagggaaaacagattg

SEQ ID NO: 125899 - DNA, 1053 bp, Homo sapiens
aatgtaacgttttcttaccctgctccttttttcttttgtttgtagcacttaatatcttttaacataattgttcattcagtaatttattgtgtttttacaaaattacccttctacctcactagaatgcaagttctatgagtgccaggcattattccaggtgcttagcatacagtagatgctgacaaaatctttgtagcatgagtgaattaatcctatatgttattacagatatagtagctgaataaagtaaactggaatattggtcaacttcatatctggttagctgtaaatattttaaccagcttcctaccttgctttttcctgttatgcccatttcaaatggtaaagagaaacagcaccatatcacatatattgaaaaattttctccaaataaattctcattataaaatcaggtctataaggtagaatacatctacagctaaggctgggggataaatggatgaaactaagcttcaaggaaaaaagaaaacaggcgtggtgatccctgcagagggaacatagcaagagttgtccagatggtgactatggtgccagatcattagggcttcaaaatcattcaatagcttcatagccatcttgctagaacaaattgtttaacctcttatggctttcttcatctgtaaaatgatatgatgataagaggaccttctgtgtggggctgctgtaacgattaggaagtaaatacatgtacaactttcagaacagtacatggcgcttgctaaagctcaataaatgctagctttgatagctactgctgccagatttaggtgtgtggtatcaagatatacttgttactaaagagtcaagataaaaattatcattttttgactgaactttcacttctaagagttaagctgcttaatgaaatgaattttgatgttagaggacaaatggaggtctttactccgggcttgaaagattatttcagattattttctatagtttggtaaaaagtaatggtccttggctaaaatgaaaacacatgcattgctgtgttctttcatttgtgatgtcaacactgcttctaatttt

SEQ ID NO: 125900 - DNA, 1118 bp, Homo sapiens
atgccaaaagggtcaccaacaccccctggcccacgacctaccgctggccaaactgtccccacacctcaacagtccccaaagcctcaggagcagtcaaggcgtttcagtctgaatctgggaagtattactgatgcccccaaatcacagcctacaactcctcaagagaccgtgactgggaaactctttgggtttggagcatcaatcttcagccaggcatcaaatttaatttccactgcaggccaacctggacctcattcacaaagtggaccaggggccccaatgaaacaagcccctgccccttcacagccacctacttcacaagggccacccaaatccacaggtcaagcaccaccagcacctgcaaaaagtatacctgtgaaaaaggaaacaaaagccccagcagctgaaaaattagagcccaaagctgaacaagctccaacagtaaaaagaacagaaacagaaaaaaagccaccacctattaaggatagcaaatctttaacagctgagcctcaaaaggctgtccttcccacaaaactggagaaatcgcccaaaccagaatcaacctgtcctctctgcaaaactgaactcaacataggttctaaggatcctcctaacttcaatacttgcactgaatgcaagaatcaagtgtgtaatctctgtggatttaaccctacaccacatttgactgaggtaagttatatatatatatatatatatatattacatatggaggtgagtctgtgggtttattttgaaacatttgggtggccaaatatctgagcaaaaaatacatttgtggtgaagaaaataaattgataatcttagaagtttcaattacttattaccagcttaccttcttactaagagttcatgttatttgtactttcctgggttaatgttccacaagtaagaagatgaaataagttaaatgaacatcttaattattaaattaatataacaatgagccaatcattcatgaaataaagaaaaaaataatagcttttgaggactattttcacgtgtaaactccagataaaaggttttaatattttcacatgtaaactccagataaaaggttttaatattttattcccatctctaatccttccagtctctgt

SEQ ID NO: 125901 - DNA, 1049 bp, Homo sapiens
ctttccatttcccactcaaagatctctgtgttttacttttatttacatagttatagcaactaactaagtttaaattataagacagtctttagggttgtatgcctattttctgatggggattctatagtaaagtacaacttatatttgtaggaagtacatgcaattataattcctggtgcaagcagcttgctttcaattctgtttctgattatcacaaatatttgacattcatgaagtttattttttgttgttttacaaatatgatggattaagtgaaatattaaaacaatgattaaaataagtttagtagtattttcaagagagaagaatttagtataattaaggtagattttttttttggtactctgcttaaagttagatttataggactctgtacagggaagttatttaaataaaatgcctaatgattactcataggattgccatacctgtaatcagccctaagcatgtgctgttcaagggaatggtacaatatattaagtaaatatagaagatttatagaataatgtcaaggtctgaatagtgtacctataaagaaatgttcagaatgattttctccaaatggaaatatgtagcagtccattttaagagctagcttggaactattggaattaactagggtaacacttttagttctgtttaagtaaagccttgagagacatggtagaatatatatatttttgtaaacttttccttggaggaaatttcaaaaattcagaatctacttatttgtcttttaccagaaaatcactttatgcatacgttgccatttatagattattttcttttcttctaagtgcttgctacctagaagtaatgcttctttgcgtctttctgctatctcttacatcctgacctgtactcaaatttctatgtcaggaaatttggaaaaagttaattcataagaagtattgaatatgaaataaaatatttgtagtctgtctcattagcaggtaaattttggtaaacccaattagaacctataaatctttattctgatattatattttaggtgctactaagttact

SEQ ID NO: 125902 - DNA, 1016 bp, Homo sapiens
aaagaatgtcaaatcagatgaagttatagttaggattctaactactgtaaaagatttttgcttccctcttgtggtaaaaaaaattatattctcacacatttcttttttctctacagacggatatctgtttaggaaagatttgaaagcagattatcagtaggtacatggatacatcaagttcatttgcagaaacaaataactgaaataaaaaacatgttaatccttgtatcatactttaatatgaaagtattgtttatagataatttatctcacaagtcaaaaatgaagattttgcagcactgaaaatctattaaagctccaaattttaagtttctaaataatcttcgctgaaatctaaaatatactataacaaccgtgttttatttgtgaaaaaaatattaaagtgatttgctctcaaatatcaaattttcttctctcttttatattaagagacagaaaattgtttcatgagttcacttaactactgagatattcagagcatttttacctctctcttaaatgttataaaaaacaattgtatttttaagaatgtttatttatcaaagtctttccttcttctattaaatatttagcaattacctttctaaaatatgaaattttgtaagatgttttcacctaaataaaaattgaaagcaagtggattacacaggagaaccattatgaacatttatttagatattaatcttaaacagtgtttatttcagttttcaaagttagcttataggttatacatttaagttaaagtgctcataatcacttgcaatttcattgtaaaatgaacaaatacataaatattttaagaaaaatttaagtttattcagataagtcaccatgcttcaaaagatctaagaaatgcaaatatactgaaaattgacatcctctgaaaattccacttgctatttacccaagaatccactggaggtcattactgccattaaataataactgaaaagactatgtagtgaaatgtatttttaaaaactatattcagtaaa

SEQ ID NO: 125903 - DNA, 1028 bp, Homo sapiens
atgtaagggatgttcactgaactgattaactgatgaatttttttgtaagacgacaaagtgaaaggagcccagttctccaaagagaggtccttgtagaaacattggtcactaccatctggagggcataatcattcctgaaagaatgtgggaagtggtatttgttctgtccattgaaaaacaaatgttaaaaaataaattttagaaattttcctttcactcttactgtgactgctatattgaaatgtattttttctaatgattaattgaatcattagggagaaaaccctcttactttacagtattgatataaaatgatctcaaggtcattgatatgaagtgaccaccaatgtaaatatcttcagaatacacacacacacacacacacacacacacagagagagagagagagatgtaattatttagcatttttgtgtatgtatgattttcagggtttcattatgtgacagtgaaaatgaaaaaattcaagataggtagtggaaagggtgatggattgttattttctctcctgtgtacttcagtgccatttacttttttgtttttgcaggtgaagacagatgacagagtggttaagatggaccttggtttactcttcctaaggttacacaaatcagatgctgggacctatttttgccagacagtagagcatagctttgtccatacggtccgtaaaatcaccttggaggtagtggaagaggagaaagtcgaggatatgtttaacaaggacgatgaggaggacaggcatcacaggatgccttgtcctgctcagagtagcatctcgcagggagcaaaaccatggtacaaggaattcttgcagctgatcggttatagcaacttccagagagtggaagaatactgcgagaaagtatggtgcacagatagaaagaggaaaaagcttaaaatgtcaccctccaagtggaagtatgccaaccctcaggaaaagaagctccgttccaaacctgagcattaccgcctgcccaggcacacgctggactcctgatggggtgaga

SEQ ID NO: 125904 - DNA, 1017 bp, Homo sapiens
ctatttttagttctttgagaaatctctatattgtttttcataaaggttgtgctaatttactaaagttaagtaaatggcacaaaatacaaactagttagtacctccagagctgtatggcttaaataagtagaaacagtgaaattaggagggtgtggtgtaataaaaccaggaaaaaaggaattggataagatatattaaacaatattctttgaacaatgcataaaacgaggaccaagtttccagggataatgtgtgaagtgggatgttaaggcacgattcatctaataacaggttaagtgatgaatggtgctctgttgaaccagaaactgctagtttagtgtactctaccaaaatattcgaatgacaaagagagagatccacaaaggtagacaagagtagaaataaattttgttttgttttctttttagtaaaaaggtgacttggtcatgtttataggttgaaaggaagtagctataaagaagaaatgtgcaactagttgatgaagcaaaataaagaacatgtgggagagaatataatcacaggcaaaatttaaggggtaaattcttagaaggaaaacagagactcttcactctctgaattaggagaaaataaaatgattcatttatgtggataatgtaatttcatcaacagaagttaagtttagcagttccaaaggtcttctatcttcatttaaattcagtggctatatatatttccacatatagttttaatctgaaatacaagcctaaatcttccttctatgaagggtgtataaatcatttttttctgtaatagcagaggacaaaactgttaaaattatagccaaatcaccactataccctggtttatgaagactcaatttctgcaattccacatacttgaatttatgaacctccataataactacaaaaattttaatactgagtaacatccctaagtggagaaattcattcttgttgagacatatagttaaggtcatatagttgaagtatttctgtatgcatttctctttctata

SEQ ID NO: 125905 - DNA, 1047 bp, Homo sapiens
gactctaattatacgaggcagattgagggggaaaatactaatatttcttgagtcccactagatgcacaaaattctgctaaacatgaaaaacacactatcacattgaatagaggcaatgttatatctgaataaaagtaagctgactacagtatattattagtttatgtcttattgttagaaattctatttgtactaattgattataatggctatagaacaaactatttggattttaacacctttttcatttgcactttattatatatgggagttttatactcaaaataactgttttgtactcaataaatactttacttcaaatcccattgtctttatctgctcaaataccttaccattcaagacattctcaaactagaagatttcttgttgaactaaatttttaacaaaaagtaaagagaaatacattccattgttgtttgagtttccagaattcaacattatgtaaataaagaacagggtaacatagatcttagctactgaagaacatataatggaaatatgaaaaactatgaaacttggattttattcttttttcatatgaatgatcatttttttcagtagcagaatactacttgtatatgaaatgcaattggctgcattttaaagtctggaaaattgaaaaaatgaacatctaaatgcatttactttctttcaggcgtttccggagacaagatgttcgacatggaaatgcagctcagcagtgctttggacaacagtttgttggtaatccatagaaaatcagttgttctgggttactcagagaatacattgaacataaactacaaacttcttaaaaagagtcctttttttctttgtgattcatgtatactagaacaatgtaataagtattctttttctctgacatgtagttaaaattttgaaaatttgactaatttttacctgattaggaaaataagttttatgtgctaccaccaagctttattattaaactaattattaaaacaaagaaaccctagaacaagaatgctgcatactttaggtggttgatgccacagtgactcttat

SEQ ID NO: 125906 - DNA, 1001 bp, Homo sapiens
atacctaaaagtatgcttggtgaaaagtatatgtagtaaaaaaatattccttcaaatctcaagttttatccttgttatttaataaaaagaatataatatataatggacacagcagtattataaaatatgtactattattgatattttggctaagtaacaccaattgaaattttatttttaaaagtactggtgaaaacagaaacattcagtaacatgaacatcgtattcctctcagcctcttcagaggagttagcaccacatataatttccaagcaggacaatgtcaccaaatttttatgttctaacatttaaattagcctctaatttccctaggccaaactgtctccttacttctcattgtaggaaatctataagaagtttttttctctatctcctcagaatacttagcacctcatttaacatccttgctggccccttaggaaagaaatgccaatacaaaagtattgctagagtacaaaggttctaccacttgtctctgaactatactattaagattcttcttagctaggcatgaagtcttttgtgcttttagcacacatggctaaaactgatgatgatagtgagggtgatgatgagatgatgattttgtatcattcatcctgtgtgcaactaggttggaaaaactttggatcattgtatgtgctatgtgagctatggagagcaaagatttaacttgtcacacaagtcaacatctatacttttacaagcagctggtgaaatcccatcactacactgattccacgattacttgcaagtcaaatagaaaccatttttgtagagcaaaaacccaaagtgaaaacaaaccttacttccattaacaagtgttaaagctttaccatttcaatcactctctctcactagcttaaaattattacttccagtaagacataaagtatattttatttcactctattgattgaaattacaattttaaatggagaaaccctactcctgtggctttgctggaaatgcttcctgaa

SEQ ID NO: 125907 - DNA, 1074 bp, Homo sapiens
ttgcctttggacattttccctgtgagttcactaatggtctgattttgacaagataatgccttgacagatgccaatcagtgtctactttgctagttcccattactatatttttatttattcacttaccttgcttgaaaaaactttctcctccaacactgatttaaatcagttctccaatacttaccaattgccatatccaagaaaaatttctcgatttcataatcatagaacactcttctcactctttcattctgattttcctgctcttacgttgattcatagtgaacacgttcatcatttgctctctatcttttaaatttgctgctcaagtttaagatgtataatctattgttttcccctttatgtttctgtatttttttaacccatagtaaagtgctgtaaaaatggataaaatattatttcatatattttgacacacaaataaaaatattagaatcagtatttgttaaaaggttatatagacaatttcctgagtatctttccaggtaaggcatagtgcaggtaaaatgattaggataaaaaataaagaagaatatacctcaattctcttgacagggctagaataatattactgaattcctcttttacatcatataagccataaactgtcatataattatgtatactgtgcttacgtggggtctttccacacagctttagtttgttatttttcagtaggtagtttctaatgctcacttagagaaaataatacatctctttagacaagaatcctgctgttgcaaagagaccttttcttcaacagagaaacatggaaacaatttgtctatcaattattccttgatgcaaagaaaaatagttaatgtagattggtagttatcacagcgcatggagagtacttaacgttttaacttcatctcctcccttatgctgtgaataattcatatgttgcatgataattcagtgaatttatatgataaattaaagctatggaataatcggtttagtttttctatgggttaatatgatcagattataagctattttcctaaatgatagcgtaatggatctttctgagaaatcaagcataagaca

SEQ ID NO: 125908 - DNA, 1047 bp, Homo sapiens
taaatagaacaccagtgccccagaatctgttgtcccccttcaataactacccccaaaataaacactattatgatttctatcatcatagattagttttgcctcatttagaattttatgtaatggaatcatacatcaagtgttttttgtgtggttagcttattttgctcaacagttatactgagattgatctatgttgtgtgtagttttcgttcatgtgttttcattactgtaatttatttacatggatataacacaatttactttcccactttttctgatcattctaattgtttatagcaattgtgctgtaattgtgctgctatgagcattcttgtccatatcttttggtgaacttatgggtgtgtttttagttagtatattttagtagtggaattgctgtgccatagaggatacatatgttcaactttagtaaatactgctaaaccatttttgagtcattgtacctattttatgcccacaagtggtgtataagttttctagttaccccacattaagcattgtctgtctttttcttaggattctaatggctgcatggttgtatcacattgtggtcttaatttccaatctttctgatgctcaagaaaattgtgtgccttttatatgcttattgaggctttgagtcacttttgagctgaagtcttcagtttgccatttaagagctgtttgacatttgccaaatgggtttgttgggggattttatgagggagcaagtataaaatatccaattcaatactcagcatacagaaaataatcagtgaaagataattctttttatggcccccttctgtgctgtttaaaacaaaatttaaaacaaggtccaaaataaaattgggaggaaacagtagagagtagttgatttatatgtgtataatgtatgtaattagggggtgagaaaagagaaacaggaagagagaacaaaaccaacgttttctgattatgatatttaacttattgacaatcaagttaagtccgaaagaaaatatgtgctgtatagttctcattagtgtgtgagggagtagagattaa

SEQ ID NO: 125909 - DNA, 1036 bp, Homo sapiens
aaattatttattttttgctacaggcgttgttgatgaggttttgattttgcatcctacttaatccctctgtttttatggggggatttcatggagaataaaatgagtgtccctgctgctattctctcaaaagtctcagagcactttttaaacagtaacaagtgatacaaatataaactactacaagtttatgtctacctctgattttactcacatctcaaagaaaatggaaattatgtgttgaatgtagatgctcagacaataagaaacagagttttaggtataaagcacatatttctagagaattggcaaagaccttgaactcttgcaaaattaaaatggttttcattacttaacagccaacatttctcttaagaatgagacgactttagcacaagaatattagcacgttactatttgtattttctttcttgcaaacaaattaccaaaaatgtagctgattaaaacacagcttcacacacttattatctcacagtttctgtgggacgtgagagtccaggcactgtttagttggctcctctgctaaaggtctcccaaggctgaaatcaaggtgttgcaatctttctggagctcagggtcatattccgggttcatgaggttattggcagaattcacttccttgcagttgtaagaccaaggtcctcattttctagatggctatcagccaggggctgctgtcaactcctaggggtcacatgcagttccttgccatgcggccctgtcataacatggctgcatacttcttctagaccagcaggcaaatctttctgttcagtttactaagagggaatcatacagcacagcttcatcatgacaatgactatcccatcacgtttgccatataaagtagtataaggagtgatttcttaccgtattcgcaggtgtgcctacaccagaggaaggggatcgtgtcgtacagctatatttgagagtgggattcttgaacatcataagcattctacccaccacagtattctttccatatcttacatgttaaagaaaggttgcattaatacag

SEQ ID NO: 125910 - DNA, 1048 bp, Homo sapiens
attcgacctatagtggggtcagtgactcctctcaggtgtatgcaaagctgcattgtaaccagatattgactgatatctttcctaaatcatgcatgacccactgatggattcattgctaacatcaacatcttttctaggattttatgtgtgtgctttttgctttagggttggttttcttttatatcaccatttttctctgtttatcttttcttgtgttgcaacatcaaaaacaaaactgtgttttcacttaaagtttatatgccaaaactgtgttttcctttaaaagtttatacattgcactatgaaaattaaagaacacatgatgctgaatattgttagtaaaaaactgcttggggctcattgcaccaatgaataacaacatcgaagtaatattttatacctataattcaaaacatagagtgcttgtttctatgataataaattaaatcagatagcatttatcactataaaatgctactatcatcactttgataaattcccattattactcatgtatcaggaaatggatttggctacataatgtataagttaagtgacaagcctctttcacttctgggatttacatgccttatctgatattttatggggcatggctttaagaaaaagaaaaagcatacgtcttatttttctttttttttttttttttttttaattgagatagagtctcactctgttgcccaggctggagtgtagtggcaggatcctggctcactgcaagcttcatctcccaggttcaagcaattctcctgcctcacccttggagcagctgggactacaggtgcacaccaccacgcctggctagttttgtatttttcatagagacaagatttcaccatgtttgccaggctggtctcaaactcctgacctcaggtggtccacccgcctcggcctcccaaagtgctgggattacaggcatgagccacctcacctgtcctaaaaaagctgaatcttgaacatatttaggattcaaacaaatatgagattttagaaactaaaatacctataggaatcattcgtgtaaaagaaa

SEQ ID NO: 125911 - DNA, 1037 bp, Homo sapiens
atcatgtataactttttttcagggataagcttttaaaatgtcacaatattttaatagcacgagagctcacaattctatactatgtacaatgaatgacgtgttaaattcataaaacacaccacctgcttctaggaatgttgtgtggcccctgcacaaatgtgctctctaaattcctagaattgctaacttagtgagtaatgaaactatttggaatttctttttcctttgactaaatgtccaaattgatataagataggtctcagatttcaaaatttttggtccaaggcttgtaaagacaggtttggcctttttatttacaaaaatatttcttttatttatctgctgaagaagactggagaatattctttcctctaaggtacctcaggtggactcacagaatattagcacattagtgatttataaacttttctactgatatgacttccttattaagggagaaagaaaactatcttacaaggtctatgaggcaagcttatctaagtataaatcaaaatgtaatttttgctcaaagctgtgttctatttttactaaggtaatcttgttggtttatattgtttatgaagtagtagataacaatatttaaattaatacataagcatttgattgagcaaatataatgtttctctgttatgagattttaaaatgtgatttttgaagcattttctcaaaagaaacgtgaaatattttattaaatgtttatttcttaaaaatatctgttaccaggctttctatgtcctaggcagtgtgaatgcaaggacaaaacatgttcttgccctaataatgcagcatttaatcttaaaaaagaaaaatacgtgtatattatttactgtaattttataaaatacagtggaaatcatagatacaatgtatggacaccaaaggaaaatacatagataggaaaaggccttaacaatatttattgtttctcataaagcggaggaagataaatccaccaaggagacagggtgattggccagagagggagaacacacaagaaagtgtcaggaaatccaaag

SEQ ID NO: 125912 - DNA, 1043 bp, Homo sapiens
ttaaatatcaagacagatgctgtgctgctatgtgtttaaaaaccatctctctgggaagaaagagccttgatttgtaggattttccgacctccatggtgtaaattgtaccaccacatccaatttctaacagtcaacatgatatcctagaatgtcaacttgggaagaaatgtgtataggctgtcattatcattgaattcatgccagttctattgagagccacctagccttcttttcctaaggcttcagaatgctggcagctctccagagacacagttgaaatattctcctcagaggaatctgactagtctaaagaaatatattgatgctggacttcctaaaaaaaaaaaaataacctaccaaccctttctatagcaaagcttacagttgacaagctctacccatgggcttagagattccattcttgagctgcttttaaacacaagtatacaacccaagatcactggatagctaaggaaatcatctaaaatgaaatatagagacgaaaaaaaaaaaaaaaaacccaaacaaacaaaaatgaaggaacttagaagaaacaaactattctggaagaaaataaagatcttcataaagatcagagaaaatattgcatccatgaaacaagatcaaattgctactttaaaaatgagcagaaaataaaacagctctttgaatttaaaagtatgcgaagaagaataaaaatctcagaggaagttgtaaaaattaaagttgaggaaatattccagaagtagggggaaatgatgaaaaaaatacatgagaaaacaagaaaatctgaggtcaccccagaagttcaaaaaataagcattgcagaaagagaaaacagaacatatgtgagagaagtcatcaataaagtaattgaatactttttttagtaattaaataaatgtatttttagattgagagagcccagtacaatggatgaaaacaaactcataccaaagcaggtcatcataacattttagaacactggagaaatataaaaggctctgtgaggttccagggaaaaaaaattaaaatgaaaaaac

SEQ ID NO: 125913 - DNA, 1040 bp, Homo sapiens
ggagttcgagaccagcctggccaacgtagtgaaaccccatcactactaaaaatacaaaaattcactgggcatggtggcacgcacctgtaatcccagctactctggaaccagaggctgaggcaggagaatcacttgaacccaggaagcagaggttgcagtgagtcaagattgcatcactgcactccagcctgggtgacagagcaaaactccatctcggaaaaaaaaaaaaaaaaaaaaagaatattccaatcaagaagcacacatgcacacaaataacttgttaaaaaaaaaaaaactatgaattttcccaacttgtttactccttgtttgattttcttacaaagtagaaataaatatttatacttgaacaaataaaatattaactttagatgcttaattatagagtcattttaatggtaagcacatattagggcaagatgattttattttataaatatgttttattgataatgtgtactaagataaaacttttcatgctattgcaaatactacattctgtttcttaaaaataatccttggtaattttattggaaaatgtctgtgtgtatgtgaaaatgtacgtatgtgtttttgtgtgtgatgtataaaataaattataaaatattaattactttataaaatacaaactacatcaaattcatgtctgctgactatctagaaccttgaattttttttttcccccgacggagtttcacttttgttgcccaggctggagtacagtggcgcaatcttggctcactgcagcctccgcctcccgggttcaagtgattctcctgcctcagcctccctagtagctgggattacaggcatgcaccaccacacctgactgattttttgtatttttagtagagatggggtttcaccattttggtcaggctggtctcgaactcctgacctcaggggatccacccgcctcagcctcccaaagtgttgggattacaggcatgagccaccacgcctggccaaaccttgaatatttttaaaaagaatatatattggaaattgtttcacgtagaatg

SEQ ID NO: 125914 - DNA, 1152 bp, Homo sapiens
ttttggtggcagttataccaaagtatgtctgaccacagcggaccagctcaactaaactaccacgagttaccttccttatttaggctgtgaaatgtggcagaataagtgattccattgttaagggaaatcacacccataaagaaaatcagagttgatggttttcttacatagatttgggcttcgtgttaaaattctagctgcaattttgccaactggagaaaaattagaaaagtttatagagcaatgattctactgacagcatctcgatgaactagtctcagattgttagacttgtgtggtatttatgggtgaataatatgaagtcccatcaactgtgatgtctgactctgcctaaatgctaattaataataacttaaaatattacttcataaagattaccaaaaggtgttattcagaaataaaattataatgtttattaaaatacacttacgatgttaaatcagtattctaagaaaatttggctccagttaacatttggtggtttttcaaaactctcaggatgtatcacataggcaattggttgacattttaggaaagacagcttattagttcattctcagccttgcttatcattgcttatcattttcaaatgtcaccattcttgctttataatcagacattaggcttgcttaatttcatcttaaatttgtcatgcactttttgtttaaacaagtttgagtaaggtatcttcatcaataaaattttgatgtaggatttggtaacatttacttcaaccagtttgctctgccttttgacacaaatcagccatatctttattgctaaatagatacgtacactcataacttgaacgtgcactgtgttactcatcattaatttattttccattggaatatgagacatagtgatacaatgaacatgaaatcttttgtctagactcagtggatagcatgaaaaagtttaagacactaataagaagttatttcaaagtacataatggggtattgatacaaatctaatgttgatcctaaagtgaaatctatatcagctaatggaagaaaaacaaatgaatgtaagatttgtcttgagtaaaattgttaacgtaggaaatgctggttatgttttgtctttgtcttctccatccttgccagttcttactcccatgctaccaaa

SEQ ID NO: 125915 - DNA, 1052 bp, Homo sapiens
tcatgtattcaaatgttttagtatgagtaaattatactataaatcataaaacatatatacctgtgagcctatttcacacttaaagatctaaaaccttcactgttctgtgacatctacctgtgtgttctctctctgtctcatcctcctcattcctttcaaggggtatcactatcttgaattttatatttatcactcttattgttttgtttaaaaaattgttcttaaatagtttgattttgcttggtttggtactttataatagcagtattatcatctaagtgtttttcagctatgtgtttttattgcaatcaatatgaagttttgaagactctttcacactgttgagagtagctatattttgttatttttccaacatggtgattatatgccagattcgtaagtccataaagccacttttctttcgatgaacatttaggctgttttcagtattttttttggtattagaaacatgtaaaaccatttctttagtgtgtatacttagaagtgaattggtaggtcatagggtatatggatgaatgtttagataatgccacacttttccaaaggctattacaacttatagttctaccaacagacaatgtgagtattccccttcatccacatgtttaccaacacttagtactttgatttttaatttttttccaatctgatgcatctaaaataactcattgaggttttaattatgttatacttttattactaatgaggttgaaaactttttatatgtgtattgaaatgtatgtcctcttttgtgaaagtctaatcatatttcttgcctattttttctagtgggatgtttgcatttttcttgttgatgtgtgggacttctcatatatttaccaactctcttgtacagtgtcacagattaatgattccaggaaatggttggagtttctcttggtcatcttatcagaacttcttgatatagaaatgaattttctgatgagtagatgataaaataatggatacaataatagagtaagatgctaaaactggtggatattctgtaatataaacaaaacaaaacaaaa

SEQ ID NO: 125916 - DNA, 1081 bp, Homo sapiens
tgttgctgttgtttggtaacattctattgtcaggatgcagcatagttattttatccactcatctactgaaggatattttgattgtttccaagttttagcaattctgaatacacctataaacatcagtgtgcagggttttgtgtggatatacattttcagttcctttgtgtaaataccaaggagtgcaattgctggattgtacggtaagaatgtgtttagttttgtaaggaactgccaaattgtcatccaaagtggctgtctcattttgccttcccaccgacaatgaattagagttcctgttgcttcacatcctcaccagcatttgatattgtcagtactctggattttggccattctaagaggtgtgtagcagtatcctattgcttcagtttgcatttccctagtgacagatgatattgagcatcttttcgtttgctcatttgtcatctgaataccttcttctgtgagatgtctgacactactattttttctcctgttttaaaagtgttatttcctgacagtaataatacttagaatattaaaacaaatatggatataacaaaacatttaagatgacttccattccatgactttttatggttgcacaatgctggagccttgtatatatcacctttcaatcttgtcaaataccatttgttaaagctatccttctatgggagaagaaaccaaggctcaagcaggtagctttgttgaactcctgcagttagcaactgtcctagcaaagatttggacttgttctcagctccaagtccaatactgttcctgctacatcaaaattgatccagtcaaagatgagcaccaattattggtgctttatttataattaacacaacaccaaaatggtttttaatcttcagccaacaatgtagctggttaaaattatactctatttgaaatgtatggactgaaaaaggtcaaaaaacatcattttcaattgatgagttagctagagttagccatttagggaaagcaaaaaggggagccaaatttaaatcttatatttgatttatattgtatttcttttttcactaaaatatttgtatttgttaaaaatttgatt

SEQ ID NO: 125917 - DNA, 1093 bp, Homo sapiens
tcaccactcagggcttaataggaaaagctcaatttgtttcccaaagaaaacaaaaccaatgatgtccttaaagtcctcttgggctttgtgatttaataaaatagaaaatatattaacacaaatagctgagatacaaaatagaaagcacatacagtgaagagaaatgtatataaattgttaagagaattcagaaggagctgatttatccagccatttagcagtctatggtgtcttaatatcctaatacaatgaggctgactataaattcttcatgtaatattttatctctttaatactcataaatacaaatctccacattctggcataaacggcattcaatcattcacttattcaccattgatggagtatcagataattgtgcttcaaactcaggatatactgataaaacaaaacaagaaaatgctggcccttcttcatggaacgtacatactggtgggagagacaggcaacaaagaaacaagaaggcaaatatataaaatgattgctaattttagtgagtgttatgaaaacaatgggaggctctggtagagaaaagtgaaggaatctttgtttaggtgggatggtgagagtggtcagggaaggcttctctgtaaatgggatactgttgcagaggtagaagcacagacaaggacttagtcctgagaagagcaaagaaacagctgtgcagatggagggaacagcacatgcaaataacctaaggccagagaatgcttagtgtcttcaaagaactgataggaattagtattaggaatgtcacctactatgacctaggcaggggccagaggatgtcgactcttgctcacggtaaggagtgagaatttttcccagtagtaaggggaaaacgctgcaagatgtaaacagggaaacaatataactgagttttttgggggaagattgtgtttgctgttctaggaagaatagattggaggtgacaagagtggaggagaagggaccagtgaaagggctttgagaacatcaaattatctgtcaatatttaaacttcatttaaataatggcttgactcatatatctaaagattacacttacactatttttttaaagtttacatcta

SEQ ID NO: 125918 - DNA, 2096 bp, Homo sapiens
cctttcagaagcccaatatgtctacaggcatcatagctagacagcaaggtccagaagaaatggaagactgtttctttccatgcagctaagttttttgaacaagaaaatcccttccccttatccctcattttaattgggcagaattacatcacatatgtccagcaaatcagtcatgggctaggaaatggaattacctaatttgctttaaatgatcaatattctactttttagtgcttctctgtacacctaacaatggtgagcgtgaacactcagacaaaataggggttctgtcatcaagaaaggacagggcaatgccttgctttaggcaacctaatatttccaatagtcatcaaatatatttacgctccagattttgccagtgaatctatgcatttttgtttaggtgaagaaaacctacattaaatgttgtaaataaatctgggtttttaatacccttttctaaatatctctgatatagaaagttgcctagaatgatacacagtaaatctaaagttaactctagaaaacagaatagggactatgaagggagagcactttcactttttaattcatgtttctaggtgtttgacattttacagtgaaaatgtgttactaatcttgtatcttaagaacaaaagaaaattgtttttcctagcaatgtagtatacaacaaaaatgattacagtaaaaagaaatacaatttctgcaatccaaaaaagaagaacaaagcatataatttcagatagtatgctatgatatattgatctgaggaagccatttctcaaggtgtgagaagtctatccctggacagggtatacagaaatttgatacttaataaaagcattaaggtttttagaccaagcatgcattgttgagccactttgaaaccaggtatttctggatcattcatatttgaatgatccaatacaataactactagccacatgtggctattgggcacttgaagtgtaactttagtcaaagtgagatgtgccatagagtgtaaaatacatactccatttcaataaataaaaatatcttattaataagttttgatattagttacatattgaaataatattttggatatattgggttaaaatatatttaaaataattttcatctgattcttatttatttattgttaatgttgctcacaaacgatgtaaagttttatatgtggtttaaatctgtgattcacattctatgtctactttatggctcaggcctagatgtctcgtgagtggggaaggttagattgcagtctccataagcgctgagcaaccccatgtgaaaatcagtgactggatgtgcttggtttgaagttatatctatgaaactcaaatctttaagtctctcaggaataagattaatttttaatctcatagataattatactctggatagatatctggataaataataatctcaggtaggaaagaaactcactctgaagaaacaagagaggagtgtaaaaaaaaggaataattatttgtcagaaatctgaagaaagaaagtgttgagagtagcaggaaaccctgccaatctgattaccttctggcctagccattataataaagatggagtcaaattataattaacttaagaaaatgataattggctgagccaatgaagtactcagagctgaggcggcgcttgatgctaatctaatagttaattgaacacagatgtgaaggagagctctcctttccaattcctgcgcttcagcttagtgagcagtccagatgagggaagtgacaacatcacctccttaggaagtttcaaaagatgtcaccacagagactcaagagcttttcagcctttcttgggggcatctaaggagcagcatgctatagctgaaagatcccccaggagcttcaagaagtagccctagggatttggggatgaggttttcagattatacagttgcgctctgggtaagcttttgtgttttcttgctttttattgttatgactcatttacttttcatgctactgtgattcaaggtaaatatgtactacaatttaaaacatttaggatcaaaattaaatcattttaaggtgagtaggatagaggaaaaaggttcaaacacttaa

SEQ ID NO: 125919 - DNA, 1090 bp, Homo sapiens
aatcaggttcttagaaaggggaaacggatactagaaagtaatgagccactatccactataacatattttcaaaataaaaatcatacatgtgatctggtactaataaatattctaatatgggagcaaagacagactccaaaattcatacccttccagaaaaacctaggaaggtttgcgctcatcctctctacagcacagcgctataattattttggcaatctgggggagacccagtaggttaacttatcagtcctttaaattccagcactgattagtctgatccttttccacttgtttccttcagcattcttggaaatggttcgtttgtttacatatatttggcatatttcccatccctaatctgatcacctgcacctggaaaatcctggtaatttcatttgaaaattcaggtgccctcttatggaacaaagcgctaaataaacttcctgccggctgcacaaatttaaattgttctcacgtaagcacttcaccttcttacacactgaatgttatatgaaaagcaaacaaaaaagtgtattttgacagacagcataaaaatactccatgctgtctagagaaaaacaatctgtaattggaatgagttggcaaagttctccatattggcataattcaccatatggaacagcctcaatactaaagatgctggtgatagtattgtaaaaaagtacagagctggttcatgtacctccaaatacaaacactctttaacaaatgtgaaatgaaatatttttatatgtctggtttgaatatagtttaacaattattatatgaaggtaattatagttatccaaatgccatcaaaagaagccaacttccagttacacagtacatgttatgctatgtatttccacagtaaaattgaaaaatatatggatacactgctcttgcactgagggccgattggatacatatctgtacatccgaactctcttttatctctagacccgggcatcttactgcttgttggatttctccatatggataaaccttgactgcccaaattcagtctgtttaaaatgaaattcatcacaacaaaacccaaacctgtttctctcttccatctttactt

SEQ ID NO: 125920 - DNA, 1722 bp, Homo sapiens
ttgatttgattgaagccttactagaaagtccacagatacagaagattacagaatgagtatcactaaggcccttcttggctgagacacatttcatttagcaaaaataattatcataaaagagtatcaagattttttgacataaggcctgagaactacaataaccagagactttcatgaccaagaatttggtgggacttaaatcataattttaaatgtctttggtctttgtctagtctggcacactgtggctatagactttttgaaccacattgttggtatcagaggaggtacttatgtggatatgtccctttccaggagtatagatatgtgggtgatatccataaaatagatagcactggtggttctataagctaagtattagtgttctttctagtagtgttaggcagtcaccggttccgttggtctaactgtcaatccacagttttgatgagacactgtagtcatagatttgagtgttaaatgggcatactgtaattggaacaactcaaatgactgatggaagaggaactgtaggatgaagagtttcctaaaaccttgcccttaggaagttatttcggttagattatttgaccctggcgatattacttttctgtgcctatgacaactttaataagcagctaaaagatttacacagataaatataggaaggtctaagatgccatcatgagatcagagatcacagggagagcaagaaaagagattggggcttcaataaaaagagatcctatgtctagtagaatgatgaataagaatggggaactgggtacggagagactggtaagcaacatctgctaaggtattggaaaagcaggtggaggaagtagggtggagagccaggattcctagattatttttatgaatttttcatatatgtatatgtctgtacacacagaactagctataaaagcaaatattctgtattcagttatatatttattatatagttaaactacaactatatgtatgaatgtgttactatacatacatatgtctcctttctttagccactgagagcctaggagcagtgacgttagtaatgagcatatccagtggatatcgttctccgttaaaagaagccagggttccttggagaagtggttgaaatggttgatctggagcaggaaaaatataagatgaatctagagcattaatgtgctcaaaaagaaggaaaaagacagaaaagaaaagatggatgtcaaaagaacatagggaccaacctgaaaaacctcacaatggctgaagctggaacaatttgggcaataaaatcagttatgatattactggatcataacccaaataataatataaatatctgagtcatactaatataaataagtaactgaataaagaagtaaatgagagaagagacaactcttccttacagaataattacaattaaaaatgtagaagaaatgaggaaaataagaaatcctcattagaatgtcacagtactaactgctgcaggcaagacacaaggaagggtgctaaaattagtgggcaaaagtttaaagataaatggaatattttcatagtcataaattatttctccctaaaatatattaattacaaagaaaaaaaccttttcagtggagaaacctggcagacaccaccttaaccaagtgatctgggtaacttatcaaatcataaacttcctaccgtgatgtaccgagatgtgattcctctctgtggtatccttcccaa

SEQ ID NO: 125921 - DNA, 1025 bp, Homo sapiens
tgtttcaacataacctttttttgtactattgagtattttttgaacttcatggttatgctatatgataaaatatacagtagaggttaaaacattatttaaaatgtttttaagagatgtgaaatgtatgtgtaggaaatacactttatataacactatttaaattatctttctcaatacttagtaatttctcagaagtttctctacaatttcttgttacgtagagatttgtcagatggctttacttttacttcttggcaggactcccttgaatctttcaaatgaatgaaattctatgctgcaagttataccacagtctactttttttctcacatctctcaaacaatgagacttgggattttaccaacttcgagtgttttaatatgcccataaccatgttgggttatataccagttgaaaatctaatgaattttccagaaaaatacaaaacttacatacactaaaaatcttgcatacgaattcaaacaattcatggatccccaaaagacaatccatgaatatttatggaattcaaattatagtgcttctagacccacaaagaagcctagttataacaattttgacttatcatcttgatggaatgtaatatacagtgagaacaagagaggggttgtttatgatgaactgaaagctcaccatactaaaagtatgaaaaatgtgaagctcagaattatatatgtactataaattcaatgatataaaatgtgcatgctctggacaaaaactttaaaaaatcatgaaaaaaagaaaagtagttctgaaagagtagtaggattatgaataaatttttcctttaaaaaattcctattaaggctctattattttgtattaaaaaataatacagtaataggagaaacctacaaaagagacaactggacaaatgcaataatctcttatctattctctgagtatccactcttgctccctttcttttcattctgttgaatgaagctaaaataatctttttttttcttttttttgagactgagtcttgccctgtcacccag

SEQ ID NO: 125922 - DNA, 1143 bp, Homo sapiens
tttgattgctgtcagcccttctaaggattttctcatggactctgttgaaccaactttttcctttatttcatgcacgtggtttgtttgctgaagttaaggaaaaccctcttctctctccagtctagaatgtagatcatatgtgtagtaacagtgtgtggtgccctgaaaaagacatgcactttggagtgagacattcctatattcaaagactatatggttctgctattgtgtctttgcttaatttgcttagcatcattttccacatttaatgtcttcaggaaactggctagttaaaatggtaaaagttgcattcattgtcgaaattcttataaagtcgttttgtttttctttttaaatttaaaatacacatttcatgggctttatctaaaatgtcagtatttggaaggagtttaacatacagttgaagtaaattttaattaaagtatataaaatgtatgcttttctggcttccctggatgatgtagaccaataaatgtcactgccagttttctttataaatattataaaattatttacagacttatagtaaatgaaagatcaatttcaaggtctggataaatgagctaaacataaccattttttaatatgaagaaacaaaaccgtctttcttcatggctaaaataaacagaagctttttaaatgtcttaattttttatttaaaaagaatctggaatggtcacaacagaatggaagaattaaaataccatcatagctgtgactgcttaattttataacttgaatttgcttgaaatcttgtagatttgccagtctctcttgtagaaagtcccatgttcttaaaaaaaggcacataatttttcagaataatttttaattaactccttgtaagtcaaatggtaatctgtaaaaaataattttacaaaagactttatgcgttaaaaatattcataatttcctcaaaatttaaaataaccctatatttttgccaaatctctttgcagcctctattttgtttttgttataagattaacttcaccaaatgctcttttcctacattaccagtttatgagctgcttatactgtcttggaattttgagtatacaggaagaactattttaagaagagtaaaacatcatcagtataaggaatatcactaatgatcat

SEQ ID NO: 125923 - DNA, 1029 bp, Homo sapiens
aaccaaggaaagagagaatgaagggagaaaagtcctggtggattcatctacttccttctgttgatatctgttctctccttatctttcaccatcctgcactaatgaggttacagggaaggcaaaaataagcttcttgataatggagctcagagaagaaaaaacaaataagccaagacctatgttgagcaagaaataccgatgtacatggaaagccccagaaattcaatcatgggagcttggcagacaggggtaggtgtttgaagtctcaataagcaagaatgcagttgcagaaatcaaggagaattgctgcttaagcataaaatgttctcctagaatagttggtgaagagacatttaaataaaggcatggatatggcagaagagcattcctaaaatatgttaacattatacatgtagatttaaacatggaatatatacttatgcagatagaacttgtgatagagtgttaattagtgtatctgtattgggtattataatcaattaaatacagatttatcatagttcagagagctcaggatttgaaatcagaggcctctactccagctctgtactccccacttataataatgataattaattgtctgcatctcagtttcctctatttgaaaataggggtagtaatggtaatttgcctgtacattttactgggtttttgagataatcaagtgaaacaacaatatctgtgaatgcaccttatcacctaaaaactatttatattattaatgtttttgcagactgatacaaagtgagaaaattggaaggaaacaggtcctaaagagaaaaaccttgaaaatgttatgagtttatatttcaacaagtgctaggataatgctaatatagaagacaggataaagttgctcttaaatcgcataaaacatatgatttatcttgatagattgcactcactccaaatttcatcttccatatctttgacctctagttataataactcagaagatgattacattgtatgtgaattttccaagattcatggcctatatattttttt

SEQ ID NO: 125924 - DNA, 1034 bp, Homo sapiens
agaatgaggcagggtttcactttactttggcccttacattaataaaatgaacagaggtactacctatctcctatagttgttgtggaaaaacgaccacatattaatgtataaaaaacactgagcaagttcttggtatgtagtaagcacttaataaatgctaattatctgagtatcctttatcccacttctgttgggtggagcacgcttaggaagcttggcctgactcactctgtgagtgattatatttgagtcagggtgaaagggcagccagagtcgggtttaatatatgaaaccacatggatcccaaggcctggggaacacaaacagacctaattacaatgcctggagtgtgacgccttcccactcatttcaggaagacctgttttcttttagtggaatttcctaaaaggatcgtgcctgtagatagactaactcacttgctctttttctgtaattgaaatggtatgcaagtcatcacttcacttcctctcacttgtaatattcataccctgatggcctgcccttattggaatcagcgtagcttcctctgtggtcatgtactaggatatttcgtactctcttaagattcaaatttctccacaacatgcgcttttagaaaactagacccagtgatgaaacatatgactgcaaataaactatgaatacgcaagttaacattacacgttaccagatacccaatctcaaatcacttgtacacttgtacagctcttttaatacactatttcgatcttactatctttggagacataaaaaacgtcagagtatccaattgcattttctttaataactaaaacagatcatctagttttgcataaagtcagacttaacgatgatgtcatttttgattatttctttggcttaagcaagttatagtattttgctgacctttggggaaaaagccctctataagcctgttttatggttatttgagcagatgagtgttagagaagctgagtgatcattcagttaaaacaacagcaacaacaaaggtcctcttagtttttatagtcaat

SEQ ID NO: 125925 - DNA, 1079 bp, Homo sapiens
cagaactccaaaaacccaggggaatattctagaatatccaatataaattattagacctaggatgtgtgcagaggcaaaattagtaggaaaaaaaaactctcttaacatttctatctggtttgttctcaaactgaaatatttgtgtgggagggaaaatgtttgtttttctatttagaaagaagactttgatctactaagtaccctaaagggcataaaggctttctctgtccatgagaaacaaaatctcattagaagatggaataacataaaggagagtatagtatccatttcatttttatggccttggagaaaaaaacccatcaagttaaagctgcttttatgctgcacactcacatgttgacagctgagtctgaagaatttacactgtgggaaaacacaggcattgtccacagctctgtacttcatctctgaaaatgtgtagttcatttgagaattcagttatcagtctctcagcactaaacgtgagaactgatttttccaaattagcacaaaggttacatctgacagggtgcaaaaaacagaactgctgcaagatggaagatacagatatgtttgggatagaaccaagggactctgaatcacaagccttgtgaaattaaataccattacagaataaaattgaaaacaatgtttacacattcatgcataaaataaatgagttttgaggcatcagcatagactatacaatcatacgtgttccagaattaacacattgctttgcaaagtagtttttaaaggtcttcaggaatattaaaattaatttcagcataggactttatttttctcaaatcagttcaactcttttggaagaatcagttcacctattttagatgacttttaatttttgttcctggtaaggaaaagcaaacaaccaaacagttctctaaaattgtaacttgaaatatcttgattttttaaaatggagtttcactactttcataattagaaaatttatatgataatgccaataaatgtttaaattcagttttagcaggaaaatttaggaatgaataacactttcagattaagaaacttcagacaatggagtctgttgtgta

SEQ ID NO: 125926 - DNA, 1043 bp, Homo sapiens
tgctttctgtcagaatgaaaaatttgtttgactaatatttttaacagatttatatgtttatttctgttcttacatatgataatttttagaaatctgactctttcctactcttcagaagccacaatagtagaattagtttctatgtttaggacactgtaatacacagacctaaaataaaatgtaacacatttaacaaaatcaaaataatatgacaactacagatgattattatttttaatttcccaatgtcataaaaaagtgatccctgctctaatatcttctcaaaaataaatggaacaaggaaccaatgagttatttaaaggactcattaactttcatgtgtccctctttgtaattgagacagtcgtgtcctagaagtaccatccaacaaatgattaatgaggtttccaaatattctaaattgactgacatggaaggcagtgaacttgtgtttagccaaatctctgtgaggctcaggaaaaaggagatacctgtctcttaaataattcatgatcatgtctaatattaaatgcttacaaatgtattttttaagtgtaaagagcttaatacgtaaggtaagtaaggaggtaatttctgaaagttttctctccaaatttctcattatgactggtttagatgtagagatcttttaatcttgttcatggtagcaacaaacttctacaaacgcattgaataatacagaagaaataacttattggatatttttccactttcttgttctatgaactggttaaaataccttttacaccacagaaatttggatggcaatctgttctatttgatcacagtaatagctcctttgaataaattataattagatgccttctcaggttagtgaagggctggaattatctgcatcagtgattaaattcttactttcacttgtgtaaatttgctatagctgtaattttgaagtaaaatgttgaaagtgaatttaagaaaaagttaatattgcagtatcctgttgcaagtaaactagaattttttttcaaatttactgtactttggaagttcctttgtat

SEQ ID NO: 125927 - DNA, 1105 bp, Homo sapiens
taagatcaatatagtagtatatattagtttacatcaaggggtggaaatgtttatacacagttgtgtgtgtgtgtgtgtgtgtgtgtgtgtgttaatttgtatagcgtccttagaaaagtctgtaaacagattccatgggtgaagtttccttaatgatgttcaggagggtattttctgaattttcaaagaatatgatttaaataatttggccaaatagcaagaaagttacagcatctggtttaaactcatctatcacgcacagtaacatgaataaatggagacattcagcactatacacacaacagaaattgtgttctcctattgatataattaaatactcatagaagcctaaatgcataatagcttccagaccctttgcttaatgccaaaaagcaatggctccgcttccaatgaacttgataggcatatgttcctagtcaggaccattgtgagccctctccagtttctaaacatttattgctggtactgtaataataaacatcttgcatttataagatgtaatgttgcctagaatttttcatttttcaagaatgcagagcacactctctaatggctctcatatgtccagtgtgcccacaaacaatttgtcttctgagtggagtgttaatctgacacctcaaggacagacctgttttcagaaggacttaaagaaaagctacacacattcataggcctcaataactactgaaaatcctagtaaactgtggctgggattactcagagttctggatcacatcacttcatgccacattttgcttacataagagttattaaagatgatagtagaatatttttcgactcattgtcaaatatgtacataccaaacacacatttaatatatgtacatatacatgaaatcaagctaatgatgacatttatggtcctgttcttttgttttatctggactcagaggtgtgtgtgtgataggaatgtattttttatttgtttaacccagttgcacatgataacctcacagcagtgacgaaggaagcaaatatgtgctttggtcataaacaccctggggcatagcaaaatccctcctctaaagacaaatccaagattttcttctcaggtcaagggcagc

SEQ ID NO: 125928 - DNA, 1066 bp, Homo sapiens
ttagccaggtaatcaaggtcaatatcaacagtgggttgtaaatcatgttgatagtttatgcttttgatattattgcattaaaatgacaatttacctctgtgatctttcttcccaaactcatatcttcaatctaagcacaagaaaaacatcagataacttacactagagtagcattctacaaaatacctgatcagtaatcttcacacctgtcttcaaaaacaaagaaagtcatcacttctccgcgcaaatgaacgaaaccaaacaaacaaaagcctcaaaataagcaaggaaagtctgagaaactgttacagcatgagaagcctaagcctaaagagatatgagaactaaatgtaatatagtatctgcatgggaccctggaacagagataaaaaatgtcagattaaaacaaagagaatctgaataatgtatggactttgattattgaaaatctgtcattattgattcattaattgtaaaaaatgtccataccatgtaaaatataaataataagaaaaataggatgtggtttatggcagacttatctgtactatttgctcaatgtttctgtaaatttaaaagtattcaaaaaaatgaagtctatcttaaatgttatatttaaattatatagtggaaaactttactaatagtgaaccattctctggtgtcaataagattaatgcatgtattagtcattttcacactgctatgaagacatatccaagattgagtaatttataaaggaaagaggtttagttgactgacagttccacatggctggggaggcctcaggaaacttataatcatagtggaaggggaagcaaacatgtccttcttcacatggcagcaggagagagaagtgcaggggaaagagggaaaaaacacttataaaacccttatgtcttgtgagaactcactcactatcataagaacagcatgggaaaactgctcccatgacctagtcacctcacatgaggtccctctcccaacacatagggattataattcagattacaattcaacataagatttaggtggggacacagagccaaatcatatcattctgacc

SEQ ID NO: 125929 - DNA, 1050 bp, Homo sapiens
tatttgctggaaatctgaactttttttcaagtttgtttttctgtgatttttattttttgtgtctttggagacgaaaagcaaaattgatattaataatagtttctactagaggttttaaatatttaaaataatttagaacaagatgttttatagtttacttttttagctttttttaaattggttctattttatttatagaagacattatttgacactctttatagctcagatatggtacagggactaatatattcacatgtaagtaatatcttttgaggttaaaaactgaagtatttctatgttttatcactgctaagaagatttttgccacgtatttacaattttaacagagacatgtcatttaatatccatgcccatgtaggcttttaaattaatatagaaaagctaacttgctatattattcctttgctctcaagaagaaataatcttagcttatttggaatatatttatttttctaaactaattgtgtcctagtgttccaggatcaaaggccggactacacacgttgggtagttttctaccttctccaatgggtagggaaagttaaattattcatctggggtctcagtcttttaagaaacctaggaaaaagtaataaataagttgttcatagtatctactgaaaaataaacaactcagaagtccacatgtgaaataaacttaagtattagaatttgaagactttaaagttatcccaaggccacaactcactggttagttaactagtaactaatagtagttactagtactagttagtaatactaactagtaactactaataactagtatcataactattaactactaatagttaattagttaactactaactactaatagttaattagttaactactaactcatggagaacacttataggtttgcacagaaggtagcccaactcatgtggatcatcttattatagctcaaaattagaattttcttcctttttttggatgactttgcttcactataatttgtaactagttaacaaccttgtacttggaagctaataatgcataggatgt

SEQ ID NO: 125930 - DNA, 1035 bp, Homo sapiens
tcttccaagattttctcatccccattccaaggcatttctaccctgccgcactttcaacctcctattgtatcatttgatttaggctaagatgtgaataaatgatgatgggagataaaaactgttcctctcttaaactatactagttcttctagatatgaggtctataattgcatcctaatttatactaattgtgacagatctcacagtaattgtggcaaaactcctggaactatattattgcagaaattagtttctagtatcaagatttaagattttttaaaagaagaaccaaatagcagtgatattaatctattgtcaattacaaactattaggctggaacactctatttagttattttgatgatgtcaacagaagacataatctggttgtacaactaagccccaaggcagaagtcattactttatgctcttttttttagaatagacggttcatcaatgacatggtgaagatttattctatcacagccactaatgcagttgatggggtggcgtcctcatgccgtgcctgtgccctcggttctgaacagtcgggttcatcgtgtgtcccctgccctccaggccactacattgagaaagaaaccaaccagtgcaaggaatgtccacctgacacctacctgtccatacatcaggtctatggcaaagaggcttgtattccatgcgggcctgggagtaaaaacaatcaggtaagtgggtctgcatttcaggtatccccatgaaagcacattttaatagagaaattcaagcgttctccttaatgtttctctgggagctatgaggttgctatttattctgaaataagactttctacttaccatttctgttttctcccttcttgcgtttattaaacacttactgtatgctatgaaagtactagttactggtgacataaaatattaaaagctcccaaataagaatgcttttccaaaatattaaaactgatttcttgtgtattgtttaggtacagcaaataaactacctatctataggctggctatagcagtcatctgggaacag

SEQ ID NO: 125931 - DNA, 1062 bp, Homo sapiens
cacacgcacaaacaggaagcgatcatttgggagacagaaataaaaggaaagtcaaagtgctggcagatgaagcacaagaataggatgtgactttggaaaatggtattcaaaggaaataaatgaggcctggacatcagaaagtatagaattcctcaggtttttgtatggggtgaacttataaaaggtaaatcttctttgggtttcttggcctgtgtttcacttataaaatgttattaatgaaacatgaccaattatttgtattatgaggatgaaatgagattaatataagataaaggagaaatataaatatgagggctgattattgctagattagtagagctagatcctgatattttgggaagagtctacagtgagactccagaggttcctaggataggcccatccaagacttggcatgacatttttgactcagtgaataataggacttaatggggctgccagagcaaaaaaatataaaggccaacagataattcagagttgcagtaaggtatcagaagatagaaaagtacatgagagtaaaaagaacagaactaattggattatgtctgtattatttacatttggtaaattaaatcacaaaatagctgattcttagttcactgctgtaaaatcttgcataatgcaattctgctgttctccctgactactgaatgatgagttttgctaacagtttttgttccacattcagtttataccatgtgctagacaaaatgtcagatatgaaattagtaatttaaagaatataatttaattggataaggatgagacagatatgtaaacaaacattgcagttaagtgatttgaagccatgaaagaagcaatgggccatcatatctactgaggggggtgggatcagaaaaggccctatggaggaagtgaatgagacttaattgataagtaggaatttgccaagcagacaagggtcagatgtgagtgtaggctagtttgggggaaagacatttcaggtgaagagcacagattgaaaaagggcagaaacatgaaacagcattgtattgtaattggttctaactgaagtacagc

SEQ ID NO: 125932 - DNA, 1118 bp, Homo sapiens
accttcaggttccaaccgccgccagggccgctccgcccagtggagcctgtccggcccccttgctgcccgctagctcccgccggctggcgcaagctgtcggcgccggggcactgcgggcggggtcggagcctggccttcctgacgttgcagctgccgtccccgcacgttccggccagggcctccctcttagggccgggcggtgcccgtggctcaggctgcagagtagggaagcgagcggctgccgaggcacagcggcgatccggcgggggcggaaaatggcggcggcttcggaggagctaaatggcgccgggacccctggggggtggggtgggccgggaggttgagtagagaactgggccagaaggagtggagacagtaaggaagccctacttgttttctcgtggtgttctatttttagtttttatttttgttacgttttcggttttgttttatggtccagcgtaggagaggtaggcttgggtggggtcgagagagtgggggtgggtctcgacccaacttccccccctttgcttttttgttcttttccctcgtttgcgctttagattcttctgtaattttgcgggggttcagccttgctcggcgattcacggcccagacatagagaatcgggatagctggccgaaccgtctctctcagtctgactctctttaaagaagggatgtgggctggggcgcggggacagtcctggtggagcacggaaaatgcggctgtaaagttgtaattaccctattgtgccgagttccgagaaagttcttaaaattgttaagtccactttgttctctaaaatgtacttcgctttgagaatttcttcagggaggtatgtagaatgttttaccacaatctccagagcagatttgagagtagaagtggccaagtgcccttttgtgcaattgaatgatagagcatatgtctttatataaaatactcggtgtagataaggaaaaggataatagtatacagtatgagtcaggactcctccctttctctcattgaatttgtgtagttgcttttttcgcaactcattcatctttgtgtacctctttttaatgtacatggatttgattatgtgtgcctcctttctgacagtcgaggctgca

SEQ ID NO: 125933 - DNA, 1050 bp, Homo sapiens
cagttaagggttttcatgttttttcattacttcaaatttctttaagctggttttgaaattatatttcaaatagctttctgaggattactgtcttttaataacttgaataatttgccatcactttaacatttaaagaatgactatggcgatacaccaaaatcttatctttttgctcttatggtgtacttagagacaggatttcatgtatttggttaggatttagaaattctgttaagatttagagaaaaaaggttaaagctacattccttaacgttacaaaaattgtcatgctgagagaatccaatttggtgtgagaataatttttttcttccatacagaaagcacaaaaaccagcctgattgtatctggaaaaaaccattatgttacaggtgtgaaaaatacatttcatgattgtggtgatttttatctcattttaactctcgatactaggtgcttctgtatgccaccaaacaagctaattttttttcttactattttagttgataggctcaccccaaaatatgcttttggggactgatttagcacctgcatattctgcgtgaatctctttaattggttgcagttgagctaatggtggagccaaaatgctattgccctgtcttcatcaacatttaatcagtaagtactgggcattgcatctttcttagaactttaagttcatacgttgcagttatatgaatacattattttatgtaaacatttttctgagtgttcaggttttagaagtattttgaggggaagaaatcaaagtttgggcgttatgacttgagctttgaaaacagcatggttgggaaatgtttactggtggagactcatatcaaaagtagatagctgtcctctagtcctttttttagagatctcttttttcaatcctttagttatctcattacaccccaggggtgctttaaaggtggggagatagtgtatgtattttataaggttagtttgatatcactggttagtatttaaataacaacaaaaaacttgcctttacctcctccgcaaaaaatcttacctttctattagcct

SEQ ID NO: 125934 - DNA, 1065 bp, Homo sapiens
atatggatagttaccaaatgtatgtggcgtttgtttactttcatgtcatttctccgtttatcttgatggtgctttcattttgtgaagaaaattcctgtaatagaaatcacaaatagattttgtgtttgctttgattctataaaggtagataagtttaaataaaaggaggaacgtggttgtgtctcccccaccccacccccgccccacccaagtttgtagaaagataatccattccatgactgagtactagaaataagttgtcagagaaaagcacactggagagctcattatgaacagtttaattttctatcatttcatatatttaaatgtcattttgattatgtacactgttaggtcattcttccaagcaccagtggtcaaagctgattcattcacttcccatcaggtgttacgtatcagaaatgctcattaggtttattttagtgccggtgtatattttagtatctaatgagtaaatgtgctttaaaaattaacttcactgtaaatcacaggtgtctggtgatactgtatatgtccatgtaaagagcctctgatggtgccttgtagaaaagtactcagttttgaaaggatgaaatctttcaagtgtggcgaataacacattgtaagctcctgaaccatgcatgaagtgaaaaataacatttttgctttttgaataagcaatatagttttattgtcaaaccagatatgaaatgctgcaccttaaaatccttgctattaagtaatcctccttactcaagtaatagtgacattgttttcaatagttggtaattgaaatcaacaaagcctgctagaatagactccactaacagctctgttgacatttttatgatatataatcatattttaccatcttaaaaccaagccatagtaaacattaattaggtaccttaattgaatatgccttatgttcatttatggctctgctgctcaaacttttccacaaagtatatagaggaacaaatcccacggggcctggcaccatagtccaaaacattcttcttcaagtgtgtagtgttcctattcgtatcttgaataaagtttgtg

SEQ ID NO: 125935 - DNA, 1615 bp, Homo sapiens
aaagagtatgaaaaatcgttgggaagtttatggatgattttaaccttcttttttttacttttttacatttctttctcccatcttttgtagtaggtattacaaaaaagccagcctttaaaaaattaatggattcagaatgataacaacatgaaatctaatagcttaatggttctccagcaggatctgtacctttttcactgaaaatgcaaagaggatctaattagaatgccgcaaaaattagaattttaatccctaatttttgctgaaacgtccccttgaacctcaaatcatgtgcttttttttttttttaaggtctttggttggcttttgaggataaagatgagaagcttattgaaagaaacctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctgtgaatagtcatcatttctgtccttcattggggaatacttttagaggccagtttccaaaaattctgcttaaaaaagaattctggttttgtcttactcttccagatgagatatcacagaggcttgggcctagattgtcatcagcatactgctatactattcgtttgttcttattaagccttattgtgtgtaatgctgttactttttcagagtgttgcggagataggaacatgggagagaaacaatctgggtaacatgaaagtgatgctggttgctaagggaaggcaacttgattctgtgggaagggctgtagctgatccatccgttgtctaggtaagtctgcttctgttgcaaggatctcacatgatttgcaaatttgtcaaaactagatcatgatttccatttacctttattttgggaatggcataattactattgtaaaatgaatgatgtccttttcaaatagtaatttgcatagtaaaattttaatgaattattggatctttaccatgtaaatgttaatatatttaagtttttgtgccaaaggaaaatacattcacttcagtggtaaatatatgaatggactaatatcttgtgtataggagccagagagagccaggcgtgttggcacgtgcctgtacccagctattcgggtggctaagacaggagtatcacttgagctcagaagttcaaggctctaggacccttaagactgtgcctgtgaatagcctctgcactccagcctgggcaacaatgaagacgccttctctaaaaaaaaaaaaaaaaaaaaaaaagcttaataaacattgagtaattatatcagggtttgtgtcctctgtattatttagtt

SEQ ID NO: 125936 - DNA, 1899 bp, Homo sapiens
gcaagaattatttagtgttcctgtttttcagataatagagcttaaatacctgtaaaaaatgttttgaaaaaataattcttaagataaaagttttgatgaatcttctgcttaaagaaaaagaagttaagtacctacaaagctgtccataaaaacacagtaaaaaagtggggaaagttttgctgataagacggattctcttttgttggatgttgcaaaaacgttttttaaagtattacaaatgttgtaggtttttaaaatttatcagagcaaacagattctttgagatatctaattctaaataatgggtataaatttgtgaaaggcagtttttgaaatctgaactctcattgcagttttacatgaagaacactgtaggcagatacccaaataaatgtgtgtggtatttcaggggattataagggaatacttcatatttgggaataatttttgaaatcctgatctggaatctgttcttgtacagatttgagtatgagcacagtggaagaggattctgacacagtaacagtagaaactgtgaactctgtgactttgactcaggacacagaagggaatctcattcttcactgccctcagaatggtaggagaacttgctgacatataattctgactctctgaatttatgaattccatgtcacttttgacccctattgcccaaataggggtctaggtgcctatgagtttaggctgcacagtagaaaaggagattatctctttaacataaatgttagtttttgtcaatcttgttgctatgttataaataggatctgttgagcccccaaaggtaatgatggaataactataatatatacttctttttttatactaattggtaccagcagcatagttaatacattagaaaatgtagaattattcctcaatgcaagtagacttttttgttagaaactgtgttaaaaaattgtacacaatcatttcagtatgacttaatatggtgatctacaatgaattaagattcaatagctttccagctgataattttgttgttactccccgacttgctcattatttatgtcatttatttattgtgctctgaagttcatctttactcaacctaggttatgtcttctcttctcactctgtatataattcataggttatttaattcaaagttaggattttaagtagcacctacctataaagatgactcagaatctgtctttatacagaattctctgtgcttctcataggcatcttaagtttcatatgtcccaaacaatccttacatgtacttcctaaacctagttctcttttttcctttctctgtgaatttcattacttagtgtccagatcatgaatgtggttgggaataaattacttctctcatcacctgcatcatttcatttgaagacttcttgatagtattatgttttttaaatccattgcatcctctctgtttcaagcctgcctttgttagttcagtttctcatttctcatctaggtagctctaatacccttttaaccagtgtcctacctatcattcgtctttcaagcagctgatgaaattgttcctgatacatttaatagcataaagcttcccaaggtttttagaatatagtacaggttctttaatttggcccataggccccagtcatttctgctttcctcatagtcttacctcctgccgcatttcatatacctgtgttccagcagatcacactatctttattttcctaacatacctataccttaagcttctcatacgtctgtgtcattgcacatattgcttctactgccaagagagatagcagttttccccgggcttcccttctctttcaagtttaagacaccgccttgaggagttgaatactgcattgcagtaggcatagaaaggcagtgtccttttgaatcctgtttgcacaa

SEQ ID NO: 125937 - DNA, 1076 bp, Homo sapiens
gtctgtatgtccttgctttgttcataaagataataaaattgtttgtcacatgcatttccccctaccccaagaaccatatttgccctcattgagaagaaagcatgctttacaataggtactaatattgttattcctattttataagtcaggaaactgagacacagaaaattataataacttggctaagagcatatctaggcattctggttcctgtaatacatactcttaaccccaatgccatattgcctcttcagtatgctgtatgacagcatgaaagttagaagcctaattagtttattcttaccgagaaagttcttaatgtgtttctatttcaagatcatttagagtagactggcttctataggaggtacaatatttcaagtgcaatactgttggcacaagacagcataccaactgcaacattaggttgtatttctgatttgcttagcaaagagtgtggagtgttcaggaagattctggagtagatgcttttgtccatggcaatggggatgcaacacatggctgttggcactcttagcacaaaggagggttttgccatagctgagaactttgattttacactcagcatcaggcaaaatcacatcttcatcttttgaaaaagcaagacttggttttcagcatggaaaatcatatctatcatatcttaacaagtagatatgtactctgaatttagagttaattgcttgctaaattgaacagaaaaacttttagtttactgtaagacttaattgaaaaacagtgttaatattgcttccagttgtggcatagacaagcataacatttctaattaaatattcgttcctcctgatgattcctatgtttttttaaaatctttcctaatttgactatcattatgttgtgattcaattctaaaacttaattggcctatctatacagatgtaatcctaaatattttctaagctagaatttttgagtggctattttgatataaattgacttcaaccaattcattttgttaaagtgcaatgtcttgttcatgattgtaggttcaaactacacttggtattagttttattttatggtggtaaaccaaa

SEQ ID NO: 125938 - DNA, 1025 bp, Homo sapiens
ttcttttttaccctgttttacttttatggttaatcattataatcactgtcttgcattcaccaagtccttttttttctctcacttatttggtgaactcataactgtctaaatctgtctttgtctgtttatttctgtaccagtgcagctaattgaaaagtattagagaaaaatggcacaagcaggctgactattctcactctaattcctgatcattaacctgaagtgggctcataatgctgcccaccagtaacaacagctctctagtgttctttttcccactctgagatgactgtttcatttgtcccgaaacttgcaaataccttttccacctttttactctgagctgataaccctattccctcttcacaaagaaaatggaagtaaccagaaaataatttctacaaattcccactaccacaaatacatacctacctgcatctatgtccatccatatatttgttgtcctatcttaggcctacccttccatttacttaatttcttcccctttacctactcaaggacattgttccaataattattttgtttcttctgtatcaccagtttttcttctactgagtcattcccacagtatcacaaacatactgttatttttccttaaaataaaaagtccctggtcaggcatggtggctcatgcctataatcccagcactttgcggggcagaggcgggcagtttgcttgagcccaggggtttgagaccagcctgggcaacaaggcaaaactctgtctttacaacgaatacaaaaattagctgggtgtggtggtgcacgcctgtaatctcagctgctagggaggctgaggtgggagaattgcttgagcctgggaggttgaggctgcagtaagctgtgagtgtgccacagcactctggcctggcaacagaacaagatcctgtcaaaaaaataaataaaaagttcctttagctcacttttggttcttactcaattttcctccttgcctttagagcagaataccttgaaaattgcctatatttgccttcatttccttt

SEQ ID NO: 125939 - DNA, 1143 bp, Homo sapiens
tccagtagttttgattttttttaaaaaaatttaacgttatccttggctcttcagtctcttccatctcttctttgtctacaaatcatagtggctctgccatccaaaatacattcacaatttgaactaccagccactctcacttgccttcaccctagtccaagccactgacctatcttttttgcatttgcccttcagactgtttttcttatagcagccagagtgagcctcttaaaataaaagattatattattccactattcaaaatcttccagtcgtttcccacctaagagttaaaaccaaaaccttctggcttacaagggcttacacaatctcctactgttcttgtttagtctgctttagctacactggcctccttgctattctcgtgaacactccaagcatgccctgtctcagagcctttgcacttggctctccttgaaatgctcttccttgagatacctgtaaaactagcttccatcctcacttgttccaagtcttggtcacttttcctagcctcctatataaaatttcaaatactatcctccaccccaacacattccctttcctgttaggttttttctcactactaatcaccatccaacgtagtatcttgtccattttgtgtctttccccactagaatacaggctccatgaagaaaggatttttgtttcccttgctcactgctatatccccagcacccacagcaatatctactatgaattaggtgcacattaagtattattaagcaaatgaatgtatgtatgtgaagatgtattaacaaggagtgtgttaggaaattagatgatcatgttttttttcccatggatatttttagaataattagaacttgccgttattattctggagatgaacggttccttttcttgaagtttcagaaaatgatcagagctttgaagtgaccatgactgcaaccacagaagtagcagatgatgaggttactgaggggactgtgacacagatacaggtatagtaaatcttttaactggcctcaggaggatgatcctttacacattgcttagctaataaaatgatgagaaacctcagcctcccaagtagcgaggactactggcacatgccactgtgcccaggtttagcccttattatgaaacaaattacaaagt

SEQ ID NO: 125940 - DNA, 2058 bp, Homo sapiens
tatgttgatttaaatacttaatggactcttggcccattttatataaaactgaagccaatagtacatttacttgcttaaatgaaggtcatattgtgttaatgcatataattttgttttcatactgccataataaaaacagcaagaaatatttttttgtaaattggatatatttttactatatctaaaacaagtgaattccatatgactatatttaagttttataatgcttagcattacaaagatgaatccggttgagcattaaatcaagctgccatttttttgttttgttttgttttgttttgttttacttttaccttttcaagattttgcagaatgagcaactagatgaaatatctcccttgggtaacgaggaagtttcagcagttagccaagcatggtttacaactaaagaagataaggattctctgactaataaaggtaagataacactgtgaattttagtgcctagtgaaaaaaaatggagatagaaagggcttatagtcatcaggattctgagttggaccttcatcactgggattgagcagttagagtaattgagcttttctaactgaattaaatttggccccaaatgactttgaattaaggttatgaaaccaccatttgtttttcagtaattaattatttctcccctgatttgaagtaaattttgtcttgttaatttttgaacaaatgcatagtggtggcatttaagacaatatagttattgcttatgagagtaggaagtcaagccttttcaagggtctactaactttggtctgataagcagcttagaggctcaaggtaacatagtgtttacagtgttggctatgctcaagcatagctggggaaggtgctacaaaaaagtgagggttgtgtctgtgccactctgaagtacagaaaggaagcagaaaaacgtaaataattttcaaccactgtatagtaaatactcattaagaatacattattcacttgatattcaatatttaccttgccctagagttttttgtatgtgttctttttgcccataaaattttcactggagaaatttttcaaaaagttttgagcatgtttggctttttttatttttataagtttctttttagctgttctatattgttgaaaggctaagagaggtaattttttttaaatcttttaattaccattgtctttttttagtagggtcaaataaatgtattctagcgtaaaaaccagaagttacaaaagcaagtttacctagagacctttcagatttcagaggaatgagaaatgaaattagctaaattttatccccaaatataatttaatcacaaaggaaatctttggtgttttatttctttcaaggagtaacattttttataacattacttgttttcttttaaaggacataaatggaagcaggggatgtggtccaaggaagaaattgatattttgatgaacaatattgaacgctatcttaaggtatcttatggcatatttttatgtttcaccaatttgtttattgccaattgcaaaaatatcaacacagaatgttgtgtgcacttattaggagctttttacttatttttgtaatggattttcataatggctaacatgtagctgaataattctaaaatacattattatagtacaataatattttgaattctcagtttaaaatagctttactgctttagttaccaccctaaagtttagataaaatcttagtagcctctcaacattttaaagccttatcttttcaagaagcctatagagtttaatttattttgtttaaagcttaaggtatgcatctttgttttgttttgttttgtttttgttttttttttttttgagacagtcttgctctgttgcccaggctggagtacagtggcacagtctcagctcactgcaacctccgtctcttgggctccagctatattctcctgcctcagcctcctgagtagctgggattacaggcatgcaccaccacgcccggctaatttttatatttttagtagagacggggtttcaccatgttggccaggctggccacaaactgctgacctcaggtgatccacccat

SEQ ID NO: 125941 - DNA, 3420 bp, Homo sapiens
tgaaattaacacaaacttgtattcctgggataaactcacttttctacgtggacatactaatgtttttatacattgctgggttcagtgtgctaaaatattattaggatagctatgttagtgaatgcgtttgacctgaaaattctgttctgaaactgtccttctctggtttcactattaaggttatgctagcctgataaaataagcaaagaaatgtacccacttttttttttttttaaacttttgatagtttaagaacaggattgtgtgtctatttggtaggatttacctataatgtcatctatgtcatgtgggcctagtgtttttattttgagaagattatttaataactgattcgattttcttgatggtctgtgcctatttgattttctgtctcttccagagtcagttttggtaagttgatgtttgatgtcttctaggaattgattcattttaccaacatttaaatttattaccataaaattgttcatttctgttaatggtctaatctctgcagcgtctctatttaggcctcatttttccatttctaatactgtttgtgtctttttttaaaattttggcagaactttaatcatttcaagttttattaatcttaatggatgttttcaaagaaccaatttctagattagtttatcctttctgtgctttgattctggattccattgattttgctcttgtgattttcttccttctgctttctttagatctatttttaactttttataattttaaaagagttgatggaaattcaatttattgaatttgatagtttattcttggaacatttaagtgtcacttttgtatctcttgcatcatcttaaaagtttatatttgatttattaatgaattagtgatatattatttttctaaatgccgttgatgacctttaacattaaaacaaattttaaaagcatagtatatccatatgcattttatcagaaatccctaaatcaaagaaatgtaacccatttaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaagtatgagaacttgtaatgctgcatgttttcatgtaattaggggaaatatttgaggaactgtccatttttttaaacaatagaaatatggtcaaggtattaattgttgttaatatttttatcctccaggtccatgttgtgaatatggtgaaaccttattattaaagcctcttttagaaattaggatctaattcactttatataggttagatttaagacttggcttacttaatatgtcaaagtctgctttgtagtaaagtaacataaaaaatacagtaatgattaaagatttaagaagtgtgaaaataacttgaaatttattggtaacatttttcctatttatttttagaatatagcattcctaggtcagtggcctttttttaaatccagaatggaaaagaactacatttctgaaaacaatgtatggatttctgttttagatagcatttatgggaaggcatcattaagattcttcaaatgcaatgattatatactgttactgacatatttttaatttctctttggaaattttaggtggcagtagtatggcttattagatactgccgagctaatgttggagctctttctctagctcttcagcagcctgctaatgaaagtacatttgaaagctgaagaggattaaattatgtttttgtgacagtggaaaaagagaaaaaattttaaatggagcataaatgacttgttagcaattcataaactttccatgcattacaaatggttacaaagtgagcagcgtttcataattattaaatggacatttttaaaaagaacattacataggctgtattgagtacttgcctactgtaataaagagcaagagtatgtcagatgtccatacctgggtaaaggaaatgaagataatcttaatttgttcagtgctttgagggaattttctgtagattttctttttagctctagtttacaatgtcacccataagtttttttggagtagttatgatttgagagtgccaaaatctaagtttgaaataaaggaactgttagacagcataggagcaaatgtatgttttaaatgttgattctttttctagagaaaattatacaatccttacctttattataactaaaaaatatttactgtttaaaaaaaaataaaaatagaagcatttattttcaactttttttttttttttttttttgagacagagtctgtgttgcgcaggctggagtacagtggcatgatcttggctcactgcaacctctgcctcgtgagttcaagctattctcctgcctcagccactctagtagctgggattacaggcgcctgccaccagctaatttttctgtttttggtagagatggggttttgccatgttggccaggctggtctcgaactccttgcctcaagtgatccgcctgccttggcctcccaaagtgctgggattataggcgtgagccgcaccctgcctattctcaacttttattaatccactttaaaatgggttactttaaaagtattatatgctaagtgacttaacattcagctccctaaatgaaattctgatttttattgaggtttttagcattcattgttttaattgattttttaaaaatttctctgaatttctagatatacacctgaagaaattgagaagctcaaggagtaagttttaaagtttttttcattaattctaattttttatgtcttacgtccttaaaagttttactttgaaaatttcaagaggtttttggcagactggtataattgaattgtgctattaagcatgattggccttaaaaagatcacatcaaatccattacttgcacaaaataaccattctcataatgtataatctggtctcctgatgccattcaccagatgcttcctcagaccactaataggggttccagaaaagattaaggggccatttttggtagcctgaagactaaatttggggaatttatataccaggatgaaaaccagggttgtgctacatggcttggtttagaatggtgacttggcaaatgtttcagtgaatatctgggctgactcaaccttgcaaaggctattgaatctcaggaagtagaattttgctttattgagttagaccttaaagtatggtttaatgaattgtatggatcatgaaaaaatttgaaggtagattctgtttataatgataaagacctgtgaaactttagatgtctaaagaagagtttgttgggtatatgctcaaaagggaaagtctggggcttgcctgggagattgtgtcagtaacctgaggggaaattggtctt

SEQ ID NO: 125942 - DNA, 1026 bp, Homo sapiens
ttccttgagcttattagatatatcaaactaatcttttactttgtttttgtataaggtaacattgtcttcagggacacaacatcaccttagtgtcaagatgattcagatctaacatgtttcagttttgtaacaatttcaatacttccccagttgagaaagtattttgaagacatacatgcagcaagtaattttaatttaggcccatctaactgttgaatttacattagcaacagctaatcagtgagtgtttatgaaaaactttagtcacaggtaagtcccaaattaggaagaagctgtgttccaaagatttgtaaatattttgcttattttaaactcaaagtatatttttccatagaaaaaatttatgattggtgtttcagtcccctggcaagaccacaaatgcctcttaatgcatgcagatgtcctgatcatactgttaaacctaatctttgcgaccaacaacgtatttaggctctgctattaactgtcatttaacctttctgagcctcacttccttctgtaaagtaaagagattagagtaggtggtctcatagtgcccttttagccataatgttctctgaaggatccacaatccatgcccactgttgcaattaaaaaaaaaatttctgaagtttagctttagcttccagggcatatacattttgaccttaaccccctgctctaaaaatgaaatcagaattctttcctgcttaactactgcactatcactgttacctgcagggcagtgagaacataacttctaccaactttgtcattctgtgacatggccagcttaatgaaagaagcagggctgtaagctttagatttaggataggatctcagagtttcatgtaagatgctgtgagtacagaaccccttttggtaacaaaatttggaaggacacagtggcatttcctgattgccaacctgagggattgattgatctgcctgcttccttctcatgttgtgacatacagctgctgatgaggccatgccatgaaacagcacagtctcaaagtagtccca

SEQ ID NO: 125943 - DNA, 1020 bp, Homo sapiens
atatgaaatacttaagatcttaaacagtagtgctctatggaaaggatacttttcagacactaggcatccaggaaaaccaaaagaggaaagtctatcaagacatccacagaaattaagttgcttttgtcattacaagattcaggacacaaacctgaggatgagattgatttcatcttccttggtccattcagtacccccactctgtttccaattcaggtagttgagccatttagaacgacattgcttttctgagcgggtaccgactcgttcagccacagctgcccaagacacaccctgtgtgactatgtcacctggctcagtgcttgtcaactcatgaaccacttctgcaagtctcttttcttcttcttctgtccacttccctgaaaaaaggaaatcatccagactaccactgctaacttcttttacaaatctgattcagccctctatttacaaggactgataggaagtaagcaatagtactaagagtttgtttctgaatgaccctctggtggaaaaccatatatacccactaagacagtttcattttactagcccagtaagggtctcagtagaaaagaaaataaagaatcctaatggaaagcactgaccaattatgaaaagaaaaaccacccaaaacataactacaaagaagaatgtattctcaagttacactaagtcctttataaacagtgaagtgggaagagcttcgtcaatggctgacagacaagaaatggcatgctttttttcttactgtcacctaagattccctgctctgcaaaagtaagttcaagaggccattacttataggaatgaatgatgagggacaagggaaattacaccaatgggctcaacctattttagtaaaaactaggtttctaccatcttgtttcctcactatcccaactccaagctactgtgatgaaatattagtaaagtctgatacaagtatttacttttattcctgtgttttctcaacccataaacccactaatagataaccccaaatgttcctctctgtct

SEQ ID NO: 125944 - DNA, 2464 bp, Homo sapiens
ggatagtgaggaaacaagatggtagaaacctagtttttactaaaataggttgagcccattggtgtaatttcccttgtccctcatcattcattcctataagtaatggcctcttgaacttacttttgcagagcagggaatcttaggtgacagtaagaaaaaaagcatgccatttcttgtctgtcagccattgacgaagctcttcccacttcactgtttataaaggacttagtgtaacttgagaatacattcttctttgtagttatgttttgggtggtttttcttttcataattggtcagtgctttccattaggattctttattttcttttctactgagacccttactgggctagtaaaatgaaactgtcttagtgggtatatatggttttccaccagagggtcattcagaaacaaactcttagtactattgcttacttcctatcagtccttgtaaatagagggctgaatcagatttgtaaaagaagttagcagtggtagtctggatgatttccttttttcagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggtttgtgtcctgaatcttgtaatgacaaaagcaacttaatttctgtggatgtcttgatagactttcctcttttggttttcctggatgcctagtgtctgaaaagtatcctttccatagagcactactgtttaagatcttaagtatttcatattgagctctttttttgtgttgtgtttgttcctttttttttttagtgggtttagtgctcatgcaaagtaccagattgaaggcgtggagactgaagtcctctctatatccacagaacaggtatggcacaggcagcggcagtgtagcttttccactgtcccaccaatgtgcctcagtcctagcctagggggaacacgtttaggataagagggctgttcagtctccatgcccttcaatccttggctactgtgctaagattgccaagaagggggcccagtctgtagttacctccacacctccaaagtagaccaaatcaaacacatccatttcatacaaattcaaaaaagctttaagatatcataatcccagcttatttttttaagtagctggtttaaccattaagatttattaactaaaatgggcaaaaatactagcaagaaattatttaagaccctgaagtaatagagactgtcaccatggctactccctaccgaaaatcaaattgtcacaacaaagctagaaaacgaacagatttttttaaacctcaaattttgttgtactgttgtgttgttttttgattgcagctattgcttttgtgttattttgttttggatttttttttcaactagtcatctttataaatagctcatttctaaatatttttgcttaacaatggaaacgctcagatccaggaagtaaatgacttagtaaatgccacactatgaaacattgcatatatacaactaaatctgttcttattctaacctttagcatactccttttccttcacagtgcctcatctggctctaaccatttatagtttagcccattggttgtacctttaattaaaagtggttgctgttggtatttcttagctgttagctctgaaagcagatctgcactcctggaatcctttcccgtgtaacttaacaatagcatctcattggcataacctgccattccctttatttgccagtgcaattacctgtagtcagaggaggggttcttatagagaaattaatttaatgtctaacgatgcttattttgtaactgtaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctggtaatgtattacttactttttaagctcctccccttttcttaccatatttactccttaggagtgagaggttagaagttctttgccccagctagagatatcatagcagatttctacttacaccacttccctgtttctctcagtaattgtttccttccccagagaagagttaatactgtttgtaattcctaaagcccctaaaatgaaaatgtacacacttattcttgttcttctacgtaaactatcaggaggaaataaaatcatgccacataacgatttaatttttatgtttttagagacagggtctagcttggttgtccaggccgacatgcagtggtgtgatcatagctcactgtaacctta

SEQ ID NO: 125945 - DNA, 1046 bp, Homo sapiens
tttgatcttcaagattccttgctgtttgatctatatgatttggttaatggctctgatgtcttttggttttctagaatgttaatagaaatttacccaagtcggtgaactgaaggacatctaagatattttgtttagttcagttaatatttgcacacacaatgaatgtgtgacaggaaggatgtataagcagttgcccaaccattataaaccatttgaaaccatcttaatttctagattttgtaattaatgacttaatagaaattattaaaaatagaaattagaatgaatgatagaaaactacctaaaaagcagtcaatcaagcaaagaaatagaattcaccaactggtatgtcgtgtagtaatttcactagaagacatatcaattggggattgatttgaggtcgtttggtaaagaaatgagttttggcaaggttaagaatgattttcttcagggagtaaagggccagtttcctattgggaactgtgtttggacagttttatgcttaatgagattatgggaacccagccattgttagagtgagaacttttttcttctttaggtataagtcaaattgatctttatcccttcccgtcagtcttgaattatagtgacaaaaaaaggaatgaggatgaaattctcagaaccatattcttccttgtttttggtctacatatgctacctgcatttgaaaagataacccaagagtattccaatcactatgttagtctcaaccaggtgattattggcattttgagcgacaggtttttgcagactgtcctttacattgcaggatattcagtgtcctttgatcttgcccacagaatattagtagtacatgccagtcattatgagaaacagaaacaccctgcatgtttccaaatataccattatgattccctggttgagaatcgcagaaccacatattggtgtttaacaccatatatccatgtacattgactgtcagagttaccttagagacatttaaactaaccatacctcttattcttaaaatcctaatctgaatttggttatctttctaccagtgt

SEQ ID NO: 125946 - DNA, 1035 bp, Homo sapiens
tgtgatcttatggatccatcaaacagtaagatgaatattacaaatcaagtgcatttctattggtaagggcattagattccttttaaatagctgagaagtgttgtagtcagaatttaataaactataataaacattacacagtaaaagttccaaatcatatttcacataatttacctataggtatgactgcaagcgccaaaaaagatgacatttctagcatgttctatttaaccttgagcagacgttgataaagtctgatcctcagttgacacacatgtaaagacattatactgtctgatctttattcagtccccaaatgtggtcttcggaaataatgctctcttaacatttatttgtgtttacaagcacttttgatcctcacagctgtatgaggtaggcaggacaggtaaaaaaaaaaatacctgaacattagtttataaagtaagttatttacccaggttttatactgctaggaagtgattaaagcctagtatttttggactaccagtccagacatccatagtgcttacccatatatacaagaaaactagtttttaccaagttcctgtctttttgcaggttggtcttagtgtgttcctctttacttcctaccgttagaaacatttaatcatgtataccaagggttagcaaaccttttctataaaggaacagatatagtaaatattttaggctttatgggccttctggtgtctgtcacaggtactcaactctgttgtagtgctaaagtaaccacagaaaatatataaaccagtaggtgtggctgtgttccaataaactttatttacaaaaactggcaatgggctggatttgtgggccatagttagcccacccctgcactatatgtcatgcaagacaaattcattagattccttatctctcttaagaaatgtaaatgacttcaggtctccaggcaaattattcaatattaaattgcctttatgataattgagtacactagagaaacttaaattaacaaaacatttattgtaaattattcttaccacagcttacctt

SEQ ID NO: 125947 - DNA, 1071 bp, Homo sapiens
taaaccacagcagttaagctttcgtgattctaaacttttcttagtggctgaagtgaatgaaattccttattcccatgtaacactaaacagggatttatgcttaaaactcccagcctccactcaactacatactgtcataaaactcaacctcagatgatgtgtttaaaggaggtaaaaagtcatagcagcaacaatgtgtgtggcttaaggactgtggctatttaaattggtaaattaagcctcttgggggttgctcctatttctttgaagaggttgtaattaacagtgtgccttctttgcttgaactgcctatttctaagaattattctaatgacagtttaccaaatcttcgacatcctttgaatcttctgaaacaggactgcccaaggatgatccaatgatatttgattcttcctgatgatgttggagtatgggatctgtaatgagtttcaagttagtcttaaatgtatatatttattctctaatccatgtcaagaatttaaggtattctaccacagtgtagaactcaacaggactagtagcttattggatcaagaaagactgaaacaagttaattaaatgtctgtttttttccatctaaaatttatcaggcacatagtaagtattatattacagtacctgttagtgttgtcaaaggcaagacagattcagtatctataacatcagatgcctggataaagccatgtggtgaaggaacgataagtattgtttcatcatcaattgtttgatcaacttgttcttctatagtgggagactctaaaccctaaataacattaaaaaaaaaatattgactcatattcttactagtcttccttaaaatcccatgtataggtatgtataggttagacttaaacataacccatttaaaaatcagaatataaaataaaaagttaaggtctcacagggacaaaagatgacctcacaatctaacatacttttaacaaaaggaactcataaggactaggtcagttataggtcagctgaatataacagaagaaacaatgctgttacagtgtaggatgatgttcctaggctgaaccacaaagatta

SEQ ID NO: 125948 - DNA, 2610 bp, Homo sapiens
tccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaagatgcaagatttgtttttacatagccttttgccatacaattataaaaatttcatttcaaaagtgaaatttttttgtgctgttttagctttaagggttggaatgtttaggtgcaacatcagctccttaaagaaaaagcaaagtgatctaggatatgtctcccttgcaagagggaattaacatttacaattaacatgaaaatcatgtatcagacttctgcaggagattcttcagcataccttatccaaaaattactcactgtcctaatgtatcattttgaagagtcctggtaagtacttctccttggcagcctcaccttcccacatcatggaagtacaggtttgcacatatacacaacatgatgatagaaaatatgatatagtaaattagctttctaaatttcggttctaagtctccttgtcgataccagtagatctaaaagaagaattaaagtttataaattaaaatttgaaatataacattttctctaccaatttcaaatttcattagtatttgtttattcccctaaatgagacagacattctccatattctgaggtctctacattcctgagatcagtacagccagaatttaattcttactctgagtttccacatccaagatcatacttattcctactttctcagtttactttcctctatattcacacctgtatactccaccagtcatctggcaagctatccaagaacatatacctgggcatactacttaacaggaaaggaagacaacatttagactcatgattcatacagttggttcagaccgtaaaatagggcttccataatatatttggattaaactagttcattgtctgttagtcactttaggcttcaagctaggggaacaggaaagctcccaaagtgggatgggctagttcttcttcgggtcatgggagtatatagcaggatcagtgaatgagaacacttggaggtgtctcctggtttaattaattttaactcagataagcaaattactattgttttttcttttgattctgcctctaaaggaacatgaaacaatgtagccaactaatgaatgaacactgaggagccaccaccatctttgtttcttcaccataaaagaaacatttgcagtaaatcaaacatttttacaacaactgcagctttagatttcccaggaggttttggtgttaatacctccattttgggaaacaaacatgtagattaaactaattttgtaataattagaattaaatccagagtgctctatctcttcccttagcagtaactggcatttcccaaagactgttggcccttacgtagtccttgagtgaagatgaattaagtaaattaaaatctttggccacctacgtctttccacta

SEQ ID NO: 125949 - DNA, 1041 bp, Homo sapiens
agagttagccagtgagacagaatgtctccttgctttccacctgtgtggctgctatacctccggttgtctctagtgacagtgcaaggggaagctcctgtacagtcagagccatgctgctctgagggacccatattaaatccctggacacagggcctgaggtttctttattcagctgggctcaaaataaaccttctcccacattttgcatcctctcgttatgctttttcctggccccttaggcttctgactgggccacttacacagctttcatggtgagaagttgtgatttggaagaagagaagcaaagtcatttctgagaatcaaacttttatttatggtattgggacccttaagtttgcttgagaaatgcagaactttggaggcaaaattgtaggatgtggctcaagggtctgaatcactcagtccaggtaaacaatggtaggaagtagcaccctttgggcatttaatacctgctcaatgtgttgccttgctctttccccatcccaggagaagacaatcactgtcttcagtggcctgaggaactcgtgggtagggagggtaagggatgagtataaaatgggattgagccttttataaaaggaagaacaaagtgcctggaggtattgttcctagaccaaactgagggtcaggctgctatttctggtggcccaataatgagatgcagttgaggagctgaatgttaataggtaagacaatggggaaaatgtccccagggaatttcagagagcttcacagcagcccccacactacaggccctgaggcctgtcaaggaaaaatggttttgtggatcaggtcctggactccagtgccctgtgtcacagctgctccagctccagctgtggctaaaaggggccaagatatagcttgagctgttgcttaagagggtccaagccccaaaccttggtggcttccacgtgctgttgggtctgtgggtgcacagaaggcaagagtttgggagcctccgcctagatttcagaggatgtatggaaatgcttggatgtccagaagtctgctgcaagg

SEQ ID NO: 125950 - DNA, 1391 bp, Homo sapiens
tagttttaaagcagctgaaatgttatggtgattccataaccaagtttgtgaaacatttttctttgttgtgggactttggaagctttaatatgccaattttcattgtgactatagttggtgagggtggatgagtagcactttataaactgtttaggtggtgtggcctttttagccctagcacaacgccttactcaattcttaactccagctccctagagcattcactagatacgtttctgcagaatatactttgggaaacatggttcaatgaatcgccttcctctgcttttccctcccatcctgccccctagggtaaactaaaacctgaaaatgtcctcccctcttctgcccacaactacctttaaaagttttctttagtacaagctttagtacacagtttggacagtctttcccactgtcttgtgttagaagagcactaaattattctcagggcttgcgagtcagtcttgatctcaacttattagctggctgtggtatcatctgaagtcagtttcagtccatctagactggtgaaactaggaggagagggagagaatggttttctcgagaaagcaaagcagcatcccatagctagggcaaatgggaaaagaaggaacactctccacttggtgccatgtagtgcaaacgagtttctaaatcagcccactctgtgggtggtcactgatcacaaaataagtgactcatcctctaagaagggtggtgacagttcttgctcctttattccttcttggatgtgatatataaagtcaatgatttggggagaaggtacatacactgaattcctcagtagataccatagtgagagggaggccctctgtggagggggcaagtgtagtgggctctgaggctcagatctttggttccaaagacaaaagtatcttcctttatccccatccccccaataaaaaaaaaaagaagaaaacaaagacggtgaaaagcaagggctttttatgattagtgttagtcaagcaattcaaacttggagcatttggcctctgcaaataatcatgtaagattagagttgctacttcatgccatttttgttgtcgcttatttaagaacaaggatcagtagggatggtaataaaataatttttaaaaatgcaaagaagagaaaaagaataaagctatgattaagatagctgggtctgtgccagcagccccttcctctgtcttagagctaccaatgctattctctgaggagtgcaggctttagtttatttcctctagatagagcttctaggtgatcaagcacagctatttctctcaaaggagggttagtcacccaaaggtgaaacagttctctcctctcctctcattcagcctgccaaaacaactttgcctttttttgtgtgtgctagaaaagtaatt

SEQ ID NO: 125951 - DNA, 1237 bp, Homo sapiens
agcagccaagcaaggaaaggggagaggcttgaggtgagggattcttgaatgatggcctccattccaggaagtgatcaaggggtccctgaacctgaacaggctaccatacgttattctaggctttaaaatgtttaacaccttttaaaaaggattaattatgtgatgtcttgggccaacaattgaggagagatctttttctatcgtcagcattaactttctgagtagtttgggcaagatctgcctggtttattttttcatctaaaagtggcattggttggctggtcccagtgcagtggtgttgacaactaattgatcatagcccgttacagatttctttgctccttctccaatctccctgcttcacttgactggcctaaaagaaggaaaaaaaaaaaaaagtggcattggtggtctttgacctctgataaagtgctttcaactctccaaaggtaatgcacgtgtagagtccagagcttccgggatttcttagttttggcaggagccctccagcagataggatagggaagtggtacacctggcagtctggggaatagccctgaatttggaagctaagaggctgccacaggactactttattttttaaactccacgtggattttactttctcttctcaaaatgttttaatatgaaagcgttttaaactcgatctccaggaagatgcaccttgttcatcttgtggctttgtataatcccagcccacagtgctcctggtttgagacgcattcctcctccagtagatgttccatcttaggcaaactttattgaccattatgtacttggccctggggagccaaggaaccctgtcaggtggagaaaaaaaacgtagacaaatgtgatgtggttggatctgtgctacgacagggacatgttagggtacagacaagaactggttgcttttgtatgagaaatttgtccatctgtcccaagaactaagagagtgcctccccagcgtgcttcagcacatagattggggttctgggtgatccagacctttgacctcttttaactcatagctcttgtaattatagaggtagatgacttggtgtaatggacttgtccatttatgcaaacacttagaaatattgatgttttctgaacagcttgggccaaaacgtccaatgatttcagtttcctattgcccatgatccatttgaaacccattcaagaactttattattccaaatgtatcttttattgcgtacttacttactacaag

SEQ ID NO: 125952 - DNA, 1061 bp, Homo sapiens
atttggtgggggagtagtgtcatcaagcatctcgcctgctggggtctcaggggtaccctcaaggttgggccgcggggctgctccgttgtagtgcttagatttctctcacttgatggcctcttgagtgcagagttgctcttgggttggtgggaagagcctccgagctctcattgccctctgctcctgcttctaccccttgccactctgcgacgaacctgttacccagccactgaaaacgtatcctctaccctttgaacccgtctaatggaaggtgtacttgtctgaaacctacttaattgtatgatcatttactcctgctctctagcaggtggactatttgcgtgtgtttgcagtgattcacgaaaagtttgtcttgggaactcccaactcctagtttgtctgcattccaccttctttcactagcttgttcatttctttttccctcttaaatatttgttaagcttgtttctttcttcccacagtcaccgacttagtccagttccctgtgatctcaaaacaattgttgcagcaggctcctggcagtctcaagcagttcatcttcttggtgtactggtatgtgacaattccttcacgtattgttcgtggttcttttccactttctgtgaattcatatctaattgcccccagaaagtcaattctaattaaatctagcataatcattttcttagtgctattggaaccatcttatttaacttaatctttgtggttgagaattcaagaaaactcttcaagaaagaatccaataatttatatttttaatgtgtaccggttggtgggttaagcactatagtgggtatgtaactaatactcttgcttccagttttctagagtctattaagtggcacagaggtaaacagaatagcttatcttctctgtatgtgtgtactagtcttctattgctgccttaaccaattacacaaatgcaacaattaaaacaacacaaatgtattatctcatagcttctgtaaatgtgaagtttgggtgggcttagctgagtacttggcttagaatttcacaaaaccgaaaccaaggtttctgta

SEQ ID NO: 125953 - DNA, 1633 bp, Homo sapiens
ggctttgaagatggaagaaggggttcatgagcccaaggaatgtggatagcctctaaaagctggaaaaaggaaggaaaccaattttcttctagagcctctagaaggaacacagccctgatggcaccttcattttagcccagtaagacacatttcagatttctggtccttagacctgtaagataataaatttgtgttgttttaagctaccaagtcagtagtaatttgtttttgcaaccagtgaaaatatactgattcaaatatttgcccattctctacccccttgcaatatgttactgcaaattcatatacttttcttttctttttaaaatacagatgaactcctctgactcctaaggacaactcttctatatctgtgctgagtcccgcttcctcttgcttagtcaagaaacttgcttttgcattatcctctctctctgctgcttatcagtttttttctttacttgattgttccagtctgtaatatcttccatcttaaaaggaaaacaattcacctcatgtctccttcaagtatcaggccccagtcgaagccatcatcctatctctcttagattgttctcacctggacaactttagtcacctcctaacttggcataccttctcttcacccttgtaatctgttctccatgtaacagctggagggatctttttagtgagaccacattatcactcccttgcttaaaaccatccattggtttccttcccatcatactggaaaccactttctgaggccagtataatcgggtctcaaccttatctaccactctatccttttctctgtgccgcagctgcactgaccttgttttcctttaagcagatcaactcatgtttattctaatgcctttgtgcttgctgtttcctctgcctgaaacacttctgcgggtatttacatggcgtactttctcactccattcagttttctgctcaaatatccgccaggtttattgtgaggtagcacccttctgccaccctcaccctttccaaccatttattgattaatttggcatcaggtttattttcttttttcttttccagccctaaactttgaaaggggtgtggtcaggagatgacagcaataaaagagtggtggtcgtagaggtaaaaggatctggaggtttttgaaggggaagaaagaagaaatggtttggaggtagccatgaggaacaaggaaaacacatatctcatcccctaggtcttgaggaaataaggtataagagaaaaaagagtatttttatcaggagactgttcttcctcatagttgatgaaaagatttcataagataatgtatgtaaagcacttaatactgacccgtaaataatacccaccactatatttccttcaagcggcagtgtatgtcttctctttcttcctctttttccattttcttttcttagaaggtaggggcagggatcacataagaagatccttggcaaaaggacaagtacctaaagatggggttatatcagaatagtctgaggtttacagcaaacaaacagttcttggggagttaaggtgtgccaaagaaatcagagataatccattgtcagtggcttaccaggtgttaccagactggacaaaattcttttcctttgccactggcatactgtatcctttt

SEQ ID NO: 125954 - DNA, 1032 bp, Homo sapiens
tcaccctcagttttctgccgctagggcctctccatcgggcagccctcagcatggcagctggctttcttcagatgagaaataagagaacaagagagagctctctttgtaacctaattgcagatgtgatatcccatcacttgtgctgtactctccccattagatgcaagtcactgtctagcctgcgctcaaaagtgaggggttacagcagagcataaatagcaggaggcaggaatcacgggggccatcttagaggctgtaatgtatatgacctgacagcagccacgcctttgaaacagcccacattatcagagtattttttgctctttggtattggaaataggctcttttttgttgaaagtctccaacctatctgtgttaaagggcttagtctctgaacaaagctagctttattaggcaactatatctgtaatgatattagagcattttctttcttatgatacactcttttaattttttcttgtagccctggttgttgctatgaaacagctatgacaagacatttttatcatggccgtacagagactatgcgatcatgcacagttgaagcagtgaggtggtgccagtccatgcaggatccttctgtcaatgtgagtattggaaaggaaaaaaactcacaagatttgtttaattgttctaaaggaaccgtggtctttgagtaactaacttctttgcttcagttttcctggatcattaaaatactttgagacatcttttctgaggtttttaaagcatttgttcattcaccagtgaaatgtgtaattggaaacagggaaggcaggaaaaggatcccatttgtgttattttctaggcaaagggtcttcagtactttaggtatttcaggacttctaatctacctttagaacaacaccaacaaagtgcagaaatcccaaggtgcctttaaaaggaaggttttcttgatgtggttgaatgtttttgaaatgacagattcttgtttcatatagtggaaccaggacagttgtatgctttgtttcatactcttttttttgaagc

SEQ ID NO: 125955 - DNA, 1081 bp, Homo sapiens
cttaaaaatctctcatggtgaaaaatttttttctaacctgagatttggggtttcattgcaggatttgatcgtcaccttttaggtctcttactcatagcaaaagaggaaggtcttcctgttccagaactctttacggacccacttttttccaaaaggtaatatagtgtagtgttttacagcttcatcaattggcttcctctttttgtatattaaatggtttttagaaacaatataagcatctgtaggcctagtaaaatgttcttttattgtgccacacagcggaggaggtggaaattttgttctctcaacaagtctggttggctatttacgagtccagggagtggtagttcccatggtacacaatggttatggatttttctaccatatcagagatgacaggtgaggcttctcttttttattctttctgtgctatagagtaggaaaggtattacttttgtttttaaatgcctttcctacactgtgattcttatattgccatctgtcacttgctacataagtaactatttttttccacttaggcatttaatgcatattcatgtttctctgtcctgcttttgagacacttgtcagattagtcccttaggtgtctttatgcagaacactgtttcaagtcgattcggcaatcatatcatcatcctcaaaatcagtacacccatgaacatatttggtttgtacaaggtattttataataagctcagataaaatgtttaaatatatggtggttcatgtagtcatagacaatattaatgagatagagaaaagagattgggtaaattatactttttaaaacagttttaccaattcagatgcagttcacttgggctgtgtggagtttgacttatgtttatggaaagaatgagaaagaaaagatcaaaacctggtataaaaaagagtagtggagaacaagataaaatgaaagtgatagcaaggcttgtaaggtccttatctacagtctggcagtctctttacaggggcttttcaaagcatagttggcttcataaaaattacgtgactacatttagcactatgtgaataagaagagggcaggcttggaggcact

SEQ ID NO: 125956 - DNA, 1291 bp, Homo sapiens
tcaggcttctctcctatttatttcagcttcccagggccacttttctcacttgccagatctgggatttcttattaggagtatctcgagaaagatggtggaaggcatgacttgatcccaagagtttctctttttgactcctagaaatagcctttctcacctatcatccttctctgcctttttttttttttcaaactttcttcaagtactctttaaaaacagtttaaatttcattaaaaactgtagcatgaattcatattccaactcattccagtagcactttaggaaggacttttctaggaaggaggttttttgttctgttttaaacgcagtaagacctagcttcagagcactctagggctctagctaatttgttcccctttgtccctaggtgctagtcatctaatgaatgaggtgtttcttagcattatctacagatatggctttaccttcaattgtgtcaggttacatttacctaatgtcagcaagacttcacatttcatgtatgaatatccagatgaaataaagtcctggttgtattcaccatcactatttggagccttttgtgtaatcattaatcattatttatgcttcacaggtttgttgtggcctgttcagcctggaaatcctgtcccgagactgatgcggaaaagctagttcagctgactttttgtgcttttcatgatatgatacagctgatgaactctactcatctttagagatgaatcatctattaagcacttaccaaaacatatcattaaactgagtgctgggagtgagttggtaatatgagatgggaaggaatgttgacttgctaacattcctttaacaagttaagaaaacttgttaaatgtagaaattagtagaatcatgctctctaaatttattctgccatagaaggtagaaatatttttaagctcctctgatgcagcagcaatgcaaattatgacatagtgaatatagaactatgcagtatttaagcctcaacaatccaaatctacaaactttaacaatgcaagtcttactctaatttttaagtatttttgttggtacttacatgggttataaatcctctctctggacatcaatgtagagtccatctttcaagcactttaatttttttagctgccaaagggtatgaattacattattgtatgctaatttccctgaaatcaatgccttctatgttcaccacagggatacaagcctgttatgtttgatgggaaagaccactacaatctaatggtgatctaaaataacttttttgggctgggtgcagtggctcatgcctata

SEQ ID NO: 125957 - DNA, 1059 bp, Homo sapiens
tctaaatgcagccctcaaccaccagtctgtaacctgaagtatggtggttttgagcttctcactacatttgtatgaggtaggcataatgtattcccatttacaaataaggaagcttggtatcctgaagtgccttgtccaagttgttaatgttagtaaatcaacatattttgttacaagattttgttggcataactttggtaattgtttgggggataaaaagtagtctcttctgatttcagctactctttaacttacgtggggtaacgtctcgatgaaaggatgtatgttggcagctttggctgcactcacaatttcatcctgtgatacaacccggctgttgtctccataggcaatattctcggcaatgctgcagtcaaataggataggctcctgagacacgattccgagttgagctctgagccactggacattgagtttctttgcttcttgaccatcgagaagctgaaaaccaaagtccacaaactataagaagggtataaaaaagaaaaaaaaactaaaaagttactagattgtccatttggaggatcgttgcatgagggtgtcagcagcttcaaaacaacaaccctccaagacttataccattgaggccagcatggccaacatgatgatttttatggtgattaagccatccctatcttggtctaactggcaaaatggtagcacatttgaccctcttttttcacacttctctttgtccttgtctgccctcctccagccatctgtgtcctactctgcgttaaagaagcctgcatcaaggtgtcccactcaggtctgctgtccccagaataatcctaacccttcaccttgacttgatttccccttcccccatgcacagcagtgaaaaagctgatcagaagcagggccccaaaagctggttgactctggtcctacctctacctctcttttccctgaaaactactagccttaactttccctcacctctctgatagcactaaggacaagaatcccatggaaaaggaacaagttacaaagggcagtgtctttgggaggattatttttgctggcagtgatggtttt

SEQ ID NO: 125958 - DNA, 1010 bp, Homo sapiens
ctttgtaacaacagatggtctctttcccttttacacttttgaattaaatggtctttaaaattacccaggtacattggagttagtttcctctttgaacattgcatctatgaaaaaatacatgcacccccagtgcccatccacaaagcagagaagttgattacttggttctagaatgttggttcaggtgggcaggagaggaatgagagtgtaaaggcacaatgaagaaatgtctgcagagcctcatgagttaagcacaggtgttgtgggtttattgtaatgaaagtaagccaatgtagctcaggcatagaacccactcatcattctgaccaagaggctaaggctggagcgcatgcatttggagcttaaaactacagttgctttgtgctttttctctcccaggccacaggaaccaggttggctttaattgcacagaatatagctaaccttggaactggtattatcatatcatttatctacggttggcagttaaccctattgctattagcagttgttccaattattgctgtgtcaggaattgttgaaatgaaattgttggctggaaatgccaaaagagataaaaaagaactggaagctgctggaaaggtaggtcaaataagatttcaattggtgttaagtgttgtttttagacatgtgttttatttgaattatttatcatgatatgcaggctttaataattaaatgtttgtgcccactacaactaataattgtcaattgtgtatgaaatattttactgtattaatgtctagaacttaaatataaggtgattaacataaaacgttgagcctatagaaagcacttaacatagttatgataaagaacttctgaatattcaaagtgcatttcattttacttcatgtccaaatgctactgtttggacaaatgtcatccctgtttcacaaaccttcatgcagaagactgtaagtgaattgttcagggtcggacatgtgctggcatttaagagatcctcttctttttggctgtgatttcta

SEQ ID NO: 125959 - DNA, 1055 bp, Homo sapiens
gctaattttttgtatttttgatagagatggggtttcaccgtgttagccaggatggtctcaatctgaccttgtgatctgcccgccttggcctcccaaagtgctgggattacaggcgtgagccaccatgcccgtcctactgtggagctttttatggaagaggaattagggaaaagaactattatgagaattaatctatgtgattatggaataggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtgaactctgactgtatgagatgttaaatactttttaatatttgtttagatatgacatttattcaaagttaaaagcaaacacttacagaattatgaagaggtatctgtttaacatttcctcagtcaagttcagagtcttcagagacttcgtaattaaaggaacagagtgagagacatcatcaagtggagagaaatcatagtttaaactgcattataaattttataacagaattaaagtagattttaaaagataaaatgtgtaattttgtttatattttcccatttggactgtaactgactgccttgctaaaagattatagaagtagcaaaaagtattgaaatgtttgcataaagtgtctataataaaactaaactttcatgtgactggagtcatcttgtccaaactgcctgtgaatatatcttctctcaattggaatattgtagataacttctgctttaaaaaagttttctttaaatatacctactcatttttgtgggaatggttaagcagtttaaataattcctgttgtatatgtctattcacattgggtcttacagaaccatctggcttcattcttcttggacttgatcctgctgattcttgcatttccacattaaggtggctctcaaacccaaaacac

SEQ ID NO: 125960 - DNA, 1102 bp, Homo sapiens
agagaaaaggtaaaacccctaagtcctattacctaaggatccacttctcctaagtgattaatactaggatttacctcaccctgtaggtggctggtttagctacctccttgtaagactgccgcactgcctttatctgcctcaacaggatcagtactatatcaagagtgcaactagtaaaccctccactcacatgagatacacttcagtgctcctgccttctgagacagccacagctctggggtagagccagtcccaagcatctgccaaaacctcatctggcgtcttctccctctatttacagggggaaacccagggctgagtgccacaaaactagggttgccagatatagcaaataaaaataggcaaccctgtactaaaatttcagcctggaaataataagatagtattgttttctaggttacaagtgcagtcacatcctgtttctgctctctcctgagtaacctttaactgctgtccctatcatcatagtgaatagttggtgacaattatccattgtgggaaacaacacgggaagaattttgggagcactctaacaacaaaaatgtttaaaaaggagatgttcattttcaaagttagatatcaaaatggaatccattttgatagcatccattaaaattgtttaagtgttggagatactttcataaaaacagacactaaaaggctgatatcccaagaatgtctttcctcaatttaaaatcatgcagagagtgtcacctgctggttacaagtaagatgagcttcaattattttattatgaatactttgttcaaatcaaatttcctttctcctgccaatctttgtcccaaatataatgaaatcagaagatggaagatactaacattgcaacaatattcttcttcattaaaatgctgacctgtttacactaaaacatatcatcttaaggcccaaacatttattttcaaatagatagtaaacctgccattttgggcttttttactgttctttccttaattattcatgaaccattcttagcttctgaacctaaatttttggagtatatagaatcgtctatcctactttctataagcaagctgttagaactttactttcagttctactt

SEQ ID NO: 125961 - DNA, 2159 bp, Homo sapiens
gccaagatgggggcattcccctttcaaggggggacacaaaatatctttcagttgtgaggtattagtgttaccaaaacccaacctagagtgtttagatccagtcttggttttcccccaattactaattgtgtgaccttgtataagttacttaactttgctcatttccttatcagtaaaatgggaattaacatcacagtgaccttataagtgttgctatgaaggttaaacaagagactgtatgagacatgcttatcacagaacctacaacgttgtcagtgcttgatttttaaaaatcaattattatttcacagtaaatatgcatagaagaatacacatttaacatttacatttttgcgctaatgaaagcaagcaatagacttaacagtctacaatagagatagccaatcattttaatctggcctttcattatttcttaccaataggtttactttcctagttatatttttatttaggccaggattttttgagcacttctcatagattccccagagttccttggtctttcctcagaccaacaccattcctcagccaaagaagctctgcttctttgatctgttttacattctaggcatctaaacttgttttacttaaagaaagaattcttcagtcaacacaggttttaaatagtttgcaattctagggtattatgcggggacgaggaggcccaagagtgtattcagtgtaatgaagaaactcattataacttgctgagatcattcagatttgcctgtgattatattagttaggcagtgtctgttttcctcccaggggtataaacctggaaaattacaacaaaaacaaaagcaaaaaccaaactcctcctttccttaaatttccacttctcaagtacagtgttttatctaacaagatctgctgcttagccacatccttgtttggctttcactgtctctctccaccctctactttccaccttcatttattaacattgtaaggaagcctggagcatacatgtgtggaatagtctccatggcaactcagcttggaactaataaggttatgggagagcttccatccctgcacctgccagtgtcacaagcagaagccatgttcctgtagcaaagattgtactctactgctaggcagctgtccccttgagccacccagccaggcacatgggatacagagagtatatggctcagcacgcactagtcactactattagaaaagctcaaagctgagtcactggtgccttcttcagaagggatgaacagctctctcacttgaatgccagaaaattatcttgcaaagcagacctatctgatagacatatttgcatcagagtagggcttgttatcagcaaggctgtaaggtgccctccccagtcttctgcaggataatccagggagccagattatagagaaagggcagccctctgttcctactcatctggctcagtattgaggatctccattcaccctttcctacccctgttcacctatccatcccctgtagttcctgacctgcaaagctattatgtggtcatagttgttatttatttccatgctaatcctgggcactgtttctctgaaaaatggagatttaagaataaggctgtcaggatacatctcagaagtattaggcgttgtattagtgtggctgctataaccacttgccacaaattcagtggcttaaaacaacaccaatttatgactttacacttctggaggtcagaagtctaaaataggtctcagtgggctcatatcaagtgtcaggagggctgtgttccttctagaggctccaaaggatgatctgttttcttgcttgtggccccttcctccattttcaaaaccagcagtggctggttgagtctttctcacactgcatttgctgatactcttctccctccttcttcttcagttaagagcccttatgattacattagtttcaccaagataattcaggataatcttattttacagtcagctgattagcaaccttacatctactactttagtttctttttgccatgtaacataacacattcacaggatccagggattaggacacagatgtcttgtgggagagggaacattattctgcctaccacatgcatacatcagaaaccatggttgaaacacaggaaacatgacagttcctcaaggcatacaattatgacc

SEQ ID NO: 125962 - DNA, 1078 bp, Homo sapiens
ctgagctggatccatatcatgattctagaatgtcaacccctttttaaagccttctctgagacccccgaagaatttagtgcttctcctttcttcctataacagattattcataaggcacctctaatgcataaatagtaattcaactcaagtcaggtctcctaagtcaagaacatgcctgtttcctctatgtcaacccatcatggcccctgcaccttgtaggtgttgggtaactgtgtgcagaatgaatatttacgtagagtacttccatactgtgtgtccaaaagtggggagaaagggagataacttttacttattgatccctaaccggctctttacagtcattggattattttctctttacatcaacactttgaggtgtagttaattctacattaaagataaagacactgagtctcagaggttaggcagtttcccaaatttgcacaactgttaagtgtaaagtgaggaccaaacttagttctttggaaacgaaacccatttttgttggtcatgcctctgtgccctactgccaacctatcaaaagttacattttaaggactgagaaatgaaagtggaatgagttttcaaatgtcttcttttcagaaactctttgaggaaagcacacatctttggaattacattttccttcacccaggcaatgatgtatttttcctatgctggatgtttccggtttggagcctacttggtggcacataaactcatgagctttgaggatgttctgttgtaagtattgggctattatttagttaagctctaaaaataaagctgggatgaacatgcttcatgtctagataggaaaccctactgtgaagcctcatgaagagattctggtgattcctaaatcggcatttctgcctctgagtcttcatgtgccaccattgaagcaccccctttcatttggaggagcagtaacttctttcctcattgctggctcacacatagttgaccttttcaaatctgtgactgagtggagtgattccattcggagattttgagaaggccttggcatttgggaagaagcctagccctgagcaaggagtctgactggctcctttta

SEQ ID NO: 125963 - DNA, 1027 bp, Homo sapiens
tgcgcgcttactatcttaaattaaattccataattttcagctctgtattttttccaaattaaacattatatctcaaacagacccagatatatttgaatattattaatgacaaacgttaggcttaaattacaaataataatatacctaacattggaaatttccatcattcctagtttgtcagactcctttatcttgctaatttgcagatattgctttagtaatgttgccgtgattaatgaaggttttcttggtattaaaagatccaaagagataggaatatgtaattgaactctagattgttgatattctactttcagcattctgaagtcatggaaattcttactgtagaaactcaataaacttacaagtagacctttactttttagttcattactgataaaataatgaatatagtctcatgaaggtgagttttcagaaaatagaagcatgagttgtgaagataatatttttaaaatttctctaatttgttttgttttgcaggctataggttccaggcttgctgtaattacccagaatatagcaaatcttgggacaggaataattatatccttcatctatggttggcaactaacactgttactcttagcaattgtacccatcattgcaatagcaggagttgttgaaatgaaaatgttgtctggacaagcactgaaagataagaaagaactagaaggttctgggaaggtgagtcaaactaaatatgattgattaattaagtagagtaaagtattctaatcagtgttattttgttactccctactgcttactatgctctaagaatgtgtttataaccattcctcaaagcaatctttttcatgcttattcagtaaattagaaacttacagaaagtagcaaagccagttcttggactcaaaaactgataattaactttaacagactttttcagttttcaggccattgtcttcacactgttcttccttcctccccactttcctccttcccttagttattttcttctttcttttctctcactttcactctctct

SEQ ID NO: 125964 - DNA, 1088 bp, Homo sapiens
ttggttatacaaaaggctataagatataattaattctggatatattttagatgtacagccaacaatgtgttggttggataagatgatggatatgagagaaagggtatttaaagatgactccaaattcttttacctgcacagtggaaaaaaaaatggagtttttttttttttttttttttttaaagagacagggtctctctttgtagcccaggccagactgcagtggcatgattacagctcactataacctagaactcatgggctcaagcaatcctcccttctcagccttcctggtagctgggaccacaggtgtgcaccaccatgtcgagctaatttttaaattttttgtagagacagggtctccctatgttgcccagtctggtcttgaactcctgggctcaagtgatcctccctgcctcagcctcccaaagtgttgagattacaggtgtgagctgccatgcccagctggagttgatctttatgaaattcagaagcctgttggagaagcaggcttgggggagaatggagagttctgtatgagacatggtaagtttgtgacgtctgtattagacatccatatgtagatgtcaagaaggctgaaatttgcactgctaactttagtaaaccttttttataattggtttactaaataagttttactatgcttctccattcattttggtcctcacaactctatagactcctactctgtaggaggaatatacatgagacagtgagcattagtctttggaataaaggaacagtaaccagtgcaatgtgacattgcacaatatgacacagaccctgtggtatgggctcatgtgctttgatggacaaatatcccgcatcacatttgacgtggaagacacaatcctggaggcaactcagtcttttgcagcagaacccagagcagatgtattcagggcattctgtattgcagtttttcttcctgcctctcaaattcctctggtgttatgacctgccttaggccacagtgagttcctatatttgtaaaattggtggtcactttttccctccatagtgctgtttgtgaggccctttgccatattcactgtctctaattgcct

SEQ ID NO: 125965 - DNA, 1027 bp, Homo sapiens
ctacttctggatataatgctgaccttaacacacttatgactcttcttttcactcactttattccagccactctgtcttctttgcattttttttttttttgagacatagtcttgctttgtcacccaggctggagtgcagtggtgcaatctcagctctgcaacctccacctcctgagttcaagtaattctcgtacctcagcctcccgagtagctgggattacaggcgtgcacctgtaattacattctatacaacttgatctaaaccttgtttttattgttttgtttgctttaggcaaagaagtttgtattaaaacaacaattactaagaggagctggtactatgccttctgaaactattccaaacaatagaaaaagagggactcctaaggtttatatttcaacgttataactctatgtatttcctcatttatagcttaatttattcttaaagaagccccatatattagatagaagaaatgttagtatagtactaacttacagaaaagatttaaagataaagatggataaggttcaagaggggaaaagacacaccagagattacatgaattttttcaaattctacatcattttgtggacttttgccataaacagttgtagaagaaattgtcacttcagccaaaaatcaaaacctgctggttcaatagtatctagttatatcaagagattcatacagtagcaaaatttaagttattaaaattattaaagtttaaagttattaaagataaagactgaagttattctattcttgccttaattttttaatgtgcttttcatttccttcaacctatattttagaggattgtcttccctcccttctgtaaccatagtgactctaaactttcttacagcaattaaatacatcctttcttcagtagcaattactgttttatgttgattgagcactttatactctcttttctaaataactattctacatgcatcttgttaatagcatgaataacagcaatagcaaatggtttataagttatctatatgctctacagtat

SEQ ID NO: 125966 - DNA, 1498 bp, Homo sapiens
cctaactgatctccctacctccatttttatcccaatcctgtagattcacctaaaaacagccacagtcatttttctaaaatagaaatcaaatcatatcccactgcccaaacctgctgaaggctgcctgtagctcacagggtaaagtctggaatcttgacagtcgcctgtaagaccatacactatgtggcccccactctctctcaaatctcatctcctataaccgcctttttccaatacaccgtctactccataaacagtggctcactgcccaagagtaggggaggggaggatcagaggagccaaatcagaacacaaatctgtccagaggaagggggtggcttttacaaattcatacaaaggttctttttaggctgctggcagcctttaaggctttcttgctggtgtatgaacagattaggtatgcctttgcctcagggtctttgcacatgctgtttctgctttccctgaggtattctcatcctttccttcattcaggcctctgttcagatgtccccttagaaaggccttctgtttcccctccccagtctctaaaatagcacctcccctcacttttctgttcttcttaccctgctcaatttttcttttatttgtaccttccatctctagaatctaaacttcatgaaagcagctactttgtcttttttgttcgtacaggtccaacacttagaaatcatgcgtaggagaaagtaggcactcagaaatttttctgacaaatgaaatgatctatttatgtgtttttatattaagtttctttcttgtgtattgaatgtcacatcctgagtactaaatgcagggggtataagtataaacaaaactgaccccatcgctgccctcttggagctgagagtctcataaacagctttaaggtaataaaatcattttctgtgccacaggatgtgagttggtttgatgaccctaaaaacaccactggagcattgactaccaggctcgccaatgatgctgctcaagttaaaggggtacgtgcctcctttctactggtgtttgtcttaattggccattttggaccccagcatgaaactaattttctccttacgggtgttagttatcatcattaagaaaatgttgaataaatatctaacctacgaatatatcacatgctttttgtagcaacatgttaactatttaaacattatatactgtagagcatatagataacttataaaccatttgctattgctgttattcatgctattaacaagatgcatgtagaatagttatttagaaaagagagtataaagtgctcaatcaacataaaacagtaattgctactgaagaaaggatgtatttaattgctgtaagaaagtttagagtcactatggttacagaagggagggaagacaatcctctaaaatataggttgaaggaaatgaaaagcacattaaaaaattaaggcaagaatagaataacttcagtctttatctttaataactttaaactttaataattttaataactt

SEQ ID NO: 125967 - DNA, 1050 bp, Homo sapiens
cgtacagccttgtgccatggcacacagtcacagaaacatagcaagcccttgaaatcaggctttctgactttgtctgatctcctgctttagcaaagacatcaattctccctccttttatttaaatggtggctgggtccctgacaaggtatgttcctgcccacagggtttcacatttggcaaagctggagagatcctcaccaagcggctccgatacatggttttccgatccatgctcagacaggtatgtctatcgagggctgtgccctgggatgtgtagaactccccatgtgtgccccttggactcagacagtgggagctctgtcatgtttcccaggcctagctcctatattggttgtccctcagtctcacgtcagagatgcggttgaaccgcccactaggcacagatgaggctctactgtctgtcaggtctgggtgggcacaaggaactggaccagtttgagacagagcctccagcgtggattcacctccagcctgtgtctcagcagtggtgggcagtgcaggcagaaggcatctttgatacccctcatccctttcctctctttccttctttctcctggcaaacccagggcacgagtgtttcttcccaccaagagatgccctctgtactctttctttccgcaaatcaaaactcatccctgtgtcctgttcttcactgcccattttcttttctgaggctagtctgaaatactagttcaagctgcagtgttactggctgataatgggtttaatggaatgcttctcacattttgcagcttcaaaaccctaaccattgacacgtgtgaatgttttcctggggaaatggggaaggaaattagaggaatgtaactcagagcagcctggttcaaaggggaaagttcctttaacaatcatgaaaattttgtatgtgacctaataactttccgttttaaaaatcactaatcacttgccattgagtaaaatgatgctttagaagtctgccccagatgtgccaggggtactcgaaccctggctaagaggcatcagtttggtgtgttaggctttctagagggc

SEQ ID NO: 125968 - DNA, 1757 bp, Homo sapiens
taagttaggaatgggtttggttgtaacaaaacctcaacttatgattttatacttttctcattcttcatatgacaataagtctggaggtaagtgacccagggctgggatattagctcttagatattgagtaggcaaccagacatctgcctcattgaagatagtgggctctgcatcggattgcctggatttatatccttgagtcatcccttgctggctgtgttaacttgagcaaattaattaccttctctgtacttcagtttctatctgtgtaaaaccgtgatgataataaatcatacttctggagatagttgccaggattagaggaatagtatatatgaatttgcttagaataatgcctggcatagagtaagaatttggtaattgttatgatttttgttggactgactagtcaaaaaaaattatttaatctcttcaaaaatccttgttgttgttgttatttgtttgtttttttatgaaggataaagttgtctgtcctgggctaggaatgttactatcttacaagactgattttggcccactgtgaagggagatacgtgttttctttccctgaggaatggttatcctctgtgttccttgagtccaaaacatcctattagcccttataactatctctggaaaaaatttcaggtatggtgctaggtcaggtagctgtagtttccaactggctctcttaactggccatcctaccaagaaggcaggctcaaggaaattcctttctttttgaaaggcctgggctgagtgaatgaccaccactctgtggttcaccaaaaaaccacatcaggttttccccagacaccttgggacagtttgaaatgtccaaatagtaaagcaatgaactgccataaatgtagttccccaccaagggaagaggagagtatttgttctgatttcaactttacacagttgaggtggcactcatgactccaagagggaatccgaacagaaaaaatactggatcaatttatgaatgatagacctatccttggcctccacagaagggagaatgcagacacctttaaggctggcaataggaaagccaaccccaatttccagcgtactaaggctctcctgacccctgaatactgggccagatgggaaatgggtcaggtccaggatgggttcttcactgattgaactaaaaatcctttaaatgttttctcacaggtttttacaagaattgatgatcctgaaacaaaacgacagaatagtaacttgttttcactattgtttctagcccttggaattatttcttttattacatttttccttcaggtaaatgtttccattttcactatattcattttgagaaatgcatcattattcaactggggggatttataaacatcagtgtaattggccttttagtagaacttctctattaacatggctactaacagccaagtttttctgacatagtgaaaaaagatgtttgcctcctctggctcccttgcttaccttctcctctccacccttacctcccgcaatgaaaccagggggaacagagtatttggcctgatatgatgattggaggtgaaaggcagggacttcaaaatggggtgtgggggagccctggatgtaagtttggatataagtattgccagtaaatgtaaatactcaaagaaatgtcttcccgtgttctaaaagcaacaacaaacaaacaaaaccccataagcgggtcacatgggtttaaaaagggtttgaagagtttatcgttcaacttttgttcaaggagaaag

SEQ ID NO: 125969 - DNA, 1037 bp, Homo sapiens
gggaacaagagaggttatccagaatcctcctgtcctatcccccagaatgtcaacattttagaatcaggttagaatttaaaagtattaatttacacagcagaatttttagaattaaaatttatagtgtaaagagactatagcgggtcttcaaatatcaaaatttccattctgtttactcctgcttataaatactcttgtcaggttctgagtaccaaataaaagtaagtgtttgtggaaacatcatttattttttaaaaaataaaggagtattgtagcaaaatttgtcaacatttttttgaagctaaataataatcactatgacattttttaaagcaaaattgtcatcacttattcattgataaggaataaggataggatatattcctttactaatttttgtgcgtatgtaagaattgtacatataaaagtttttaactagcctgttgtaataatttgtgttttctaggatgaaagtatacctccagtttccttttggaggattatgaagctaaatttaactgaatggccttattttgttgttggtgtattttgtgccattataaatggaggcctgcaaccagcatttgcaataatattttcaaagattataggggtaagtgtgatgcccatttgtgtgatttacttgtgaatcctgatggaagaatgaacgaataaagtgcttgtgtctgaactgggatacaaaaacaacaaaatccacgtatctccatatgaaactaattggcttgaagatgtaagaatagcagtctggtttgtgataggagagctaactttgtgaaccttcctttgtcatcacagttggtttctaacctgggcaactaaagaccagcttcctgaaatagtcaatgaaagtgatgagatgactttctcatacctgccaacatttggctctgaacaaatcttgtgaactttcatttcaccaatgtgcaaagagagttcctcaaatgtttgtcaggctggcttgagaatgcactgttctctaacatacatactttccaggatgtgagtaagcctagcat

SEQ ID NO: 125970 - DNA, 2043 bp, Homo sapiens
aaaaattgatctattttcttctgtattttctagtttctaccacctaatttttccttgtgtattttttctttttgaagttttccacttctacttatcctatggatcctgaaaatgttgtgtgttggttttgagaattgtattgctagttattagagagacatatagagtaacaaaaattatgagcattgggaaagttacaaaggttagagaagtctcagacaaggcctggatatctggctctgttcctttatgaaaataaaagagacttacgtgactcttcaatttttccataattcttcaacctaggaataagtatcactaactatggataaggcacagtgttgagtactttatgtgctttattttatttagtcatcacaactactctaagaagtaaatactattattatccccattttacatatgaataaattgagtctcacacagtttccttggataaaatattttattggataaaataaattcataaatttatttcaggtcagtgtgacattgaggtctggactttgctgcctcacatttattgtctgtcttgttcatccagggggtcatgcgggataggatattataattcctagggctgattactagccggtgtgtatcagtacagcacaatggcctgtgtttgttttgattggccaacgcctggtctgtaggaatttgttggtttgtacaagcccctgattattattatttttttattttttattttttttttttgagatggagtctcactctgtcacccaggctggagtgcagtggtgcgatcttggctcactgcaagctccacctcccaagtagcggggactacaggcacccgccaccatgcccagctaattttttgtatttttagtagagatggggtttcactgtgttagccaggatggtcttgatctcctgaccttgtgatccacccaccttggcctcccaaagtgctgggattacaggcgtgagccaccacgcccggcccaagcccctgattattactgcaaatttaggttaaataaaatatttgggggcttacataatattaatatgtgactgttatatttgtgtttgtatttattacaaggaaacatcatttttaactattatcaattgtctatacatttattgaagtcagaggctatcttatatagatttgatggttttacaatgcccacagcattggttcagtaaatatatgttgaatggttaagtttcttcaggtaattgttaatgtattcaaaaaccaaatttctctctctttaggccagaaaaggtcggaccaccattgtgatagctcatcgtttgtctacagttcgtaatgctgacgtcatcgctggtttcgatgatggagtcattgtggagaaaggaaatcatgatgaactcatgaaagagaaaggcatttacttcaaacttgtcacaatgcaggtatagtttaacttcagaattttcctaagtcatctcagtgataaactgattttgcatttaatgctaaaaataaatattatttgatttgattaccttacaaagtaggaaacaacacctgggggattcaggatgagaccagtgtttaagattttttttctctcttgaaagaggggaaaataaagaaggataaacagataaaaaaattaaaaggtttcaaggtgagttatccgttatagtagtcagtagccacatgtgtctgtacagcatttaaatggtagtgaatctgaattggaatgttttaagtagagtgtgcacatcttgttctgaagacttagtacaaaaaatgcaaaatatctcaatttttatattgattacatgttgaaacgatatcatgggatatcaataatatattggatatattaggtgaaataaaatatataactaaaattaatttcacttctttctttttacatttgttaacatggcttctagaaaatttaaaataacatggctcatagcatggcttgtgccatatttctgttgaaagcactgatccagagtaaacttgattgagtcaaaacacccacaaaaaatggcgtgagaagataa

SEQ ID NO: 125971 - DNA, 1034 bp, Homo sapiens
aaggaaggaaataaagaaagaaaaagaaaaacacagagatgaaatcacagattaagcaaaatgaggggaaaaatagtaaccagaatcccatcggcctctattttggttcacagaatgtttagtaagctgctttttttctctctcaaaaatttattaagcacattgacaggatgttaaggaacattcaagtgttgttttattagagacagggagagttgaaacaaatatgagttcatctttgaattctactgtgacatctcaacttggaacacctttggttataatgtctccatctccacattctcggtcctcacagaattatccccgttactatcacgtgctggagatcaaaggcacagtgcccggcacacggcaaacactcaaatgctatttggtgaatgagtcatatggactccagaattgcaggacagtcaaactctgttgatagtcaataacctgtcatggcttaggtaggttttcagtatcacaggctatctgcccctttcctggaaataagaggtttcttatttcgcatagagtcttcaagtggcattcaacacctggaaaattatatatggaccttcaggttgtatttttctcttcttggcaatattacaaactctcaaaacctaaataacagggttatccacatagtcaagttttgaagatcacaatgaagatgaactttcacatgtgtctatatttctattttttaatttaaaagattagcaagtgtcttcaaatgaaaatgtattcatcaacatttaaaataagatcagagaaataaatagaaattgaacaataaaacaaacaaatagaaaaagatttcaaagaggcccaatgcttttattttaatagctgaaggaatcacctagaagctatcagaaatttccttttctaagaccaatattaacaagaattagtagtagaatgttcttatgcttataaatcaggttggtttgaactaagcctcactgaccttatccagagccacctgaaccactgcttcgctttctgtgtccaaggctgacgtg

SEQ ID NO: 125972 - DNA, 1054 bp, Homo sapiens
tggagtgatcagagcaagctaattaacatatctatctcctcacttgacaccttttgaggtgacacatttgaaatttactcttggctgggtgtggtggcccatgcctgtgatcccagcacttttgcaggctgaggcaggaggattgcttgaggccaggagaccaggctgggacacgtagcgagaccctgtctctagaaaaaataaaaaaaattagtcaggtgtgatggtgcatgcttgtagtcctagctacttgggagactgaggcaggaggattgcttgagcccaggaggtagaggttatgacgagctatgattgcaccactgcactccatcctgggtgacagaatgagaacctgtctcttaaaaaggaaaaaaaatgaaaaaaggaattaaatgtactgttagttacaaacttttaaaatatttttaacacctagtatttatatgttgcctcgccattttaaattttaattacctatgttagaaaaagacagaagaagtatgaaaaaaaattgctgtcactatctcagtagcctgatggtttttcttcacattcctcaggtattcttttctgtattaattggggcttttagtgttggacaggcatctccaagcattgaagcatttgcaaatgcaagaggagcagcttatgaaatcttcaagataattgataatgtaagtctgagttggccatctatccacctatctaaaagattgtccagttaagtcaatttctttgtcactttatccagctctccacaaaatatcactaaaagtagttattgtaacctagtaatctcttaaaatttgattctgtttagaagccaagtattgacagctattcgaagagtgggcacaaaccagataatattaagggaaatttggaattcagaaatgttcacttcagttacccatctcgaaaagaagttaaggtacagtgataaatgattaatcaacaattaatctattgaatgaagagtttctgatgttttcttgtagagattataaaaaagtgcatgtatatttaaacctagtgaacagtcagttcctatatc

SEQ ID NO: 125973 - DNA, 1002 bp, Homo sapiens
ttaaatgaaggactgggctttgccagaatgaagaaatcctctgagaatgtgcagtagagcaaaacaagatactttctgaggaaatttctgagcaatttgaaattcctaggttgaatacttcttgtgtacacgatgtccatttcctggggccatgtgggctatggatttttgttgttaatgacaaatatcctagtagaaacttctaccctgctaaataaaacaaagcataggcacaaaatactctagccataaactaccctacactcaaaacaggcttcacgagaaaagttgatgtttacaattctgacaattatttctaacactatctgttctttcagtgatgtctccaagattaatgaaggaattggtgacaaaattggaatgttctttcagtcaatggcaacatttttcactgggtttatagtaggatttacacgtggttggaagctaacccttgtgattttggccatcagtcctgttcttggactgtcagctgctgtctgggcaaaggtaggtgaagcctgtgaatccagattttgaactgcaccttctcccttcctgctctcaccctacggaaaggtctttttactacatgatgactctgattctgtacttgttacttttacgttttctgttcaaaatcagctggataagcatatccagcctcactgagtactacccctgccaagactccatgctgttcttggccatgtgattatttggggaagggatgagaaagaagaatgtagctctcatatctaccttctgcctttgtaagaaaacgagcaagtaaacaaacaaaaacaaaaacaaaacaaaaaaaaaaaacttgaactccaaagaaccatgctctctagtggatgatgccccattcacacggcaagtagagactcaagtttagtgaactacagatgtcccattcaattaacatttttttttactttaatgtttttggctttctagatttttgtttaagttttaaattgattttacagttttgtc

SEQ ID NO: 125974 - DNA, 1009 bp, Homo sapiens
catttttaaaatttttactctctctacttatattctatcagttgctaagtcctgtaacttcttcctctataagtctcataagtatttgctttcttttctattctcatttagactctctttccctacatagttatagtagctgaagtcccttagtctctccacattccagttaatcgtatacattgctggtggctaaactctcgtagaacatacttctaattatatcctattttgctcaaaactgtcgaacaactgctggtctgttttcttgcaccatacctgcaggacccagattatctttccagctacataaccacctccctccatccacacaacacacttcctacccctgtcaaaaacaggcttacccattcttcaaacttgccgttgacttttgtccatattgttcactttgctagaaatagtttttcccctcttttccataccagttgaaatcagactcaactgaaacaggccctttcattttaacataactttttgcagtctcgattgtgataatttatcctagaaaatatttactctttgtacatttataacatatgtgtataagtatgtttaacacagcattgcttgtaacagtaaaatattggaaacaagtgaaatagttgcaacattgaaaaaatagatacacacatatatatactgacaggaaaaaatttggccactaaatgtaaactatgactccattgttaaaaaataagtgtgtgtgcttgtgtgtatatacatgcgtacataaaatctgaaaatgtacacacaaaaatgttgaattgtgctcgtgtgtgtatatgtgtctgagtgtgtgtgtgtgtgtctgtgtgttaggggtaaagttatgaaatacttttataatgtactttttatccaaaaatgttagcatttgctaatattgggtgatgagctcactggtgtttattacactgttctttgtatttgatatttttaaataagaataaaactggaaaaatgctaagattttaaatatatacct

SEQ ID NO: 125975 - DNA, 1028 bp, Homo sapiens
ggagggagaaccagcctactaaattcttggggcccgagatacagtcagatcattcttctttttgcccttccctaggcagaacctcattatctctccatgggggtggactagataccagagcctccttattggaaaagtagtccttgcttaaggggacttggacttgcggaggctcttgaaagcctgggggtttttacaataaacataggatctaattagacagctctaaaaccttcttcagtaagcagatccttctctgttgctgcaatagaacccttgtaagttttctcgtcccaatactttgccttaattaacagacatcagcttttgttctgctgttttactgtggaccagatttcctgacagccactcccatctatctctggtttaattatagaatatgtgtagcctttgccttaaaatctctgatgactggagcctagggaactctctgattctgtcatatcacttttttttttgtaaacaaagcttaatcactgatgaatttctgtaatattctgtgaattctcatcttccttatgagactggccactatctggaaatgatcctagataaaggcgattgtggttttaaatgtgttgtggtgaagacggcaggtggggtgcctgtaaaatgacatccaggcagttgaagaaatgacactaaatcttggcataaagaacaggactagaagctgggtgtggtggtgtgtgcctgcagtcccagctattggagaggctgaggtgggaggatcacttgaggtcagaagttcaaggctagcctgggcaagatagtgagagtttgtctctaataaaacttaaaaggttaaaaaatgataaaatgtaaggaggaggtggaacaagatagccaaacaaaagcctccagaaatcatccccccctcccccatccctacaggaacaccaaattgaacaactattcacaaaacaaagcaccttcataagaactaaaaaccaggtgagcgaccacactatttggttttaacattatattaaggaaagaggcactga

SEQ ID NO: 125976 - DNA, 1050 bp, Homo sapiens
ttcaaatcattttacctttataccagttccattgtttggcaggtctttaacccaaaccactttcttaaagcaacacaatgtttcctccatggtatcctcagaggggcctttggcattcaagtttttgcccatgagatgataagtggcttctattcttagaaactagagcaacaaataccatattatataccattaaatacttttacagtttcccagaatgtcccatccttctcattagacttcatataagaagacagaccaagtccaatatgaagaattaggccagaactcaatggaagaatcaaatgtccatttctaattagactattgcaataatttagcaaaggtagagggtgtcttggactaggttggtatcagtagtagtctgaaaaatgtttggattttggatatattttgaaggaaaagcaaatcttccatgaaactgtactaatttttcctctgctattcttttttctctctttttagtttcgctattcaaattggcttgacaagttgtatatggtggtgggaactttggctgccatcatccatggggctggacttcctctcatgatgctggtgtttggagaaatgacagatatctttgcaaatgcaggaaatttagaagatctgatgtcaaacatcactaatagaagtaagtattgtttgtgtaccaattttattggaaacttgcagcaaaaacaagcacttagagtgatgtttatggattctttactaaatacacattagtgtgtttagtcctgtaggaggcagacagtctgagttataattcatatttgtagtgagttagaaaagataatatttacaagcattacaacacacaactgaagtgccagcagagatatgtagaaaaagagagagccctgtgaagtcagaaatattctggaaagcttcaagaagaaatataggaacttaattagaaccttgaatgataagtaggaatctgttgtgagatttcctaacagattgaacatgggtgtaagacgaaaagtcggggatgattctaaagtttttagccctagaaactgg

SEQ ID NO: 125977 - DNA, 1050 bp, Homo sapiens
ttttttttctgtttttttaaatagagaaaggtttagaattcaattggtgacatttattaatgcttaactagaagcgcaggaaggttcccgtgtgctatttaagcgactgtattagacaaataggatgttaaatggcaagatatttctagtgtctagtccctttcatttagtttgattttattgttaagactatgatccagactcattaagtaaattaagtaaattttccaaactaacaccactagttaaagatagaataggactagatttgaggctttttgacacctagattggtggtgcccttgccattatagttcactatattacctttatttttcagaattttattgttcttgcattttcaagtctagttttattttactttttaaaattttatatcgcaatttgtctcctgaaggtcaagtaacctggtttggttatgaaagtcctcgtagcttctgggactatatcagagtggcttgccggaaagtttcacagaattgtatctgcagcattgaaaatatggaaaatgtcagttcttctagagctaaggtaagacattggtcagagactcgtttctattttttttttcattgcatgtatttggaatagcaggaaggtgtgaagctacttactatgaatttccttttcttaagaagcataataaaatacgtcctgttctgtgatgtttctacatttcttgaattatctaaactagtggctctcaaataatgttcagcagaaccctgaagatgtccaagaccctttctttaatgggtacaaaatgtcaaaaatatttttatataatatcaacctgttatttgccttttcgctgtgttgatatttgcactgccaatgcagacacaatggtggataaaactgttggaaccttagcacgaattaatgcagtgacatcaaactgtgcaagcagtcttgagttcttccccaccatgcactcagtattttcttttaaaggcagtttcaacttaagaatgaccatgatggtgcgggaaacattaattcttattaaatctcaactttgaggatctg

SEQ ID NO: 125978 - DNA, 1014 bp, Homo sapiens
agacaaacagaagttggagcttggaactgccactgaacaacagacaaatgtgcctggagttgtgcatgcagttttcctatggggttgttgccaactctaagtcatctgtagctcaaagcaaagtcccataaacaaagctgaaagcagcagggaagaggtaaaactgctgattgatgatttcacagtctagttctggagagatagaggttagagttcaagggcaagcaaggtgaaggggaactgtaaacactccaggtttttacttgagacccctgaaagacaatatctttggagtaagggaaattcagaagattaatacaaaaaaaggcctaaaagtagtcccctaaattgtgaggtgattttctagtactctgactgactgccaaaagaaaaatctactctggagaaaggtagcctcagagttgctataaattttcatacagaatgtctagtatacagtaaaaaatcatcaggcacatcaagaaacaagattgaatgactgaaatcaagaaaaatgaaaaagacaattgaaacaaacctatgggtgatagagactttggacttttaagcaattataataggttcaagaaaatggaaataaatatgaatattactagacaactgaaatacataaaattactagattattggaatatgttaaaattcaaaggccgggtgtgatggcctttaatcccagcactttgggagaccaaggtgagcagatcacttgagctcaggatttcaagaccattctgggcaacatggcgaaacccagtctccacaaaaaatacaaaaattagccaggtgtggtggcacgcacctgtagccccagctactcaggaggctgaggtgggagggtcacttgagcttgtgaggcagaggttgcagtgagcttagatcgcaccactgcactccagcctgggtgatagagcaagaccctgtcataaaataaaataaaataaataaataaaataaaataaaataaatactgcaaaatatacattcttatcatac

SEQ ID NO: 125979 - DNA, 1050 bp, Homo sapiens
ataatgaaatttggattttattactagttgtataaaacctcccactgaaaggataggattgaaaattttcttaaataagtgatgttagactgattattttcattaatgagagagaactctgtttttcatgatttatgagagggctcattttaattagtttgttgatttgcggtattgaagtagagagttatatcttatataattacatcatgtaattcaaaagaagtctctaacccaagtaactcagtattaacgttctgtcccttcagaggatagaaagttagtttgacatgctgtaccctacatattcagagaaacaaaatatatactctagataatcaaaatttacctatttttatctacttaaacatttttcttagtcgttatcaaatgtatattttgaatggctgttctttacatattaaaatatttttgatggcacagtggcaaaatatttttttaattttttttatatttgattctttcttcttccttttagggtagagcctggatcagagtagcactcatggaaaaacatttatctgaatacatctctacagctctgagagacttcaaaacaaccaggtttaaaagtccttttaattttctaatatatatttgaaagaatcacctgaagactcagaaatcagaataggatgaagaatcaatttctaaaatcctcaactgttttatttcctccttttgttactactcagataaatccactgtcttcttaggaaaatgtaatttgtcaactaaacatacatctacctttctgtaaaaagatacacattacgcctggaatatcctttttctaaatcatttctgattcatactctttcaactcttgaagcttcattctccccatagactattccctgatggatttgaatttaagtatgaaatttcaatagcatcttttttcttttcacctcagtatttccttatttttttgcttgtaaagaatatacattggccgggcacggtggctcacacctataatcccagcactttgggaggccgaggctggcagatcacctgaggtctgga

SEQ ID NO: 125980 - DNA, 1001 bp, Homo sapiens
ctgttcatctgtttagcatggatctagattttatacttcttgactcagttattccaccaacttaagaaggggcatcctagcatcattctttaatctggcctgtcctcagatgttggtattgttttagtatggccctatctcaaaactgctatccccaaacaaaaaagtatgcagctagggtgttgtacagagatcactttatctagagtttaaagtcaggactggtaagtaatctctgctacttacgtaatgtgtaacactgagcaatacttcctctccttgctcttttctttctgcacatgtaatactggggataatacctgtctaacagaattataaggatcaagtgagctaataaattgctagcatttaatagctagcttctcagtaaatatttatactctataaagtcttatgtttctactctaatgtaatcctgtatcttcaatgtttggagagtgtatacccacctaacttctaaactttctgaaccttatgtaaaattaaagtgaacaactcatccccagttgttctgaataaataaatccaactgtctcatataaaatggaggctttggattttcagaatagaggagttcaccataaaaatcacgtttgaaaccaatcacagcttttcatcaggatccagttttttctcccttcaaacttttaatataagccaaggctcttgaactacctgatcactggctccttttgatttgaccaataccttaagtaagttcaacagacatttattgagaaactgcaaattatgaaggaggtggctaaaacctttttaataaggaacattagctctcttgacaatctggagaaagaaactgaccctataattcattacagttttaatgatagtagatgatttttcctggtaaagatatgggatgtctatagctatttctctaggaactctgtaacttcattcaaccagttagccaaagacaatttaagaagagagtgttaaaagaaaaactttagacaaat

SEQ ID NO: 125981 - DNA, 1044 bp, Homo sapiens
tgcaatttgttctgtaggtttctttgggcagtatggtcattttcacagtattgattcttccaatttctaatggttttaggatcttatttgtatcattcttgaagggcaattaattatttgctatttaattctaattttcaggtaaggaagatactccctcattacttggcctctgtggatctctaacgtcagtggcaagttacaagtctctaacaagcttaaaatctaatgactaccttgcaagtcctacaacagagatgacaagtccaggcctaactccatcctgaaaatttttgtgtaaaagccaaaactttttatgttgtaaatgtttaatttacatgtttgactgctgggaagacctttgaaattttatattgttctggtacatgtctgaaattctattgcttggagagaatcccctccagataagagattttgagtgaaaaacataatgatcctgccatttttcatttttaaaattcttacatttgtcattgagaaagttcaaaatggaataggctttaaaaaaaaaaaaactttcaaagatccgccaaatcattcatagcaaattgtacatattgttcagctgatttttatatatttaaatacaccttagtggccagagactgacttcaaggttttattccagagactccagagacttaagctaagtattttttcattctttcagattttcaaaaaaaaaaaaaaaaaaagttaatttcattttttcattaatgtcttcctaagttctatgctttaaatgccttgtttttaataacgggaaagttctcagctgcattttcacagtggcttattcagtttttctttaatatttaccatttggtatcaattcagcattccacttaacattttataaattccataggaacatgcctgttttggtagttactgacttaatttgttagtgccacaaggaaaatattttacagtattttatgccatttaggcaaaatgaataaactgttttccaagattttcttaaaagattatcaatttaaaagtatgatcaagtatgcctca

SEQ ID NO: 125982 - DNA, 1032 bp, Homo sapiens
attctattaatgttaaattttctaacataaacatttaattgattaatgtaaaattttaggaaggaacatctttaattttcaatatgagatggttgcaacctttaaagtagtacatatttgattttttttaaaaggcaatatttttttttctaggaaaactattcattatggttatttaactgcatatgttttttaaatttttccctcttggaacaacatgtactggggcctatcaaagggtggagggtgggaggagggagaggaacaggaaaaataactaatgggtactaggcttaatacctgggtgatgaaataatctgtataataaatccccatgacacaaaagtttacctgtgtaacaaacctgcatatgtacccctaaacttaaattcttccctctttttgtcttgggcacaagtttttgggatatggaaaagtttattgtatcccttttgaattttcttctaagatgaactttttaaataaaagatattactgcttttatatttaatctgtcaacatttattgggacattttatgtagtaggcagtatataaaaagcactggagatgataagatatttcagatattgttactggccacaggaggtttcagagctatgattgagtgattgatagaaacatacaaagggagtcatgggaaatatggggagttgttcactcagcctgggggcagagaaggggagtggtcaggaaacctgagttggactgacagacaggcaatccaataagtaaacatgcagggaagtgggagtctcaataaggcaatagaatttagtccatatggcttgaacaaagtgtatacatgggaaagtgtaaacatggaaatgtaatctaaggccttgtgcgcttaaggaggaacaagaaggctgtgagaaacctaggaaaaactttttggcaaagttgtaacagttagttagacttgggttttggaagatacccagcagtatggaaaatggggcttatgataaggtgatctatgttaaaatctaaaagttttggtttgtattaa

SEQ ID NO: 125983 - DNA, 1563 bp, Homo sapiens
aaaagctagagagggcagtataggattgtttgcccttcattcagctggtctcaaaacaagacattgaaatcttcatcctgttagctgtcatgttgtttacatggtagtgtgcctggttcttagaattcttttttttaatcttattgcatctagtagtctgtgggccaaggcagctttttagaatagtgtgtaaacgaaaataaacaaattttgtttataaacattatattcataagctttatgtttatacttcagtgacatctacttttgctgagtttttaaaaaattaggtttttattcattttcttccagatatttgagtggttgcaaataagcgagatgttattattagctaaaataaaccctttgaaggagacagcactggtctaatttatttcaagaatagcgtatccattcagaaaggtagtaataactcaggacactgctagggagaatgagctgttttcctcagaaactccttttagaaaaaaaaagttttaaaactatttacaataaaatgtgaatgaaaaaatggttgtgaggacttttctttggcattggataccccatgaaggtttctatacactttttaagagataggggtctcacttaagagttcaagaccaggctggtcttgaactcttaagctcaagagatcgatcttcccacctcagcctcccaagtagctgtcttttaaaaatttcattatgaaaaatttttaagacctagaaaaagtttaaaaaataactaccatcaagtttaagaaacaagcattatcaagtcaggagaaaccttcagtacattcctccttaattgcatccagtcctatacatctttaaacatacagcctttttctgtttattatttttaatgaatctaactattaaaaataaaacttaaagtagctttttaggtaaacaaacctcttcttatggtaaagaaatgatatatccgcaagggccatggacactatgttatctgtagtaggaattattaaattgttatttataatagcattatttctttattttaacatttagtttctatgcctttgcatatgtcaacctggattataatgaagaacattgttgctaaaaatggattttccggattattttcaggtaaaaatacttgctttaccgaatcattgaatagaatgattacttttaaaatattaccttctaaaattaacttataggaggaagttataggtaacatactacatttattttctcctaaatatctttattataagttaaaataaatgttaaataaaagatttactatcaataagataaaaatttctctataatgtaatatggattgaagtgaggatgttggaagtgagcagtcttttctaccaatttatggatttgaacatattacttcatttaatttgataattatcagaataaagccaaaaaataatatttttaaaaataaggtaagaaaaaaatatttgttttgattattcctattcttttctcaggcctaattcctcgcttaattaaaattgctcctgcttgtgccattatgatcagtacatatgaatttggaaaggct

SEQ ID NO: 125984 - DNA, 2765 bp, Homo sapiens
aaatatgtgttcatttcattctctgtttttatagcaatgtactggtataactatgaaattttaaagaagtggttatgtgagaaatctggtttatatgagccaacatttatgatcaactttacttcaggggcattgtctggttctgtaagtttattcttttgttgttaatattccagaagaataattgttgtattaaaacaaaacaaaatatagcatctcatgtatattgagatccactttggctgcactgcttgaaaatttgtctaagtattttccatctattttaaggaaacaaattattagcaaataaaataatttaaatatactgtatttgtttttatgttacaaaaacatatttttctgagaaacttttggatttgttagatcattacagttataatattttagagctttattatttagagcattttgtaatacattaattcaataaatgctctgattaggtaatatttcatgcaatgtcatctcatatgcattaagcacttctagcctctgctgctgatttctgtttctttggaaacattttgtcctactaaagtactttttaaaataatttgaacaaaaattacagtcggaaggaaataatcttgttaccatttttgggtaatagggagtttatctttttccacaccttcctgtagaatgatatcaaagtcctgtagtagactttcattatgcagatttatatcaccatgacattggcagttttttttatacccacatacttccaaaaatgaatctgtaataacttgtagtgagacaataacacactggaaccacataaaaacaatagcgaaggagcagagtgaagtgatgcagacttgcagaaaaatattgtaataatatctcagaaaatctaggccaaggaagccacagcagttgactttaaaacttagatataaatattcccaggtctaagatctttcaaattaatcctagtggattataagtctattgaacaaaaaaaccaattagtattgttgaataatggctttaggatatttaccagttttgcagaaatatgaaggaaagtcctctattgtactatttctatttaacctagaaaatttatttttttaaatgattttttaaatgatctagaaaattgctgcattttgacagctttcaaataaaggtttgtgtctgcaacagaaaaaacacctgaatgtaagtgtccaggctttctgtcagaaaacagaacagcctaaaccacctcattttagaaagagtttcaaaaatggcttacataacattgtagctactacatgatagataatgaagatggagaaacagtccttgattttaccttacctgaaatctttgaagctgatttcaagaacgtacatcaacaaattgttggggtgaaataaaatataagtgattttgagggacattttatgaccatattggccaaatgtgagttgggaagcaaaaatgcataccagttttaaccttgcatggctgttgtatcaaatattgcaacaacatatctaaaagaattaaattattttaaaaaaactcccttaattaaggcattgtggaaaaaatgtaaattattttgagaaaagttatttaaaatgtgatttgcatccagcttttatcattaataggaaaaaatgtgatttgtgaaccattgtaagtatattttaatatgtaaacatttacataactattttaaaaggcttatagagttaaaagttcaaaattcattttctttattcaaatttaattttttattctattttaaaagcgtttgctggaaatttttaaatgctcactagatacttgagaatttctgctttgacatatgtgttgtatcttcttgtgatgtaaaggaataatagaacacaaaggagcgtgagaaattgtgaatgctggtagtggagtcagagaggcttggttggaattgtggctctgcaactagtagctgtgtgacctcaggaaagtaagggaatttttctgaggctttttacttttgagtatagtgagaaatacatatctatttgctttaatgaaaacttaaaaatatatatattatttcattttaaagttcggttattgttttcattatccttaaataatatactaataagaagaatgtaaaaatattttaggaaaaattaacaggttgattgaaattaatcaattttactttctgatagtttgctgctgttgcaactttaccatttgatgtagtaaaaacacaaaagcagacacaactttggacatatgaaagtcataaaagtaagtttaattaatttaaaatatttttaagatgccatttttgtttttccttacagatattgtagggatatctaaaataaggaaaacaagattttttcttctgcattattctttgtgtattttactgaaagtaatatactgttagaatggaatacccagaaaaactaaacaaaaacaaaaaatttaagaaaatgtaaagtctaatgtttcttgaatgccatcagttaagtctgatacctgcgataaagaagaaataatctttgtcatttaaaagctaagttgttttatgatgttttttcctaaagtttgttttcagatctatttcaaattattatttttattgtccttttaagtcttctttcaagtaaaccaataaaataaatttagacaaatcaggataaaggataggaaattactggaaaccttttttctcttattttttgattatatatatgtatatatatatatatatacacacacacacacacacacacacacat

SEQ ID NO: 125985 - DNA, 3756 bp, Homo sapiens
cttttctaaagctttttttctaagctcttagtagaacaatctagagctgagtaatatagacttcattctgtaagaagttagtatcatccagaaatgcttcattttaattgtgttaaaattccctttttaaaaagaatggacatacataaatccaaaaagcttatttttttagatataaatacctgaaagaatgaaattaccaatcatcagtataaatttttgtataaaaggtttaaagatatattttgattactttttttctattataactttaggatgcattttttaaaatcattcgaaatgagggcattaaatctctatggagtggccttcctcctaccctgtaagttgaaatttaatgttttttctactaaataatgattgttattttatcctataatcagcatggttggacaaagtcttgcatttttaatattagaatgctttcattttctgaggtattgttttttaagcctcacagccacccacatgtttgatgatgtactagaaggacttgcaggacctgaagaggttacattcacagatacggtttattacagcaaaaggatagaaaacagaatcggtaagggaaaaaggcacatcaggagttgtccagaaataggcttccaaagtcctcccttatggcattgcacaggatgtgcttatccttctatcagtgagctgtgaagtatacaaagtgcttctgccttgggaaacccatttgagttttgagtgtagggcttttattgagcatgggttatatggatacattctgtcttttaggccagttgtgatgagcaaaacttcaaacccacagaaggaaagaagtgtactataaatcgcagtgtacagatcaacctggacaagttggtttagtgcttcagacatacaaaaaaccttctaatggggaatactcctggggatatattctcacgagttgtccagaggtcaggcatgcacataggccctcctgaagttatataaggtttgagcaaccaagcctgctgtgttgtctttgctacacaagcatatggtaatttttttcatgttcagaaataaagactttggtgtttatttgttcattttactaaagctgtatgatatattgcaaaatgtatactttcctttctccaggtaattctaattgtctactgcctggcgattacatgaattaatatgataaactgttaatattgaatgtaaaaatgtaaaataataacttggcttttgctgtctcatttattcccaagaactttatacttttaatggaggaaattagtcaatttgaggcatttattttaaacaatgtttaaggtttaaagttagtggcagatccgataccccaccagtcagtcctgctcctaaattctcagcagcaaagtccaccatataacattaggcattccaatttatagtctgtgaatgtcctttagttacatcataaacatggactagtttcttgttgcactaatatttattgacatggcagtacctgcaactttgtgtttgaatttaataattcccttttaataatttcttttaaaatagtatgtcattagaattcccttaaaattagtgtatgtaattctgatgatgttaattataatttatgtctagttataagcaggagtgatatatggtccacagtacaaaaatgttttacaatttctcacgtactttttatttcgctgattctgatgttatggtaattatgaatgagaaagaagatctgggagaccagaaacagagatggagatgaagtgtctgtcttaatttgtcttttcctatttgttttatttttattttatttatttatttatttagagacagtcttgctctgtccctaaataggctggagtgcagtggcacgatctcggctcattgcaacctctgcctgccaggttcaagtgattcttgttcctcagctacctgagtagctgggattacaggcatgtgccaccatgctagcgcttacttaatgctatttattgtaactgtctttacaactggaatgaaaacttttggatggcaaatgcctactttatatctttttactgcctactaagttaagtactaatcatttttaaactaaaagaaaaattgatctcataggctgatttattgtagtttttagcttacacaaaatataagacttttttagcttatataataatatttgaatttaagttaagactatgtgggatcttttgataattttgaacaaatctttttgtgtgatctaacagagtgatggcagttcctgccacagttatttattttacctgctatgatcaattaagtgctcttctgagatctaagttaggagaaaatgaaacctgcataccaattgttgctggaattgtagccagatgtgagtaataaatctttattttcattttgatttctgtttagagcttctgtttaagttgtgacattcacagataatttgtataatatatagagtattagtatgatatattttgcattatagtttatattaatttgttaatatagtataggtactccagaagtcatatggaatggtgattaccatcagaatgagatgggctcagcctattttggtcaaatcatggacagagtttttagagtgacatcagagttggttctgatttacctgaacttctgaggtgtcatctgggatcatgcgtgattcaggccaaagtcctgaatcactttccttataaactttgggattcagagttttatcataaggaacgttgactctatacagaagaacgtttactctgctaaatgggagtgggatttattggggcagtaactggaatgggctttggttttcatagttctggttgattataacatttctggaactgcccttgagagagttgaaaccagaaaaagtaaagtatatgaaaatagatttttaagaaatactttgtcaagggaaaaatctgtggcaattatgttgacatcatgacacatttaattttaaggttttcagacattatagactaaaagtttaaaatataaaatctgtgaatattaatttttacagtatatgtgtttgcatagtacatggctttatttttgttttcttttttttaacttgtttgtattagttggtgcagtaactgtgataagtccactagaattgattagaaccaagatgcagtccaagaagttttcttacgtggaactgcatcgatttgtcagcaagaaagtatctgaagatggttggatttccctttggaggggctgggctcctactgttcttagagatgtacctttctcaggtaggatttatcttatttgtagctactaaattttacatggctttgtctcattcaaatattactgtcactagatttttaactctttaccattaaaggtaagttattttctatagtgaccacaaactcctttttcattgttgggctctcagatctttccaagcttttattgaatgaatagtttttattcaagcttgtttttttttccttgtgattaatttgcttttctacattaattagtgggtattcatattcagagaatgcaaactacctttaacattctaaataagtcatttaatattattctaagcaattagtaagataagtaaaactactgcaaatcaaaggatagaatccatttaagaccactttggaattatatgggctcctactttttcagttattaaaaataaacatctccccattaaatgattatcctgtaaaagactattacaaatcaagtagggaattgtactgattactc

SEQ ID NO: 125986 - DNA, 1075 bp, Homo sapiens
tgtgcctcagaggtaagaacagaattatatttgtgagggaccttagaatccagcttactcctgtgtccaaaagttgtgcccatgttagagcattcatgaccatcatacaactattgcttgaatatagtgattggaaatttattattttatcagacagcttggttaatttctggatagtagtttatgtagaatttgagacaaataatgatgtatttttataagataggcaaaattcgcaattccttagattttataggtttataaagataatggcattgcaaccatattttaagtggcagaaaacacgtgtttggactgtgagaaaattggctcagatataaagccactgtgttgaattcagagtggtgagatggaatgaacagccctggtattttagatgaatgaaaggatagattgattgtaggaagatgctgaaaaggtaatttcctatacattaaagaaagccataaaagcagaaggaaacactcagacctaagtattacaaaattcacagctttgtatttttacatactgttgggcagagaagacaattttggcaacagttagtccagtaagtgggaagaagttggtattagagaaagttgtactacattaggtggaatgtgacaaatggctagactgagcagtacagtacagatacagaaaaagagacaaagcatagcattatgtacattgagaatgacatttaaaaaaaaattctagttttgtctgaatttcccttgcataccacagatttttcttctggtcaaatagagaagatatgcgtccatgttcccttctctaaatgggttttcgtcttttatcttccttcttcattccctcagataacttaaaagaagttatttttgtgtccttttttttttttttttttgagactgggtcttactctgtcacccaggctggagtgtagtagtgtgatcatagctcactgcagccttgacctcctgggctcaggtgatcttcccacttcagcctcctgagtagctgggactacaggcacgtgccatcacacccagctgatttttaaaatttttttgtagagatggaggctcac

SEQ ID NO: 125987 - DNA, 1061 bp, Homo sapiens
caggtgtgagccaccacgcctggccggtgattatttttgaatagtaagttcataagttatttttatactgttctgtattatctgactttttaaaactttttatgtttttatgttgcttttctcatcaaatttttgtaagataaaacttattaaggttatgtgtttttattttacatctgtacaacaactactggtatacaataaagggctgtatttgctgatacctctgtactctattggggaggtttttttagtagtgtgtatgaggctgagttcacagactcagacttagtggtcacctgctttcattctgtcagtatctgtttggttaattctctcttagttgtcttactaatgtgatgctgctcacccagcttagctgaaggatgttatcatttttgaaagatcagaggatgtgctctaattttatgttttctttttaacaggtttttatttaattagttaaaaatatggatcctgagacaaggggacaagagattatcaaagtgacacctcttcaacaaatgcttgcctcatgtactggagctatactgacatcagtaataggtaaaattatgttactgatgtagattatgtaactttgaatgagtcagtgcttccatttgagttttagtatcagtatttcaacgtagtttctttctattttccataagtattggctggctgagaaataaagagtacaaagagaggaattttacagctgggcctccgggggtgacatcacatattggtaggaccgtgattgcccacctgagctgcaaaactagcaagttttattaaggatttcaaaaggggagggggtgtaagaacagggagtaaggtcacaagatcacatgcttcaaagggtaaaaaggagaacaaaaatcacatgcttctgaggaaacaggacaagggcaaaatcacagactcctgataagggtccagcaaagatcacaaggcaaagggcaaaagcagaattactgataagggtctatgttcagcagtgcacgttttgtcttgataaacatcttaaacaacagaaaagagggtttgagagcaga

SEQ ID NO: 125988 - DNA, 1050 bp, Homo sapiens
gggcaaatgttaacctttctggctgggcacggtggctcaagcctataatcccagcactttgggaggccgaggtggcggatcacgaggtcagaagttggagaccagcctggccaacatggtgaaactctggctgtactaacaatacaaaaattagctgggcatggtggtccccgcctgtaaccccagctactcaggaggctgaggcaggagaatcacttgaacccagaaggcggaggttgcagtgagcggaaattgcgccactgcactccagcgtgggcaacagagcgagactccctctcaaaaaaaaaaaaaaaaaaaaagttaacctttctatgctagaatttacttatctataaatgaagataatattgttcagtctactccacaactttttgtgattatcagagacctaatctgatctttcagattacctcacacatacccaaatataaattttttgttctagaatctagacaaattaattttgtagtacttatcactttttttttctttcttttgcctaagcctcttcacctggctcagcaattattttttcctgtccatagcaaacctagcttagattcatcctttatctcctgctcatttgggtataatcattcctgtttgattcatttgccaactattgatatgtcgtcttctgaaatgtgttctgatctatttttattaattttcacatttcatagtctcactatcctggtgaattggagggcttaaggttatatgtaaggttaaattcttagttttgcaggctaagtgcatgaaaggataggattggttagtggctgtggaactgtagttaatgtctcaggtgactgtgggctgggaaaccagggtaaattcagcattatcaggcccttgaagacatcctaagtgtgttcactttaaattacaggcgcctgccaccatgcccagctaatttttgtatttttagtagagacagggtttcactgtgttggccaggctggtcttgaactcctgacctcagatgatccgccagcctcgacctcccaaagtgctaggattacaagc

SEQ ID NO: 125989 - DNA, 1154 bp, Homo sapiens
cagacaaactttatatgaaactaaaacttgagcagtctgaaacccttgaggactaggttattctgcgtaacagaggattctttcatcgctaaatgaagtttaaacaccagttttgaatgttcagcagaatggcagatgctcaataaatagttgagtattaaatatccccatggagtttacatcctaaaaaaagaaaatctttcaaaagagttttatatagttccgtgcctcaggaataaacacacgaatatttcttgctgagtcaactattattttacaatatgcggtctgtgaaagtatatagggcattttgcctctatcctaagtagtactacaaagaaatacatttcaatgctaataacttaaactggtagggttgtaaggatttttattctgtaatattgtataatgaaatattttaaaaatagtaaaagtgtctgtgtaaaacatctgattctaaacatctttaataggtggaatccaagtcaaaaatgaaaaaaacagaccatctctgaaatctctgaaaactgataacaggccagaaaaatccaaatgtaagccactttggggaaaagtattttaccttgacttaccttctgtcaccatatctgaaaaacttcaaaaggacattaaggatctgggaggggtaagtgaaaaccgtacactggcatagaaggaaaaatttgtaactagtactttctactgtgtaatcatttaaatttttcattttggaaaacgcttctattagcaccaagcttaacatttttatcagctgtttatcgttaacaaaaaaccatttgttttaaccttttgtggactgacagacctttcaggtttctctgattagcagtctagtgtaaagttcttagagtgtaagactcccctgtcctagtggaactgctcattgactgcttactgtaatgttggaatgtcctccagataacagcaatttcttgattatgaatcttggggagctacataagtttgtctggactagtgtaacagttaagaatgttactacagaacagccatgcaaaccacagttaaaattgttcctgagtgatacagatgttgtttcaacagaatgaatgttattaaaggaaaagaaatttgcattaagaatctggaataccttctttcctaccttatacact

SEQ ID NO: 125990 - DNA, 1993 bp, Homo sapiens
atcctcaggtcctggtttctgtcttcagcacatttactgtttctatcactaaaaaagattttgtcataacgatcttctacatgagttaatttatcttcacatcattactttaggtgcctttttaattcaccatttcacgtactttggtttctataatctcggtgaaaacatcttaatatcccatttatctgcagagtatgcttctgacaaatttaaccactgagagcacagcacccagattctgatataaaggggaaatacctttaatagtgcaagaaaagtaggtgttacagaaccatctaaggaggacatgggatcagccacagttaggtccatgtctaaatagttttggctaaaataaggcaattggagaggaacagaaatgtaggccgataccttggcgtattagcttgaactgtaaaatgtttgatgttcgtcatgatcaccttgagtcatcagaaaatacgttttgagtttactctttaaatggcatagattcaacaatatctaatacattgaagaccctggtaaaattgattcaacaaatgtttgagtatgatgtgcactgcactctgtgttttggtagattcaaaaatgaatccagccaggctcggaggctcacgcatgtaatcctagcactttgggaggctgagttaggcggatcacttgaggtcaggagtttgagaccagcctggccaacatggtgaaaccccatctctactaaaaatacaaaaatttagctgggcatggtggcgcacacttgtaatcccagctactggggaggctgaggcaggagaatctcttgaacctgggggttggaggttgcagtgagccaagattgtgccactgcactccacctgggcaacagagcgagactgtgtctcaaaagaaaaataaaataaaaaatgaatccttatgtccatcccatcctcatgttctaacctagctagagatgacattggtacaagtaattgtgttaataatacaacatagaatgtcaagagaaaggagagattagttccagctgaggaattgtgggttttgttcacacacaactggaacacggctttgaagaatgatgaagatttgggcatgtgggaattcattcaaaaattattccaccactgtctccagtatatcagcactattttagatcctagagatacaaaaataagtaaaatataaccctctaggtattctttgtctagtggaaacctcagacaactgaataatttatgttagagtgttgtcaatgctttgacagaaatatgtagaaattgctattagaacacagagataggaatgattaactctgccgtttggaatcaacagagataaagtttgagctggatcttgaagtcttagttagcaaggcaaatagacatactaaatagaggaaagcatatttaaaatatatgtcaatgcagtttgtttgtacaactactaatgttgcagtgggatttgagcttaggatataggtgggggaagtgacagcaaacaaaattatattagggctagattgcaaagggcgttttattcactctaaggagttttaactatgtaagaaattaaaaaccaaaggaaataagtggtactaacataagaacagacatacagaccaatagagtagaacagagaacccagaaataaacccttgcatatatggctaatggattttcaagaagggtgccaagaccattcattggggaaaagatgatcttttcaacagctggtgctgggaaaactggatatctacatgcagaaaaatgaagttggacctttactgtcatatgcgtaaatgagctcaaaatggatctaagatttatttgtaagaactgaaactcttagtggaaaatatagggagagatcttcatgacattggatttggcagtgatttcttggatatgataccaaaatcatgtgcaacaaatgaaaagtatgaaattggacttcatcaggattaagaacttttgtgcctcaaaggacattttca

SEQ ID NO: 125991 - DNA, 1057 bp, Homo sapiens
caaacattttagtaaagaaattctattcaaacagtcttacactcttaagcgtaaaggttccctccatcctgtaagttgaagcctcaagggaaggtgtaataatgattgatttagacttgtattgtctgctatggtaaccattagtgatatgtggctattaaatttaaagtctttaaaatcaaatttaaaaatcagtggcttgagctaggcgcagtagtgtgtgcctgtactctcaggtacttgggaggttgaggtaggaggctctcttgagcccaagagttcagggccaacctgggcaacataacaagaccccatctcttaagaaacaaaaaattcagtggcttaatcacactaccaaggccatttcaaatgctttggtaagttgtattggacactgctgctttagatcatgggcttgagtcagaatgcctatgttcaaattatattatttgctactgggtaacattaagcaagtcacctctcttcactttttatcctgcagaaaatgtagatagtatcatgaggctgttccatagattaagttaattaacatatataaagtatttaagaatagtatccagcacatgctgctgttgtgctgttataggagctcttatacttcctcagagatctaggttcagaaaaatacagtataaaaaccaccaatttacgaaataattgcatcaaattgaaattttttactgtgcttggcatatgaaacagtttatggtttttatgacctagttgaaaataccttggtggcatgtgcctatagtcccagctgttcagaaggccaaggcgggaggatcacttgagaacagggggttgaggctgcagtgagctatgattgtgccactgcactctagcctggataacacagtgagaccgtgtttcttaaaacaaatttataaataaaaatactttgttctcttctagcgagttgaagaatttctcagcaaagatatcagttatcttatttcaaataagaaggaagctaaatttgcacaaaccttgggtcgaatttctcctgtaccaagtccagaatctgcatatactg

SEQ ID NO: 125992 - DNA, 1855 bp, Homo sapiens
gtacaacctgcaggttaagcatggtttttacattttcaaatagttgtgtaaaaatatcaaaagaatattttgtgacaagtagaaattttatgacattcagatttcattgtcataatgttttattggaacacagccatacctgtttgtttaggtataatctgtagttgttgtgttttaggcagaattgaatagttgctgtagagaccatatggccaacaaagcttaaaatgtgtactgtctggtcctttgcataaaaaggttgccagcccctattctagaattattgaaatcacatccctaccactccatggccagtaaattgaaagatgcaaggaaagacaaattaaattgatttaattgggtgtgaggtgggataggatcaaatgagagataaaatgtttatttcagtttttaggttgaagtgtaattaagttattattttacaatattctcctcgacttacctattatagccatttgaaaattaaggaaaatgaggagaaaacagaagaaatgagtcagaaaggagctatcacttgaaaaaagagatacaatacatagaagaaagaatggaaaagagatcaagaaaggaccatgcattctctgagttaatgcttttttggagcaaggagacaatacaccagcgattccaaaataattgttggttatggcatttcaacgagttttcctagtactttatttaaaaagtgaagtaacggctgggtgcggtggctcacgcctgtaatcccagcactttgggaggctgaggtgggtgaatcacgaggtcaggagttcaagaccagcctggccaacatagtgaaaccacatctctacttaaaaaaaatacaaaaattagccgggcatgatggtgcgtgcctgtagtcccagctacttgggaggctggggcaggagaatcacttgaacccgggaggcagaggttgcaatgagctgagatcacaccactgtactctagcttgagcgacacagcaagactttgtctccaaaaaaaaaaaaaaaaaaaaaaaggtgaaataacatgtgaaaacagtatataaaatttattgtttttctgaaatctctgatttaataggaactaaaatgtaagccaattaattataaagaattccagtgaaacctagctattttatttttcatgttgaatagaatttactacaaaaccaaagaggtcacccaaaaaagagaaactttttaatatgagacccaaaagttctcttttcttagctgctttacctttttaacctgttctccagttaagcactatgttttaaatttttctggtctttttataggtgtgtttaagcagaggaaaattattagttgaaaaagctatcaaggaccatgtaagtaggaactataaagattcacattgtacattttgttattaaaaactcaactggaaattacagatattcttgaaattttcctttccacatttttaggcaaaaacctgaatctcagcatatattttattttacaaagtaaagaacttacttttcatgtagaaacatccccatcttgtggccttttaaaatattactggaaacttaaaacttgccttatagttttcattaaattaccaaggatgtgggtataaagtgggattgattttaggaattctatagaaaatcttgatgtcctagctattgtaactctatagggtctgttacaaataactgccttagtgacattaaacttcaaataattgaatttttattaaaatttagctcatcttaaataatttcctagaacaaccataaaacttttttttttacaggattttattccttcaaatagtatattatcaaatgccttgtcatggggagtaaaaattcttc

SEQ ID NO: 125993 - DNA, 1808 bp, Homo sapiens
tctctttttataaagatatcaggtccactcccatgataacccattaatccatgaattccctcttaaaggtcccatctctcagtaagtactgtcacactgggggttaaatttcaacatgagttttagaggagacaaacattcagaccatagcataagagatacctataatggtaaattctttatctaatttaactacaagaaaatatcactgtttaactccaagagtaaaattgctaatcttaaaaccttctttcttttaataaagacattagatactacattgaacaaaagaaaaaagagttgtatttactcaagaaatcaagtacttcagtaagagatggggtatgttttctttttcaatttttaaagtgaccaagcttggtttttttacttacgtatttgcaaagttttcctcccaagcagaaaatatcctaggggcaagcctgtgtatgatgtgcctgtttctgttattcaaataaatcgagtgtcatttaactttagggttgtactcaccaggtaaaagttgttcctggaatagtggcataggtcgcttcctcagcccccttttgttactgctgttttgtaacaggtacttttatttattctgtagaaaaatcactaaaatcagcctgttgtataaacgttcctaatgtaagtaatgtacttctttttggaatataaatatgtactatccttttcaactgctctaaatggtataacaaaatctcgttttagcatagctaactggcctgaccttgaaatacttgttaaacaaccacattggttgttaacgttctgttaaacctaatgttcccattatcttcagtccctttccttttccttgttgcttctttgaagcatctatacagtttcaggctttttccatcctttaaaacaaatacagtaaaacctcccttgatcccacatccctacctacctattatctaatccttgtaattcctcatccaaagttctcagatctctacttttatacttcccattcacttttcaacctacaaggtataaaacttctgaccagttttccaaatcattttgatactttttaaacccagtcatattggttctctcagctgttgtccatttcttccttaaacttttctattctcttctgaaatttcatctcttagctttctcctgatctcttcatatttctcagaccattcttttgtggcctacttttcctttgttcaatatttaaatgacagggatctaaaaataataaactgataagagtgtatatagagacatgaagccatagtaggatggcatattttagaaatcttgtatagcataatacagcctgatctttgagtgtgccagtgacaaaagataaagctggaaaaaccagcatgttaagattataaagtaccttgccctatataaaggagttagattttatcttggagagtttggaaaattatggaaagattataaatagagtaacctgattggatagtcattttggaaagatcttctggttgacagtaaagaatgaattatttggcaagactgaaaaatggcttttgaactcttgaacaattttttttttttttttttgaggcaggccctccccctctgtcatccaggctggagtacagtggtgccatctcagctcactgcaacctcctcctcccgggctcaagcgatcctcccacctcagcctcccaagtagctgggactacaggcatgagccaccgtacctggctagtttttgtattttttgtagagacggggtttcgccatgttgcccaggctggtctcgaactcctgagctcaagctatccacc

SEQ ID NO: 125994 - DNA, 2700 bp, Homo sapiens
tcatcttaagtgtgtttacctttacttttaaagtctttttctaataattacaatatcaggaacatgttggggttggcatctgattgtccttttctctcaaaaattgataatgtttttctggttgtttacatgtgaaatttaagttttgactgtatactggacattctaaatgttgtgtaggccctatatcctgatagtctgtaggatgctgattttgtttctgccattgttttagcggacagtcatcccagttttgttcagactgttctgtcttggtggttgtgggtggggtggatctaatctcagtttcaattttcaaagcccttgctatgctgcgttgggtctatccttagcatgtgcaacttggaggtaagccctgcacttgcatggatttatatagggaattagggatccctttctctaacttgctcttttcatggatcaatctccagcttgcagtggcctctttcccaggtcttctagtcagaaagtgagggtttctcaatgttagcttaagcttgtactacctttacaatctcagcctcctaattgggacccaccctcagggcagaactgtgggagaaaagaaaataatacagggattctcttggtatttttggccacttgaacctcattcctggttcttcctgccagaaagataggagttttagctgctggctctgccactgctgctaactccatgactgaaggttccagttttgacttccttccacaatctgcctgcttattttacttttcattcttcaggtagttgcttattcagtgttgtccagagtttctagttgtaatcagtggagttgattatccatctttaacatattgaatctttgcctaaattgactgactaataaatgttgactaatttctttattcaatttaatacaaagattttgctgaataagggcataaaaataatatgacttttaaaaaaacatttcattaactaccttttcattattggttttctttttatgaagtcaaaatcaattatagctagaatgcaaggtacttgctgagtgtattgtaaaacatttaaaaacaatagttttttttaacaaagaataatccttctttgatatagcacttttctgcatgatttttttatcttgaagatactgagcaattgcagttgctgttttaactgtactttcaaagccaatcttttcactatatatttttttttagggcaaaagagttggtagtggtgcacaaaaaacaagaagtaagtattttgtgatctttaagtgtatttggtttgcatttgaaaaatcataaaagatcttctaaaatcatataaaccaccctctaaatgatttattcaaggctttcttcgtctttatagaacatagatccttggtgaagtttggtgaagcctgtggaccgcattttcagaatgatgttttttttaaaacgtttcctttaaaaatcattagtctaccaagaaaatgaattatattaaaatgtagttaccaaaatagtttttaattgtgaaatagtgataacttgctttttattacacagaacagattctagcagtgaatctaattgccacttcattttgaattgataagcgtaaacaatgctttgagatatctgctcaagcagttcataactgatgaaaatatgtgcagtttctattagcatcaaagtcgcaggtactgcgaatagtgtgatttgttacatttataattgaaggaaatgctaaatttcagtttgaggttagtgaagacaatagtgtagtttttctcctgttctaatttatgaccttcctgaatcctgttaatttgagggttccatttagtttaagaatctcagaatataggagagagcttctgttatttttggaaatgaggtgataatggaagtacctcatctgaggcttaaaactttaaagtggatacatagttttttgtttggagggttttgttttgccacagtagttttattaaaaaaaaaaaagaatcctgaatttgcaagtatctaatatgttttctatgttctcaagcaggaagactcaaaaagccttttgtaaaggtggaagatatgagccagtaagtatttaagtccaatctgtatgatttaagtgcaatactaaagaggaaaatcacctaactaattaggctagctcgattagtactgttaggttcctttgtgtttgatttatattatactaatgtgcatgcggcacaagttaacgaaagtagcattaattcatttgtgctcaaggactgaatttagtttcagtatgttgtagatattcctgaaatagctggtttagaaaaatcatgacaccgtttttttagtatttaaattattctctggctaaatgcagtaccaaatgatttagaactactgaaagattacgccttcatttgcgaaaaagaaattattagatgctatttagaaacagaaaatctaagtataacatctaacatggttgatttccaaaattctgaagtattgtaggatagtcttgttgttgttgttgtttgttttgattttttgagatggagtcttgctctgtcacccaggctagagtgcagtggcacgatctcggctcactgcaacgtccaccccacccccggttcaagcaattctcctgcctcagcctcccaagtagctgggattatgggtctacgccaccatgcccagctgatgtttgtatttttagtagagatg

SEQ ID NO: 125995 - DNA, 1024 bp, Homo sapiens
gccctgcagtccatttgatgtagacaagccatctagtatgcaaaagcaaactcaggttaaactaaggttggtttgaatctttacttttagaaggaatattcagaatttcatctcaatttttctttgtaaagatttgaaatagtttcatttatgccataatggttatttgtgtttgtaattactattctgattacttttataagtctgaatctgtttagatggaggtggggagggccttaaaatatttgtgaataatgaaaatgtgtagtttatcttgaatgatctgaaatattctccagaatattcattaaatctttagtttgcttctcaatatagtataaagaaatatgattaaaagtacttgctgatacaagtctctgcaaattatgcagattgtgtgtgatagtttaggacaataaatttttaaagttattccttaggttcagcagttaattctttaccatgtatgtctgtcatcagaatccaaacagatggcgataagtatggtggaacctcaattcaactccagttgaaagagaagaagaaaaaaggatattgtgaatgttgcttgcagaaatatgaagatctagaaactgtaaatgtgattttatattttgggggcttgtttcgaaaactgtaatacttgtgttttaaattttagcttgttattctgatgcagatattttacattttaagaactcaagggaggaaatgagtattgaaaatgaatttttattcagcaaatactgagcgtctactacatactgatcactactctgggcaaacagcattgaacaaaacagacttaattttttaccgttgtgaagattatattctgtagggtaggggtgggataggggtggagataggtaaccacaggataaaagaagaataaaaatatagagagagaatattagatcagtgctatgaaaaaatagaacataggaatggggatgttgctatttagcctagacaaggaacacataactgataaggtgacatttgagtagagacctgagagaaa

SEQ ID NO: 125996 - DNA, 1126 bp, Homo sapiens
ggaaaatggtagtcaagggttactatagtattttgaaccttagcaattaaaaagtgggcttattatttataatgggaagagaagagttgaaagaagtaaagaccattgaggtagcagaaagaaatgggagagttgcaaagggtatataggatgaaaatgggggaactattatagtttgtaaactgatgagcaagagctatggattcaggctgccaggtttgaatcctggctccctggctgtgtgagcttggacagtgtttggcacatagtaagtgcttattgttagctgttatttgaataattttttacgtaatagataggtttgttttggtgtttggttcggttttggtagaagatggtgggaaagttaaggggaaagaataatactggaacatatctgtcttcagactctgaattgaagtttgttttataaaccaaaatatattagtgttttgtgtcagtttttttgtttttatgtaataaacaagaaaactatgattagtctaaaattgcttttaatcagaagctaaagtatctcagaaatatttccccttcctgaaaataattttgaaaattaaaattacagattggtcctgaagttttactttgctggtgtagcaacaaaataatctggaatggatgcttaatttggttctcagaaaatgtcgaggctaaaaaatgaaaaaattgttcagtggttgccacaaagaagaaaattagtgaaagcagatgttgagattagaggttgggattgaaatttaaggtcatgtttttacagttttcatttatatgtttcttagttgctaagagtaaagacattttttttttgaatgttaggtttcataatgattcaattccacttgtatcaagggattaattaacacatatttttgagtactggggagaaagcaacagataaggcggacatccctacccttatgcaccttatggtctggcagtgtagatagatagaaaatatgtatttgcaagtgtgatgagtttcacaaaagtaaagtatgaagtgcaatgggaataaataatgaggttatttaacctagaatgagggtctcaaaaggcccaactgaacacaggtgacgctttaaattaagacttataaggatgagta

SEQ ID NO: 125997 - DNA, 4483 bp, Homo sapiens
gtatctaagttagtttttgactttgtggaatatgaaaaggacacacctaaaaagaaaaggtaattagttttatcaacctaagttttaaattctactaggcggccaggggtggtggctcatgcctgtaatcccagcactttgggaggctgaggcagttggatcacttgaggtcaggagttcgagaccagcctagccaacatggcaaaaccccatctctactaaaaaaataaaaaattagccgggtgtggtggttgcacacctgtaatcccagctactcgggaggctgaggcagaagaatcacttgaaacccaggaggcagaggttgcagtgagccaagattgcaccactgcactccagcctgggtgacagtgagactccgtctcaaaaataaataaataaattatactagaatattaaactattaaactaaaaataaacacagttttcctgttcttagaaggaatatgtattttcgggatgtaaatatggttaaaaaccagtagcttcttccctactatcaaagatccttaccttagactacttttagttccattctttttaaattttctttttatgtaaaacttttccttttttaaattttttgttttattttgagacagtctcgccctatcacccaggccggagtgcagttgcataatcttggctcactgcaacctctgcctcccaggtacaaaagattctcatgcctcagcctcctgagtagttgggattacaggcgtgtgccactacaccccactaattagtctcattcttgacactgtagtttagaaggagttggctgacttttcctgtaaagagccagatagttgatattttaggttttgtgagccgtaagatctctgttgcaactaattagcttagcttttttgtacaatggatatgactgtattttgacgcaattttatttggaaaaatagactgacggctagattttgcccacaggctatatagtgtatcagctcctgttgtagaaccataaagtttaccatttactcagactaaaacattttattgaacttttaggtaatattaaggagttttaagaaaacttcctccacttgccccttaggtctttatatttcactaaatatctttgcctaaaccttatgatgggtatgtttactaaaggtactgacaggacttttaagtgtgaatacagtactgctcaatgtacaccaactgcacattgacaaaaattgtcctgattagattattcctataaacttaaagggatggtttcatatggatataccctagaggtggtgataactcattaagttagtctttattcttagactaatcttacttaagacataaagaagattagaaatgtgataacaagatacagcttctgaaaattaaccagaaagtttttttacttcaggtaaaacagttcttaaattccatatttctgtgacattcagaatggtttcatgactgacttaatatggatttgaagagaaggcatatttccaactattaaaactatgtgggctactgtgcccaggcagggtgtctcacacctgtggtcccagcacttcgaaaggccgaggcgggcagatcacttgaggccaggagttccagaccagcctagccaacgtggtgaaagcccatctccactgaaaaaaaaaaaaaattaggtggtggcacatgcctgtagtcccaactacttaggaggctgaggcgcaagaatcacttgaacccgagaagcagaggttgcagtgagctgagatcaggccactgcactccagcctggttgacagagagactctgtctcaaaaaaaaacaaaaaacaaaaaaactatgtgggctactctaagaacttataattccctaaaaactcagtctgcagcaaaattctgagctagtactggttgttccttaattgtcacttctgtgggcaagtgtcctaaacatcttggacttaaaagccatgttagagtagtttttttttttttttttacatttttttattgcccatttgttcaaagagaattgtttgtaagtaaatgtatgaacaagataaaaaagaacattctggttgaaggggcaggaaaaattgtattatttctcacagttaatctgtgacatgcggaacacaaaatgtaattggtgagctattaactttttctctaattgtatattatttaggtttgtctaatacaaactggaatttcagggatatcaagatgctccatgaagaaaataattttaggtcaaatatgtttgaagcttaaaagttacaactttgtcacctttgaaagtataaagatactaagtttctagctcactttgatattaaatattcttaaatgtaaatttaaaatatatgtttttgccataggtttctcagtaaatacttattctccacattgctaagtaaaatgaagagtaaaatgtgcattaatgtaaatcaaagcacagaagttaagaaattgttcagaataatgaaagcaaaattaggggcaggctcaaatccctttactatcaatttctttcatttacatgattaaagtaattttaaatgtcaaaattcaggatattggttatctgggagggaggcagggaatgtagaggagaagagaggtacactagggttttcagctatatctgaaaagttgtattactttaaaaacagctcaagtaaatttggcaaaatgttaagatgtttgtatttttgtaaaatttcctaagttaaataggtttcttaaagattatataatgtttttactaatttaatttctaactactcaggaatttgttttgatagcaattattttaatatttttcttctatttttcctacaaagaataaaatacagtgttggatccctttctcctgtttctgcaagtgtcctgaaaaagactgaacaaaaggaaaaagtggaattgcaacatatttctcagaaagattgccaggaagatgatacaacagtgaaggagcagaatttcctgtataaagagacccaggaaactgaaaaaaagctcctgtttatttcagagcccatcccccacccttcaaatgaattgagagggcttaatgagaaaatgagtaataaatgttccatgttaagtacagctgaagatgacataagacagaattttacacagctacctctacataaaaacaaacaggaatgcattcttgacatttccgaacacacattaagtgaaaatgacttagaagaactaagggtagatcactataaatgtaacatacaggcatctgtacatgtttctgatttcagtacagataatagtggatctcaaccaaaacagaagtcagatactgtgctttttccagcaaaggatctcaaggaaaaggaccttcattcaatatttactcatgattctggtctgataacaataaacagttcacaagagcacctaactgttcaggcaaaggctccattccatactcctcctgaggaacccaatgaatgtgacttcaagaatatggatagtttaccttctggtaaaatacatcgaaaagtgaaaataatattaggacgaaatagaaaagaaaatctggaaccaaatgctgaatttgataaaagaactgaatttattacacaagaagaaaacagaatttgtagttcaccggtacagtctttactagacttgtttcagactagtgaagagaaatcagaatttttgggtttcacaagctacacagaaaagagtggtatatgcaatgttttagatatttgggaagaggaaaattcagataatctgttaacagcgtttttctcgtccccttcaacttctacatttactggcttttagaatttaaaaaatgcatacttttcagaagtgataaggatcatattcttgaaatttttataaatatgtatggaaattcttaggatttttttaccagctttgtttacagacccaaatgtaaatattaaaaataaatatttgcaattttctacagaattgaatacctgttaaagaaaaattacagaataaacttgtgactggtcttgttttacattatatatatgttcgtaattgtttcctgagaattacaatgaataataatttgctttgtcactgaaaaccaccagtgaagtgcaatttggggaatatcaaacttagcattatacatttggatattctagttgtattgtaaattttaaaagattatcaggataacatgaccttgccttgaaaaacctaaatttcatacagaaaggaaaaatacatttctatgcttgaattctggaaatcatcagaaatattgacacttgagggtcactggtggaccatgctagtattttggtgctgagtaattagattatgtataggggtaactggaagccatgaaggaaggacttaaccaggctaccaagtggaatataatttatctgctatttttaattacttaccttgtaaataactttaataatattcaaaagttgactctcctgtggctcatgccacaggatcccagcactttg

SEQ ID NO: 125998 - DNA, 1013 bp, Homo sapiens
tgcaattagtttatttatttattttttgtgacagggtctcactctgtcacccagacaggagtgcagtagcacgattatggctcacagcagccttgacctcttgggccccagtgatccttccacctcagcttcctgagtagcttggattacaggcatgtgccaccttatctggctaattaaaaatttgtttttgtaaagatgggatttcaccatgttgcgcaggctggccttgaactcctgggctcaaatcatctgctggcctcggcctcccaaaatgctgggattacaggtgtgagttgtgggggcctagcctgtttttctgttttctaaaaggtcttttaatgtgtggttctttcccctctatttcttttttttccccttgcaattttttcagtgaagacatggagtctttcatcttgtagagttgctcagagtcaagattttgctgttgtagccagtgctttaaaacaattcacaaagactttctaggagaggaagagagactgagggaagaagagatacagaaaaagaaaatgacaggattgaacctggaaactcacagaatctctgactcatgctggaaatgtctttgggtacctcttgccttttctgtgttggtgaaagaccaccacttttgaaaagtggaggaggtcagtcctccttttctccccatttatggagcaccacttgtgcagttttttgattcacaggagtcttgacttggggtggaaagctattttgggttcatagagcttctactccctatagcaataaacatcacaatagagaagaatgactggtttttggtgaagtatgaatgaattggtaggatttaggtttaaaagtatgaatagatgattaattcaagtcagaaatgaaagcaatgataccatcttatagtaattattacaaaacgttatcccagtgcctgggatatgtgtacatagtaaggtacacatagtacatgttgatgtctctatcacttgggagccactgcactttaccatgctgct

SEQ ID NO: 125999 - DNA, 1524 bp, Homo sapiens
aatgttgctggagtcagatttcttacatttaccccattggaactatatatgacttttagtgcctgaaaaatatatacattttaaagttagacaatagtgaagaagcttgcagagcacaacaggaatgtttcatttttattatcttgaaaatgaaaatggaatttgtgaggatatctgacatttaaatggtgaaaaacacctcttgaaggacacgtgtcctatttgtttgtagatatgtacactctctgttacactcgttcatcgtaagtcacatattagtattcagcaatcaacaccaaaattgtatatgcctttttgtggtcaaagtttcataggtagaaacattaattgctaagcagggatccatattcatatatttttctccaaaagaaaaaatacaaagtatcttttatgccttcatagaactagcagtaccagagtcccaaacgtgatatcattcaggtaaaagagatatgtaatcaataataacaaaaaatgatagcttctgaaaacatgtagttgaatgtgtttactttgataataaaagcacttgcaagcaaacattgggggaaatagttgaaaaaataaggattagtatttattaacttaaataaatataaacatttataatatataagtataaatatataatatatacaaaatataaataatatataactttttttgtcatgtaccaggcattgtattgagtgatttacatgcattatctctcattatgaggtagatactgttatacccatttgaagatgaggaaactgaagttaattaacctgcctaaggttatacaggtaataagtggtagaagtgggaataggattctcaaaatgttagacatcaacataaaataatcttttataatctttactacttatttgacatgtggtttcccatttatctctgtgttggaacatacctaacgttatttcttggtctggcccaggtctcctccctagctaacttgcagttattttacatataattaaaatagagtacaacatgctgtattttttaaaatagaaatattttatataaaaatgatttttgacttctggctatcctttacttttgattttatcattagagttccttttaaaatagaagtttgttttgtttcccccaggacagactgttctctgtaacttgattttgaaaataaaattgaaaattttgtaccatgatccagaaatatcagcggttctaactggaaagagaaggaataaagaacgtaaatcattctcccctacccctaaatatgcttgttatttgtgttgaagagattttcagaatcatgtatcagcgaggttaaatgaacatttttcttctcctttttaaaatttaattttgtactaggggattttagcacttagcaataattgcccttttgttgcattttttgtctcaagtaaagattgttagataactctttgaagatgagaaatcgatggtgcttttctgcagataggccttgagagctcacattttgcaagtgattttaaaattttc

SEQ ID NO: 126000 - DNA, 1038 bp, Homo sapiens
ccacacagatgtggcgggaggccattatattaagtgaattaatacaggaacagaaaaccaaatactgtatattctcacatataagtgggagctaaacattggatactcatggacatcaaaatggcaatggtagatactggggactaagagagaggaagggaaggagaggggcaagggttgaaaaactaactgctgggtactatgctcagcatctgcgtgataggatcattcatatcccaaatctcagcatcactcaatataccaatgtaacaaacctgcacatgtatcccttgaatctaaaataaaagttgaaattataaaaaaaagattatgaaagctttgattcagggctacaaaaatgttctcactttttatgatcctgtatagctggtttagctgtaaatagtacatagctttttttctgaattatttcctcgtgaaagtaccttctaacttggacagatattgagtgataagaagataggggaaattcaagaagtgttcattcctgtcaccaaaggtgaagccattctggctaggtaagttactagaggtaagactatgtcaaaccacagtgtatagcagttttcattgactctcagaatcctctaaagtaaaaaaaaaaaaagtggtggggagaggatattggtgccgagatactaagaattttcacttaatttaatttctgagacaagtttagcatgatgttcttatagttcttaataatcttgaatagacaatgttctctcatagttaacgagggaaaagtactatttattcataatcaatttaatatgacatctacttgcggtctttgatgagtgttttgggtgttttcttaagtgttctgattatgaaatgatgaactttgcagttattgtagggttatggaataaaaattattttaatttaattacacgcaataacatggaatgaaggcatggaccctcatcttcatttgtatttctttccatcgttgagcacagacagagccttgtacataacaggtgctcaacaagcaaatattgactgaatgaa

SEQ ID NO: 126001 - DNA, 1150 bp, Homo sapiens
atatagttttaaataaaagtttgtcattctgaattcattgttttttcctttctgtttggactcttctcttttaattattgtgctgtttttggtaccattgtagagtagttgtgatcttaaaattttcagcttcttattaatctgggcccagcattagatgtagccttcagatcaatggaaagaactgaagaacttccatgttcttgcagtggattcccatatttaataaatattttaatacttatcaatcaaccatgtgtttctgaatttctaacagttttaaacagtctttccaaaatctgttattctgaagttaattgtttgtgttatttctctttttcaagaaataattaggttagaagaagtccatatgctttcattttaagcatcatatgttcactgatgaaagtattcagtgttcaggaagaagagagctccaagtgcagatagtattgttgctgctggtggtagtggggtgtgtgtgtgtgtgtgtgtgtctgtgtgtgtgtgtgtagagtattctgcatctcatctccataaggccattgggtcactcttcgtccttatatttcacttgacaagaagagaaacagttatacttttctctgaaccttctggcccttgtgcagttgggtatttcagttatgttagagctattaatcatgcctttttatagctcctcttctctgcagtatgttttcactagaactagagattcttgatttctctttttatcattctatctttgaataatgagggaactgaggggattggcaaatatttaatagactttggttcttgttccttttcttacaaagtttaaacttgccagctctgcaattaaaatttttccattggttctatttcaggttaaggctcagtagctgttttgagtaactaacactaatgcagtttgtgtgtgtgttgcaatttcctgtgatttgatttgtgaactgacatccttttaactcactccaaaaacatttattgaggtcctactatgtggcactgttctgtgcctttgggatacatcagtgaataataaaaaaaattctttcttctgggcttatgttctagcacatagacaaaaatatagtaaatgatgcagtaatacattatatggtatgttcaaaggtgataagtactatgg

SEQ ID NO: 126002 - DNA, 1049 bp, Homo sapiens
aaatgacgagttaatgggtgcagcacaccaacatggcacatgtatacatatgtaacaaagctgcacgttgtgcacatgtaccctaaaacttaaagtataataataataaaattaaaaaaaaaaaaagagaaaccttgtctctactaaaaagaaaaaaatacaaaaaaattagccagccgtggtggcgggtgtctgtagtcccagctgctcgggaggctgaggcaggagaatggtgtgaacctgggaggcagagcttgcagtgagccgagatcgtgccactgccctccagcctgggcgacagagcgagactctgtctcaaaaaaaaaaaaaaagaaaaaaaataaaagaaaagaagcaccatatttcttctctttggcctatttatcagccagaaacatggggaaggtaggttcctgaatattggaagaccacagaaaatgcgaagaaaccaggctcacatttattttagtgaccaccactgcaagtttggtttgggtgagaagtcctgtgttttgggtttgatccttgaggcctcatgagtttcagccctgctgctgaaagtgtcttggttttagccaaactgtggaggaaagtgacattgaatactggtgcaatgaactcattggagctgcttttcaaaatgttcagagacagtgtcagtgatgctgtattagtttcctggtgcttctataacacattagcagaaacttcgttgcctgaaacaacaacaacttattgtcttacaactgtggaggtcagaagcctgaaataggtcttacaaggataagatgaagtattggcagtgctttgctccttttggaggccctaagggagattcattccttgccttttctagtttctagaggctgtctgcattccttggttcctgccctcttcctcttagcactctgatctctacttccaccatcataccttcttctctggttttaaccctgttgccttccacttataaggactcatgtaattagattgagcccatccagataatccaggataatctccccaagtcaaggtccttaacaatatct

SEQ ID NO: 126003 - DNA, 1035 bp, Homo sapiens
tctgagacacccttagacctccatcttccctggtcattctcgacagcatttctctgttttattaagtctgagaatactatgtttattttctaaacttatttttaatttaattgttcattttctgtctcctctactatcagataaactccacaggagcagaaacatgatcagttttcttcactactttgtcccccaaatctaaatagctcccagcacttggtaggctctcagaagaaggttattgaatgaatcaatctgtatatagtctaagaaagcttgccttatattaaaactatgttaacatactcctgttcctattactatcaataatgcaaacattcttactaagcagtagttaagcattctgtcaatggattttcttttgaatttaagtacatgagtttctcattgggacataactgagatcaataaaataagataccagatgtaaaatggagctgcaggaaaaagaattataattaatgcagacagtaaataccttgccaagaagaattttaacattacctcaatccaagctgtaatcatgataccaaggtgaataacacgtggcccttgtgtttttcaccacaaatttgcaacattaatatttctgattcaaaggaaattgaggtaagagctttaatagtcctacaataaggatggaggagggagaggttcattttaactgaaacatcatttctggtaagcagaggctcttcccaaaacacagttgttagcactctaggaaactcaaagagctttaggtagagggagtgatgttatccattgacatcacattaaaagcaactctgatggaaagagtgtctttctataagcagttaacttatagctgttcagttgttgttcatttatacatccaggggattgataacaaccttcgaatgaatcaggcaatcagaagatcaactaagtacctggtgctggtcaagtactgaggtcttgatgtgatattgacctgtagtgaggaggagatgaggaggctagacgaggttggaaaggcttcatggaagaggg

SEQ ID NO: 126004 - DNA, 1010 bp, Homo sapiens
agagagatgctaaatctgtcacattaaccgtatttcactaatgtaggcttaacttggaattttactaatatgatacaaggctaggtccagggttgaatccaggttcattaggcctgaaaatcatttaattttaagggatacttttaagaaaaaaatataaaattatgattacaaagttaagtatggagatatttataactaatgaaaaaagaagtaataacatttttaaaagctgacaagtaccacaaaaacctacatatataacataaataccacaaaaacctagaaatataacatttaaaaatgaattgcttgatacactactgtaatatttcattataatttatatgctgtggctgcatactttctaatcatttctcttaaggtaatagtcattttgaaatatcactgtctagcttttgaatgtgtttgctcttgcttttctagttcttttaatcacttcttttttcattagttataaatatatccatgcttaactttgtaattataattttatatttttttctcgacacatacactctcccaatactaaaccaggaagaagttgaatctctgaatagaccaataacaggatctgaaattgtggcaataatcaatagcttaccaaccaaaaagtgtccaggaccagatggattcacagccgaattctaccagaggtgcaaggaggaactggtaccattccttctgaaactattccaatcaacagaaaaagagggaatcctccctaactcattttatgaggccagcatcatcctgataccaaagctgggcagagacacaaccaaaaaagagaattgtagaccaatatccttgatgaacattgatgcaaaaatcctcagtaaaatactggcaaaccgaatccagcaacacatcaaaaagcttatccaccatgatcaagtgggcttcatccctgggatgcaaggctggttcaatgtatgcaaatcaataaatgtaatccagcatataaacagaaccaaagacaaaaacca

SEQ ID NO: 126005 - DNA, 1101 bp, Homo sapiens
tacaaaagaagtagtctttgctgtatatagaaatcaggcatcataatttttcactaatttttttgaaatgccttttaaaatcatagttaaaatagtgtattcaaacttcaccaaatatgctattctaataaaaaaaagtgcatttatattgattttatttttgacaggagtgcactttgaattttgattaggtgtctgtgataatggaattctctgcttattattttagacatctggtgactggaaaaattttccatagactagcttctattttaaaccttttatccctactaccctatccttcagttggaggcatcatggggtgcatccctgtggtaagaggtctttggccctgcaccttgttttgttgattgagtcagcacagtgggctctaagaatgtatctggatgtcatttctacactgctaaggccagcagtaactttactgtacacaatagtgatgtgaaccacgtaagtgtttccgtaactctacttttcatttgtctgaatgccaaaaatgtctacaaccattccaacccgttatggttgaatttctctctttttttttttcaaatataaatagaaccatgtgaacatattgctagggtctctctatagaacttgtaagggaactgtccttggaagaggctcttaggttcttggtgagcctacttctggctatgtttcacttggaacagatcacctaaagaaccgtgaaaggacaggccatggaacactggctataaggtgccagaactgacctaaatttcaaatgtgtctgataaaattatcacaggtttttcatctgaaatggttgtttatgaatttgctttaagactttttttgcaggtgatggacacccgcttttaactagttatggctttggtagaaagaatttactggctcgggtaacaaaccactggaaggtaagcaggttggaagtagcctaaaggtcgcctggatttatatattcgaacagtgtcatatctgttaatctgtttctttcttttcccatctctctttttctatgttagttttattctctactcctgaaaaaggcctttttcttaaaaaatgattgcaggcagtgtggggttctat

SEQ ID NO: 126006 - DNA, 1064 bp, Homo sapiens
tactcacacatttggaaataatctctgcatgggtatttaaaacacaataggctttcactgcttatttttctatataatccttcatttttcttttggaaattaccaaaaccttcactaaagaaagaaaataacccagagttgtaattgatgcaaggtttattgcccctcccaaagttcagaaatcctctagtgtgaatgtttttatttgcttaattcttttgatggaaaaatataatatctttcttctgttgcagcattctaatgagggctggggatggacatgaaagggagtaaagatgtaaaatatttttcacaattgtatttttaatatagcaacccattttatcaccacatttattaccatttgtaatgtttggcaatcattaataatacgttaacagtataacagcacagatataaggaagtttccttactttagcacttcactggaatacagtactgtatctgtttcccctttgatataaaacctctggatacattgagcccatacttagtttatttttattttaattaactgttctcccttatccttccttgctgcccagtctgtgagaaagttgtgaattagaataaaatgaaaactcttctgattcattcaccaatttttgagtgttattttgtacagtgactgcaatttataacaaaaacagaaataaaaagaaaaagagagcctcctcctatgtaatcttaccatttgaagaaaacagttggcttttccttcttttctttcttttcctttcccaatgagaatatatatatattttatgtcatgtcattgtgatcatacttaggtagaatttgtagtcttccctctccatttaacatctgtcataaacatttccatgtattccacattcatttatggctacatatttgctgatgttccataatatgcaaaagaattgaaaatttcattggacatttatgttattttcagtcttgaactctataaatgatgctattatgaacatatttgcgcagtagagcctctcttctgggattctttctttgagaaaaattctaagtaatggaattagtagatc

SEQ ID NO: 126007 - DNA, 1009 bp, Homo sapiens
tctacatcctcaccagcccttgctatctttttgttattttttgataaaagccattcttacttgtgtgaggtgatatctcattgtggtttcactttgcatttccctgattattaatgatgttgagtattttttcatttacctgttgtccatttgtatatcttctttgtaaaaatgtctattcagatcctttgcctattttttccatcatgttatttgttttcttgttattgagttttttgagttcctcatatattttggatgttaacaccttatcagatgtttgtttcagaaatatttgcccccattttgtaggttttctcttcattctgttgattgttcctgtgcagaagctttgtagtttggtattatgctatttgtttatttttgcttctgttgcctgtgttttgggggttatagccaaaacaattattgcccagagcaatatcaggaagcttttaccctatgttttcttccaaaagttttatagcttcaggtctgtgtttaagtctttagcctattttgagtgttttttatatatgtcatgatttcagagtctgattttattgttttgcatgtggttatccagttttccaacactattacagttaggttaatttttataggactttcatcttgaatagttctttaatgtgcactggccactttgttgatacaatataaaatcatgggcaacttagttttactctttttcattaatagtggaatgtggttgttcagatggtagactcaggaattagacctacgtgggaatacatcttggtgtaatcattcaccagctgtggaacttggtgcttgttcctttcactggccacttgtgtacctccttgggcttgccatttgtcttcaggcatctatttcctagcctaccaaatgagatcatatttataactaccttcccaattggctgtttatttctgtgatctatggatgcatttaaaatacctagtacagttcctggcacaccataaatgctagctggtggtattat

SEQ ID NO: 126008 - DNA, 1264 bp, Homo sapiens
tgggagatttaggttaaggactcttgctgttaagcttaaactctgagagcagaacttttggtgtggaacaaagagaaccctcaggtgcaggtgttacaggttgtggcatgagcatgcaggtacctcacataggttctctcagacaggagaggaaattttggatggtatagctatgaacatggtgtctttctatgctaatcagaaccaagttaaccacaaatacacagattttaaaattaggtgacttgcaaaaatttattttcaagaccattctctgaaaaacagtttggccacgacttaatgtcagtttgactagtaatgaaactaaaatgactttaaaaatatttatcaatacatcttcatacatgaatatttagttgttagctgtaggtaggctagctttaaacattattatattttaatgactccattctcccctaattactgaaataaaatgatttttttaaaacctcaggatataaagatcctacaagaataagagctcaactttctaaaagtgattccataagtagggttcaccatatggtaatttaatgagaaattattgaattgaatttcatggtgcttatgggaaacaatattaagatcttctgatttagagatgattctgtaattgcagatagggccaacacaggaaaccgtgtcccttggttcctgtgggtttgagctgttgcccatttttaagtactttcatttttaaatagtgaattgtgtcagaggaatactcattaattttctctgttactcgttcaagaactgtgatattctcacagaagtattttaaatactgaacaaaagtttatctggaaatattatagttttgatggttagtatatgtaagtcatagtgagctagcttcattgattaataattactgtatattgctgtcctgtagaaagattatgctttcatatactgtctattaactcaggctccctaactcagtcttaggggcaaataactgccgccagtaatttactgttagtcatttggaagagttaaccttttctccttacaaatccaaactcattttgcttacttaaggctactgatggattattctttttagttaatgacactcatcttaatggaattaaaaaatataatgacttgttgtatttctgttttacatcattgtcaaagtcttgtatttttacaaataaatattatatattcctataagtgctcactttaacaccagggatttcctgtattatgcaatctgtatgtctttcaatcctat

SEQ ID NO: 126009 - DNA, 1055 bp, Homo sapiens
tttcctcctctgttaaacaagacaaacatgtagctcagagctttgggtgtgggaaatactccataaatattagttctgatatcattattgaggtaaagtggcaatttgtacagaatttctggcaaagtctttggtggcttctacccattcttactgctagtttctgattccactcatgacaggaagcatgtcaggatcaccagcggcagttctttacttcctgctttataagacaattttctgtgcctctagactgtaaattccataagaagttcctccaagagaagcacccacgggaacttgtactatattctcagcatttagcataatatttgttcatagaagacaataagtatctgctgaatgaaaaaaataagtgaaagaattaatccaggtattagaaaattgagtggtttctcctgttcacccaacagtatgtcagatgtgtaggggaaagtacagcctggacaggtctgggaacgcatattattccccctgctatcaaaatatgcagtgaatataaacaggaaaaataaaaactgatagccttataatcggcttgcctgatggtaagcgcatcctccacacagaggctcacattcatgcgttttctttctaaggtattttagagccacgtctgatcagttttaaattttaagtcaccaaatatcaacaattggcctgcgataaaaatctctataatcgtgaaatgttttaaacatgttaaaaattgtataaaatacctcaacagacatccacgtgtagatttaacatagttcagtgttttgctatattagcttttaaatcttttcatggttttaaaatctactaattgtgtatcagcatgtctcctgttagtttttatttttattcttgccttgactcttttacttgatcaatcttgttagaattttttgtaaatactctctccccacccgccccccaccccccctttttttaaagacagggtctcactctgttgctcaggctggagtgcagtggtgcgatcatagctcactgtaaactcgaactcctagcagtacttctccctcagt

SEQ ID NO: 126010 - DNA, 1087 bp, Homo sapiens
tcctcaaggccttgcttcctttctcataaccttctctatcaaataatgtttgctgatgtttaacatgggaatacatccacttcctccatcctgtcgataatgataatgcacaggtggttgtttcttacttgttttgtaaccccttataaagctaccgtgtcattcctcagcattctcttttaactaaatcgtttcatttccttcttgtttgttttactttttggcacagaacaatccagcactttaattttgttaaattttcgttgagaaactttaaaataattcctttttgttaccatcttagagatgtggcttttcatctaacaagcagttactgggtgtctcctgtgtgccagccctaggaatattaaggcgattgaaacacaagtcctgggagctcacagtctcatgaggaggccaaatctagcccatttcctgatgtggaacatgataggtatatttgctttttttttgagagagagagaggaaaaaaaaaaaaacaaaactgggaaaaatgcaagctaagcattgtcaccgaagaacaggtggcacctaagggctctggaaacatgccacctgaagacagtggagtgcaataggttggaatagcctatccaagggagagggttacactgacagatcttaaatctaggaaagagagctaatggacacggccagaaaatctagctagtctgcctgagtgacacctctggtcaggatctgggaataagcatattaggcagaaaggaaagaatataagtgtaagttaaataaccagagacaggaggccatgtgtctgagagcatggaagacttccatttccttgtttgtgctaaaagactactgtgaataaaggtgtacatttatttactttaaatacattatttgaagaaagaggtttttacaaacatggaatccatgcttaatatcagacagtctctgttttcttattaggaaaaagaaacattgaagtccttttcagcagtaaaattgttacatctgagctcaagacaagcacatctgtcacctaggaatagtacagtgagacctgttcacatttgtgacagcaagtgtatattgggggtaa

SEQ ID NO: 126011 - DNA, 1273 bp, Homo sapiens
agtatccaaaaataatggtaatggttcaccttgagtgttttatagtattatttgtataataagccccttcaggttgctcaaccatcaaagtcttaggaaatctgtaccctgtggaaagattgcagctttcctttcactttgtagaaaaatcctcccttataaataacctaatcttatatttggagatgaatctatacgcataaacagttgatgtataattttcacatctgctaccaagagcagataaatcctgagatcaatttggttatgggcaaagaagaatataaattaattggaaaaaattagctcaaaactttggtgtcctataacaatttcttaataaattatgaacttgggaatgtgtgattatttattctacttctcattgctcctcttctttattttgctgcctctagaaggttagtaatggaggtgaaagtcaagttggctttttggaagatttccagtaaataaagtaatgatatttataagagaaatatgaaaaattttccagataaattagaacagaaataatgttctagattttgcaaattatattcatcctttatatgtttatttagtattaatatactacagttacttaatggtttgtgtgatcgttaagtgcaacattatgtattataaaattcataagaaggaagggcaggtaaaactttgccctgtattgaagaaatctgacaaatgcactaagttaaattaaatttaatttccttttagaatttcagcaagtaaacattactccatcaaaatttattttgaagccaagaccaaaaaggagtaaacggcaggtatgtattcacagtggtgtgtcgtgttattttaaaacaattgtcaactgccagtcatttgaatctacagtaagtctgtgtgagagggtgagtattagtttgggaatttgtcagggtgtgataaaccgtaagggtgatggatctgaagaagcagtagaaagggggccatgttgtttcacagatgcaaaaaggattcaagatagtggtgataatatgtttcttcatcatattatgggttatgaggctcctgcttgtggcaccttgggttctttctaccataggcttctttccttgcccagatatgtaccacatcgtggaatccacttgtatggtttatatccttgtatttattccctggaagataaccccttaggaatgaatcaatcaggttgtgaagccacagaatgcttttgtctcacttgggcaaaactttggagtccaggatataaaattaggtcatggac

SEQ ID NO: 126012 - DNA, 1009 bp, Homo sapiens
atatattttgaacattttagatcgtcacaaattcagatatccatagacatcagtagacatataacgtaagtgaaattaaccagatataagacagtattaggtgggtaaggcctgtggtgaaatgaatggtgcatggcctgtctaaggggagcaactgcctctcattgtttgccagttattaccaggtgagaatgctaattttaactgaagccagaaattggattttacatgatatttcctgatttttaaaacacgattgagaccaaccaaagatatatgtgatccacatctgccctgtatgccacctcgttgtgacctttatcttagaggtttcttcttgctgaataagtcttgcagaacttttaaatttgtttgcttttagcagtgttcacatccactttactgtctatacccctacttagatttgtatgtcttgcaattcatagacaactttcatatgttttatcattttgaataacaatcccaataaaaataaacttatgaaatggatggattgggtattttttacttcatctcccagatgaataaattgaggcttcaatcctttaagagacttgtctcaggcaacacagcagataaagaacttgatctcagctctgactctgacattgttttacagacaacacatttttacagaaaagattttttttttttttacatttttagggatctttcaattgcaccatgttttctctgatgagatgattgttttctgatcactttgcaagaccttcacttgttttcttttgctttcagtttaaaaaacatcggctttccgttgtacataccaatacctatgcgaaatctgtggtgaacatggcagatttagtaagtatcaaccccgttcattattgccctagaagattcttatttcctaattgctaatagaatggataatatgattcttatagttttactgctctatgttgcacttcagccaaggtgtctagtaagttccgggtgaccttgcaatagactttattgactt

SEQ ID NO: 126013 - DNA, 1077 bp, Homo sapiens
tattgggcccagattgcgccactgcactccagcctgggcaacagagtgagaccctgtctctaaataaataaataaataaataaataaataaataaataaaattaaaaatataaaaaactaatatggttactgtaagtgaccagaggacagactggggaaataatggcagataatatgggataattattatatattcatgttatgcttggaataatttccagattaagctacttacagattaaattgagagaatctttacctttaccttcattgaaaataaggccctatttatcactttgaatgattttccagggaattgaataattccctgaagcatcaggttgtcacctaacaacccaactggatattttttccttagtatttaacagatttggggataagaaaaatagagtaggttttccaaagggtttcttttactcctaaggcactaaacctactagagatgatcaaaaagaaaatacttgcatttttaagaggctgcaaattgaaaaagatatcctcagttcttcttaagtttctattggccgaagatcatcactacctcctgttactcatttcatttgttttctgaagctacattctattccacttgaggggaatttcaggattacaactggatacaaagatgaacaagttctaaaaaaatttacagatttaattttattttgtattatccaaaagacggatttaattatataccaatattgaatttttcaagaatgtcactggtgaaatttggactcagatatacatttccaaaacccaaaagctgtgattatttcctgacttctagtattccctgtaagacctaatcaaacatggatttttgtttcttactactttttcccaaatgcatattcagtgctggctacagtgtgttcagcctcttctaaagaaattgcttagaaattacttattttcagcgatattgtgacatttttctctggttctttgtcagtgacaatttggatttacatatattttatttttgtttttgtttttcagtttgggaaaactgatttaatggctgttacacttgcccagtcattagcccat

SEQ ID NO: 126014 - DNA, 1007 bp, Homo sapiens
tggctgtgacccctgagggtgcttttacagagaggcctctttgtaggaggcttaactagactttgacttctaagagtcctacactaagagttagtgactttttactttggcagtatggatccaactcaggttttgaccagtaggataaagagggactttggggctgggcatggtggctcacgcctgtaatcccagcactttgggaggccgaggtgggtggatcctctgaggtcaggagttcgagaccagcctggccaacatggcgaaaccccgtctctactaaaagtacaaaaattagctggatatgatggcaggcgcctctaatcccagctactaaggaggctgaggcaggaaaattgcttgaacccaggaggcagaggttgcaatgagccaagatcatgccactgcactccagcctgggtgacaagagtgagactccatctctaaataaataaataaataaataaataaataaataaataaaaggaggggctttgaaaaaagacctatttaaatttgataactctggcagagatatgttggatagattagaggaaaaggtgataaaaacattggctggagtaaaagcattgcaaggaaaaaaggaagtaatattgttaccatgaaacagatggcttggttggtcacttactgggtatcaacttaattatcataaccaaggaagattaaatgaaagggattttattacttttaacaagcaagtagaataccatggatagttcccaaagcagtgtatccctgagctggaggctgtgtcaggttttataagcatagggtaatgaggtgtgatctgattggatcttgcaatgaggtggtgctgggaggcatgatcggactggatgccagagctcaatctgattggatactggatcctgtcattcagtgtatattagtttgtttttcattgttataaatgaaaacctgagattgggtaatttataaagaaaagaggcttacttggctcacagttctgcaggctgtacaag

SEQ ID NO: 126015 - DNA, 1041 bp, Homo sapiens
ttacctttcttggtaaagccaaggagactttcagtagatcttttcttgttgctcagcttggtgtatctcttgcattagctgctgaggaaacaagggagtactttgagacatgataataccatgcatatattattggtcctgcaagtttagaatgcatctttacacactttatgttttcatcctcccagcagcatcctcatacctatctccaaatatttaagcctttacatcaatactaacatttgaggcttacttcccctaaagaaatctaattcttgttttctcatacaaaatctggtgtaatagtctacgttatttctatctgtctctcactttactctgtacatttcatggagcagagccaggcacttagacagtaattggtatacattctcagtaaatatttgttgagtgaatgaataaatatgcactctcttagtgataatttgctgattgagtaactttaaagagttaaaggaggatgggatatgaaactatcatagtaagtatctactgtgtgccagagattatgctaaggacttttgtatcatcttatatctgaatttctcaactctggcactattgacatttttggctggataatcctttgttgtaagggtatgtcttgtgcattgtagaatatttagcagtatctctgcattccacccattaggtgccagcagcacccctcctagatgggacagccaaaaatgtccccagacactgccaaatgttcccttgtgggtaaaatcacccctggtggagaccactctctgagataatgctcacaagcacacttttgggatgggcattattatcttgatttttacagttaagcaaactcagtctcaaggaagttaaataacctctatacaggctcacttagccagtaaggaatagatgtacagttatgccccagatctgctggcagcagtttctgttgtttccactctaccactgtgtctcctggcagctttttaagacgagcaggcactggcagagatctctgaaagcactctgttaaaaagaagattaaaccaa

SEQ ID NO: 126016 - DNA, 1029 bp, Homo sapiens
gatcaactgtttacatgtgatacatcgaaaactgtttacttcaacttttatagaaacccaggctcatggaatcactgcaaatctatctgctcttcagacaatacgaagaccctctgagatgctacagaggagaggaagcggagtttcacatctggttaccattttctttttgtcattggcttaggatttaactaaccatgaaaagaactactgaaatattacactataacatggaacaataaaggtactggtatgttaatggataatccgcatgacagataatatgtagaaatattcataaagttaactcacatgacccaaatgtagcaagtttcctaaggtacaatagtggattcagaacttgacgttctgaggcacatcctcactgtaaacagtaatgctatatgcatgaagcttctgtttattgttttccatatttaaggaaacaacatcccataatagaaatgagcatgcagggctaaggcatataggatttttctgcaggactttaaagctttgaaaggccaatatcccataggctaactttaaacatgtatttttatttttgttttgttttttacttttcatatttatattagcatacaaggacaattgtatatatgtaacatttttaaaattttaaaaaaatgcagctgttacacacaagtgtattttgccaaatgcctaaaaattccgtcacaatcacatcatcgtcatccatccagtgatcttcaaagactataagcaggtaatgtaaatatagtggtcaatgctgtaaatgtgtctctccataattcgtatttgtccaaaacatgtgatatccctttaacctgtgcacagtctggaggcagttttattgagtgagtagttgagtgagagaacaaaatgcccagcaaaacttctggcctccacagtttgctgatgcaggagcccactctgctgccgatgggctgctccctggaaatcatctatcccatccgtccatcccatctcatcccagtgagccagcccctcagcagtgtgtgctgc

SEQ ID NO: 126017 - DNA, 1318 bp, Homo sapiens
caaaagaaagctagctaccctagtgaggctggagattgatgggctcaatcacatggtctgctctgaagtatacttctgatttcctcatttgctgtgtgttcttaagaggaatggaatctgcagacaggttttcagatatactctcttaaatttgatcctctcccatagtatccatggacaaaatccatatcatcttcatatgtaatcaatttgattacatatcatgcccaaactgaagggccgagttagaaggcagcattttatactgtgtgtttatgtcttctgtaatggacctctcttttgaaagtctttgaaatgtttggaaagcaatttaatgatccaaaattacataatgtaaaacagcatttttcatgacaggaagggatgtgattgttgatatgaccataaagcgatccatcaggccaaggtttgggtgagtgttgggcagtgttgccacatagctcaagccaagaacagaagggcagacagattgaaagatgtagcaaataaagtgactttttaccaagatcactgtaacgtgcactgaatgtttcctggtactgagtgtacaaaaggctaatgctataaggtttattttgactataaaagagtttatagatttgaatataaggtgcctcatgtaaatatgcttcctagttacaggtacacaaactctaatttgaaagaatccacaaatggctagctgagaagttaacagatctctatcattcgtctgtgtgtctttcttccctcacctatttttacatgaaattattatttcaaatgaaaatcatgatcatgtgccttttgggagacatggtttctctagaggtatatagtttgtaattacccgccttggtaataaccttcctgtggaactgactaaaaatttttgttttatttgtagagattatgatttgaggtatacagtaactttaatgttctattcttggaatctactctatctcccatgtttaaacattcttagagccatttgtgggattcattgacaaatttatagtctcaagggagagtttcaagaagtatctatatgtatactcatggttggggttctagaggcattacatctaaatatttatgacttttcatccaccgaggtaggtagcattaaatatacaagcacagcattatttctctttaaatatctattttggagagaaactttgaggccgtatcacagtttatatcatgcaactaatatttatatttcccaatccactacaaaatcattgctaagcagaagagagcagttatttggcctttatgttccattgtatgcctttttcccctcttccag

SEQ ID NO: 126018 - DNA, 1041 bp, Homo sapiens
tatatatagtactttaaatattttcttatgttattatttaacacaataataaattcttatctaaagaaaagattattttactttattttacttaaaggaaagagaatttattggcaggatattgagtagcttgtagagtatatggaaggggagagccaagttaggaactggcaggagcgaggagggacaagacagctgcctgcacagtctgataggacacatctggctgctgccactggatgcccacatgggcagcgtgttgtaaatatcaccctaccagttggtaagttggcatgaattttccatgaaacacttgactgccatttgcagcatcatatctactttttatgcacctaattatatttttcctttcacttttatgtttttttctaaaactgccacctaaatacctttccactccgttaaatgtatggagtcaagataaatttctcattcttgctctacagtttaagatgtataagaagtaaacacttccgtggaatagggcttaatttggggctcaaatgttttgttttcctcctgagatgtttttgaatggataagactactctggttttggatgcagcaacttttctcctggcatggaagaactaaggactttgataaacagtttcccattgatagtataatataatgaggggcccagtctgctcttgtgaaaattggctgagcggcagcagcccatcccagctgtgtgtgagtagccccgctgttaaaagtacacctgctgggaattgttggcacatgctcatagcatatgctctgtgggggaggtgcttttaattccaagaggagcttttctcccacatctgcggatgcagaacaaagatgcagcaggactttagaaaacaggagtgtttctactgacattttattcattgctttgttagtcccgcaaatggagcaacttctggttgtttgtaagcagaaaaacaaaacattcaaaaccaaaaacctaattagtacttttgtcctttatatccctaggatgctctagggagtagaggtggcaggcatctt

SEQ ID NO: 126019 - DNA, 1020 bp, Homo sapiens
tcttgatttaacagcttttaacctggagacttgccggcttatggtttcaatgctggatgtatcctttactttgattgttgtctagaataattttttctaaaattctaaaggaattcatcttagaattaatatctagtaaacacaaagtaataaatgatcactaaaaagctttctgaaataattagcttctattatagggtggaatttggtgtgaataaaggaagaaaagaaatttagtaaacagaatgttgttcaggaatttaaggaaacatcagagtattatagaacaagtacagagtccagagtgtcaggacagctttttttctttaacattgattcctctgcaagtgatgggatttttcacatcccacttgttggactgagtttaggtagtgctgactatccagtgcattccatcccacctcatttgtctgggggcactaaacaagggaatattagtaccagagatgatgctaggacagaagggcaaacagcatagcctgaagcacccacaaagtacagcctagttccagtaacaagaccgctttttataagtggttcacaatggcaacgctatttccttataatcaagtcatgtaagttatcttttccccacagtaaaaattggcacttgagctttttctccatagcccctttctatttttaaatcattaattttacatcataccaagaataatctacaataacttttttagccattgaatattgaattccccttatccttgatctttcatttaatccttagaaaatatcgcaaaatacagctctaatccttgattacagttcagagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggtaggtatggcttactagaactctccattcattggtagaagtaagttgatttttatttttaaa

SEQ ID NO: 126020 - DNA, 1011 bp, Homo sapiens
gtggcatctatttgtgtgtttccttaagtatagttcttatttcttattgtttgctctttgaccctcctaattctttcttggcatttgttaattcttattttcttttcttctataaacttgtggcacaactcctaggtataaggaatgctacaattttttaattttgtaagtcagaataactttttgtggagctactgtgcacctagccaatatcacattcaatttaagttaatttttgtgtctttttttctctcatccttctctcaaatcagggtgcagaaattgattagggctagaaggtgggggagggttctggtctgtgcctgtggtggttgacatctttattctggctcttctggccacatgatactgctgttaagagttgggtcgatgtagtcactttgctttgcatggcctttgaagtgtttctcagagaactttactgtattgactgaagattcttactaaaagctttgtgtcttactaaagtaatgagtcatctctcagcatttgggatacttcattctgcaatcctcgttcctctgcctcagattcagggtggtggagggattaaatccatacctttttctcagattcagccattttcaacttttgctccccaagcatcttttcttcactatctctttaccatgtttagcccttctctgagactagcagcttcataatgttcagtgaaacagaaatgcatttttttctttcgtatgtatttttagaccttaagaatcacatattttcttctctttcataggtaggggattggaacttggaaaaagagatatgcttccctaacacactctgtgatgtacatttgtcacttatttatgcttaacatcttaggacataacaattggcgaaactatctgttgaggattatatttgagtgaaagggttaataaatgtcataattattatctaatgttattaacaaaagttatttattttgctgcttttctgcctgtgatgctttgtcagttaggttctccaagaagc

SEQ ID NO: 126021 - DNA, 1075 bp, Homo sapiens
gctctcccctctctgagggtaatactgaagcacacacagcatactggactgtgccaccccgctgagctcaagcttacattgcaagaagctgcagatctgttaatgcactttcaaacccatgcactgccttctcttttgcttatccctgaagggaagtatttttagtcccagatgctggaactactgtgattcaaaaccttttagtaactttatttggaatgctgatgagttaaaaccagaattaaacaaaactaggaaatatttttaaagtaacatttaatgaatacacatttataaaagccatcatcccttaacatggggaaagtgtacaaaaataatgtgaaagtgtaaaaatttttctagaatacaggaaacatatcagcagtaaagaagtttagtttaactttttttttaaatgtaaaatagtttggatctgttaaaaggaatacagttcgcccaaagcacttattttcatctgttgtaaactcattctttctaccttaagtaaactggaggagtcagctgtgttaatatggtcaaattaatttcatagttttgggagcagggaggttgtgggaaggacagaaggagaacttgggctttctttggtcagctggtggggcttggagcacttgtggttggggccaaaggtcaggtctggaaatgcagctattatgccaaaaccatcagagtgctctttagcttcaggcttcatgaattgcttttaactactcaggtagagcatttttactaggctataaaagtagagttcatttttttctataggtcagcattttacctatggatggcattttctattttcggtgacggactatgagccaggataaacacattactctcttctttaacaaaaagagcatggttaactccaaagacttctctagaccagcctggatggtacctaaactttaatcaaccaatgctcaagtaaaagagcagtatccagccccagcacacctaactgttttgcataacataggtgagtagtgacattttccttatcttttccactgatactgtagggtcagcaccgtataccatgactctactcaat

SEQ ID NO: 126022 - DNA, 1007 bp, Homo sapiens
tttaaaaacagttaattaattctgtatttactccttttccttatttaataattattttgaaaggctacaacagcaccatgccaaatgatgacgtaaaacagtgaaccgattttaaaataaggatgtagaattaacatatgtaacaagatgttttaaacttgtatgtggtgtcttagataggtaagtaccagggtttttagttgatgatggttttaggcacatcacacttataaaagacatggttctccacactgtgagtagtttgatcttctgtgtttgtggtgccgcatcacttatgaatgcttctaatctcagtgtataaatggaaccagtttcatacaaggtaatggaagcagaaaaggatattcaccaagtattagtttctagtactgacaagaagcctccagaggctgacaccatggggttccatcaaactaaaatctgagggtgcagacagtgggagatataacagttgaccaccttatttggtcaagctcaagaaaattattcacagcacatattagcaaaatgtaatatttagtgggcatttcatcttggaattatattttggaatctttgaggcaagtgcacatttaatgattcatgttttaaagattgagtgtaaatttgtttattcttacctgccgacttgcatccagtgctcctgactggagagcccaggctgagatggtgttaaatgcttttaccacgtgggctcctggcaccaaatgagcaaggtactctgcattagattctggatattgattgattttgaggttgttgctgatgtctaccaatatttttccattgagaacctcagttaattctgtgagaaaatcataatgctctctgtggattgctatgattatgatgccagacttcttggctgcttctgaatagctcaagacttctgcaccactgggcagtagggtggtcttctgggggtttcgacttccaaaaacaacagaataaccacactggagcattttcaatcccagtgatcttcc

SEQ ID NO: 126023 - DNA, 1085 bp, Homo sapiens
cagctttctcatctgtgaaaaatataatgttgactagaatagatgatatttacatcccatctagttttaacattccaagaacacaatgcccatatgctacttttacaattaaaaaaacaccccagaatccacacttacatgtggcaggcaactgtgccttctctcttctgtgccgaccccaccaagtattcataatcattcctttttctgtcttgaggcagcagtatatatattttctacaggaatatattataactatttgtaagcatttgcattaaaaatcttccaggacattaaatattcaacatttatgacatatttctgttcaaatatatctaagtgaataaaatgtcaccaaatataaacctcagtagaaagcctgaacaatagacagattctggagaagccaaaaataactagagaatggattagaagaagactttacaatgttggcctatgttgtttaggaccattgagctcctccaagaagggtcatgaccactggcatgcaggtttaactctttatctagaacgaggttagctgcctacgaacttggaggtggtgaatttttttgaaacatgcttaagaatctcctacaaaattatgttatcaagtcatgcttacctctgctttgtccatatccttcttttattaaccttctctattatcttcacccttgggtattcttcaggttgaataatttcatctgtcatagcagtaggtcaaattgtaaactcaattttaaaattatcctctttcaataactctcttttcttttcttttcttttcttctcttgtttcttttttttttgatggaggcttgctctgttgcccaggctggagggcagaggtgccatctcggctcactgcaacctccaccttttggggcttgagtgattctcctgtctcagcctcctgagtagctggaattacagatgggcatcaccatgcccagctaattctttgcctttttatttttattattattattttttgagatggagtctcactgtatcacccaggctggagtgcagtggctcgatctcggctcactgcaacctctgcctcccggcttctagcaatt

SEQ ID NO: 126024 - DNA, 1020 bp, Homo sapiens
aagtggtctaacctgtctgctggttggccgattgaaacctatgtggcctacattgaatgaagttgatggccaaaatttcttgccaaaatgtaaagaaaagagtccaaagacttgggagaataggaatgttggagtggattgatcaccggcaactgcttatctcccatgctatgaccgccaaatagccagtaatttaccattaatgtaatagcaacttttggaataacaaggaaaaaagaaagaaaaagaaaggaagaaacgctacaacaatagacctattttttttccttcagtgcatttcatccagagtttatatctaggtcacacaatcaataacctaaagatttttttgaggggggatttacttttgaccagtactggagtattgggcatgactacagctagtcaaaagtaattcctctccaaaaagccacaactctgtgatatcagtttttgggattatgacttttaaagcacctctactattgcaataaggcatatcaaaaagcacttgggctttcttggcattgccatttagttaacttgtggtttcattttttccttaatggaactgtgtcttcttggacagtaaacatcccttgaaagtcagttggaagcttttgcttaaatagatgttcaatgctttgtgacaggctttcaccacatataaagtagacataccaacaactcctagctttagaataattttcacacaatcactttcttccctcaagctttatagtggtgtaatgtttttgaaatcatttttaggaagtacacaggatgcaatctttggaaaaaattcggtggtacaacaaataaccccaacaaacaaatgaacacctcaattgaagtgacagttggatcaacagatactgtaaatgcctggcagtgacagttattcttctgcatggatgcattcacttttttaaaagtgttaaaataaaaaaaattattccagatttcagaaatcataaatgtacctcctatgattaaagaaatagttgacatagaatatat

SEQ ID NO: 126025 - DNA, 1049 bp, Homo sapiens
cctgagtccagggagattaaagtttcagtaagctgtgattgcttcactgcactctagcctgggcagcagggcgagaccctgtctcacatttaaaaaaaaaaaagcataaaaaagtattaaagcgtaaacaataaagcaatagctttatgtttaatggctgcataaattccaatgtacaaatgcactttgttaaataaccttccaatcttcagcattttaaattgcctacttttttgttaaaataagcaacagtctatgaacatctttgaatcttagctaattcattttacaatttaagtaatttcagatgtaaaatatgtggcaaaatgattatgtattttgtaagagtttgacaaatattttcaagttatcctacagaaagatgaaccagtttatgcccaggagttgcttcttagttaaaaccttgataggataaactgagaaacccaccaaaattagaatgcccatctcagaattaaaaaaaaaaaacattaaaaaacagactaaatagatactagttttgttatcagaaacagttgagtttaaggtgtgaggtgctcttatgttaattctctgaccaaacctagcaaagatcctgccattacatcaaagtgttgcactggggttgtcagaaataccaactgtatggctgttggtttgcagccaataaacaagcaaaaaagctcaacatcactgatctttagagaaaattaaaaccacaatgagatacaatttcacaccagtcagaatgacaattattaaaaagtcaaggaacaacagatggtgcggagagatacgaacacttttacactgttggcgggcatgtaaattagttcagctattgtggaaggccaagaaccataaataccatttgacctagcaatcccattactgtgtatatacccaaaggactataaaacattctattataaaggtacatgcacatatatgtttactgcagcactatttacaatatcaaagatatggaatcaacccagatgcccatcagtgatagattggataaagaaaaggtggtacatatacacctg

SEQ ID NO: 126026 - DNA, 1050 bp, Homo sapiens
cttggttgtcagtcggttttatattgagaaatgttttttaggctgaaaataaggtacaactttagcaacataagaaacattttgttcatggacgaggccatatttcaaacttctaccaccctcacaagattactttttaatattgttgttcttctccttgtttaccaatatgcatgcacattacagttctatccaagtaaaccatcaaataattattagaaaattaatagattatggaagtgttgcattcaagaaaaaaagtgatagctcctatgtcatttgtcttagaggaatgcaaaaaaaaaaaaagaaaaagtcataaatttgtggagacctgttatcagggcttcatagtaggcacagggaagagtgtagaaggagattcacattcaggaaataactgttgtttgcatttcttctttctttatttaccttctggtaggtccaacaaaataaagaagatgcctggattgagcatgatgtttggagaatggagatttatgtgtctctgggaattgtgggattggcaatactggctctgttggctgtgacatctattccatctgtgagtgactctttgacatggagagaatttcactatattcaggtaaataatatataaaataaccctaagaggtaaatcttctttttgtgtttatgatatagaatatgttgactttaccccataaaaaataacaaatgtttttcaacagcaaagatcttatacttgttccaattaataatgtgctctcctgttgttttccctattgcttctaattaggacaagtgtttcctagacataaataaaaggcattaaaatattctttgttttttttttttgtttgtttgttttttgtttgtttgtttgtttttttgagatgaagtctcgctctgttgcccatgctggagtacagtggcacgatctcggctcactgcaacctgcgcctcctgggttcaggcgattctcttgcctcagcctcctgagtagctgggattacaggcacccatcaccatgtccagctaatttttgtatttttagtagagacaggg

SEQ ID NO: 126027 - DNA, 1004 bp, Homo sapiens
agtccagtggcgcgatcttggctccctggttcaagcgattctccttcctcagcctcccaagtagctgggattacaggcacctgccaccacccctgcctaatttttgtgcctttttagtaaagatggggtttaatcatgttggccagtctgatcttgaactcctgacctcaagtgatccacctgcttcggcctcccaaagtgctgagattacagacgtgagccaccatgcccagcctataaatgacatagttttatcagttatttaatttggattccttatgaataacttcaaaagaaaaggtatagacactgtggacatcacctgggagcttgtgaaaaaatgcagaatgtctaacctccctctagacctaaagaatctgagtgtgcattttaaagaggtccccaggtgatcatatttgcattaaagtttgacaagtgcctttctagtgagtcattcccttggaaacagtggtctgctcaggtcagcaggatcatgatgcctggagaactggggaggggatccccttgtagaacagaaagaagagatacagtcatggaaatattccgaattttgaatattatgaaacaacaggaacaaagtatgttgtgcaaggagtgacgcattttaaggaatggcattgcctttcccagaaagtgaagagaggaaattggaaaattgtgagtggaccttctgatactgctcctccttgcgtggaaaaggggaaagaactgcatgcatattattcagcgtcctatattcaaaggtaactactactctttcgcaagtgtaatttttcattactacaaacaacaacgtaaaaattaacataagtgagggtcagaaagccacatctactatcgccaaatgatgaaagtattagattgaattctgaatcttttactagagtgattttcaatcttggttgcataataaaacatctgctaatcttttttaaaaaatgctgttgctcaggatgaaccccagaacaattaagtgaaaactg

SEQ ID NO: 126028 - DNA, 1011 bp, Homo sapiens
cgtaagtggagcatgcgattgctaccatttttataaacaacaatggtaatgctgagtctttttgttttttccacaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggtactgaatgtgcttgttatttatctgatgctagtaaaatactttttattagtataaattgtaaaacataaaattttacatgccctgtaatggaaatttgattttggtatactgcgggaggggaaagaattgttctttaaacaatgtttttgcaaaataattaggtggctaattcaaaattatttaagtaaaggctgctaccatccttttccatacagaataaaagcagaaaaatagagggttgggttctccccctttttcaatgttataattgcaatgagtgctttcagtattcaacaattcattattttaatgttttataattggctgtgctccacaaaatgatgaggcaattctcagtaaatatatacaataaaattagaaccagtaaaaatacaaaacagaac

SEQ ID NO: 126029 - DNA, 1027 bp, Homo sapiens
ggaaagtacttatgagcagagcgacatatccaagtgtagacttgggccaggagaggaaggaaaagaaacaaagaataagaaacaaatgactgaaactcataaattaaactatcaagatacaccatgtttatattttgataaaactattttgtcttaaattatcaagttaacctttgtcctctactgaattaaataatattaatatttttatatatgcatatatatgtattatttatatgcacaccttatgttacacaaataaggccctactgcatacagtttaatattcttactacttcatttattttatcaagaacattttcctcatgtcattaaatatgaaaatgacattaatactgtataatattctattgaatggatgtgcataatttattaaaccattcctttttgttgataattcactgtttccaactttcctcaactataaatgtcatgttaggccattttccatattttgatttattttcttaggactggtttctaatagtaggattattggtcaaaacatctagcttttccttaagggtactgatacatactgctagactcttctttataaaaattattcacattcccaccagttgtgtattaaagaaatgtgtatgtatgtgtgtgtgtatacacatacacataaatatagtcatgtgccacataagggcattttggtcaactatggactgcatatacaacggtggtcccataagattatatgccttatttttactgtaccttttctctgtttagatatgtttagatacacaaatatttaccattgtgttacaagtgcctgtaatattcagtacagtaacatgctgtacaggtttgtagcctgggagcaataggtcatggtttgtataaatatgctctatgatgttcacatgataaaactgcctaacgactcattgctcagaacgttccctactgttaggtaacacatcactgttaatacataaacagacatatgataaaattaaataaactaatttaaaattattaaaattaatta

SEQ ID NO: 126030 - DNA, 1071 bp, Homo sapiens
caactgtatgacctcactttacctctttaaagatcctatctccaaatacattctgaggtagtgtgggagttaggatttcaatgtatcaattttgaggaaacacagttcagcccataacagatcccagtatcttttgaattataacttcaattcttataaacagcagattcaagaataaagtatgtttaatcaaggcacaaatggtattctcgcctacaggacactgatatttcacacagtagtgctgagttactattttgatttaacagtgtatgactgtacatttgatcaatgtgaatctgcccctgaggggtttttctactctcaggggtctcaacaaatctggattttgagtctgcagggtcccgtgcctgactttctcaaagtcatcatttgtctcttgtttcacttcccattagaagaatccactaccaaaagtactgtactagtctaggttccccaagcctgccataaacaaacaacaccaacactcacctgctgccactctatggggagtactatctctgagaaacagaagtgaggaaaaacatggaagtgaggcagtaggagaagggaacacaaacacaggtgttagtgagcttgtcatagctttgcaacaagtgcagttaattgctcggtctttgaggatattttcatgaaggtcttatgaattattgcactttagaacagcctatctgggggaaaggaagggagaatttatctactagcttcattttgtgctgtacctccttgatcaaagttcactccttaagtagggttgccagatttagaaaaattttaaaaagcccatgcttataataaaaagtaatttattgtttgtctgcaattcaaatttaactgagagtcctgtattttacctgacaatcctcctctcaggatattagcacctaagcatttccaggcagcagctggggaagccagaacctccacagacagatctggtgcacaggcacaaaggtcagttactccttgtcagtggcacagtgtacaggactcctcaacatatagcagtgtggtggtggtggtagtggcagcagcagcagaaactct

SEQ ID NO: 126031 - DNA, 1259 bp, Homo sapiens
tgattgaatgtgttatagagctgtcactttgaccaccatgtgtaatagactggtttagtggattcttatctggtacatagaggattagaggcagatttggaagtgtaaaaaatattagaaatatgttcaaatgaatagtataatataaaaagggagattttgttgatagacattcaggaagtattttcataaaagtgtgtgttttagtttgagctgctataataaagtaccgtaaactgggtggtttataaacaacagaaagttatttttcagtttgggaggctagaattctgatatcagggtgccagtgtggttgggttctgatgagggtgctcttctgggttgcatactgctgatctcttgtattcttacatggaggaaagagagcaagacagctctctggagtcccttttataagggcactaattccattcatgagggctcattacctccctaaggcctcactcctaaaaccatcacattgggggttaggatttaaatatatgaattttggagggacgcaaacatttagtgtataacaatatagtttttaaaatatgattttactttctagggctttgaaggaagtatttaaaaatctgtttatgagaggtttcagtcattatgaccgtcagcttagaaatgacatattagtgatcactacaattatagctcaaaatcctgaagcaccaatgattgtaagtatgaatcaaattgcattaattttaattgtggaagtggtgggcttgggtgaaagaagtcctatattatgttggaatatttgtgtattttcttgtaatgctaagttatgctgtaatatcttgatggtcaccagtgtgcttatcactctgccaattcttctttgcaatcctttggaaatttggaatcttcctcatattgtgtgatttatacatgtatttaccacttatgatgcttttctttccttcctgatgatttgagtttccatctggcatcatttctctttcactggaagaactttgtttacaatttcttgtggtgcaaatctactggctgctggcaacaagttatcttagttttcttttatctgaaaatatatttaattcatcttaattcttaaagtctatgctcattgaatatagaactctaggctgaaaaatgtttttgtttagcatttcaaagataaagttctgctgtcttatggagtctgttgtttctgatgagaaatattcattgtgaggttccatggtgtaatggtgagcaccctggactctgatgag

SEQ ID NO: 126032 - DNA, 1706 bp, Homo sapiens
aaggtttcctggcctgttgcagccatggtgcattgcagttgcgtgttgttcagaaaggtccgtgcgggtcccctcagcctggtccccttagcgctgacagctctggttcttctttgctcccctgtctctccactactgtcttcgtggcggccttttccttgcttggttttcccatagacttctccgcccctcctgtagtggcgctttgtcagtaagcggtgacagtggtgtgtgtacctggcgtggtttggacggttgtttgggggcaggggcagggtttgaagttctttagagacatagtgtgcacgtggtatgaggaactgggatacctgcctgctgtggcccaaatgttgtggtggttttttttcctttaatgtccacagcctgtttttatatatttctccttgagtgcgctgtttaaggtttttctaatggatttttatgaagacacgaaagcgtgtaattgatgtgccttcctgcagaacatttaggtcgatttttgtgtggtgtcggtcttaagaatcgtttccgtaaaaatttacaactgctttgaatttttattttttaaatcttatcctatcagtaatgctttttgaaacgttgcctgcgtcatatttggccattactttatttctaacgaccagagtaaaatactccttttaagtaaggctcctaaacccctgaatctgattaatctagagcaggaaaaaagtgttacatatttaatggaactgtagaaactctcctcgagtatatcagaatggtcaatatttcaactttcttgaaaaaaaaatcccatttgttttttataatagctatcctaaatgactagagatgtggattatgaatttaagaaattactccttaagttattttgattttaatagcctaagaggttaatacgtaagtcctttacctacaagaagttcttgatttagtgaaggaaacaggtaaacactaaatgcagcgtgagatttataaaggtgtaataatagagatataatcaaattgctgggagagccagcaaagtcagagaattgattagaggaatttggaaagacgttagaaaatatgacgtttaggtggatttatgataggaaaaacaaatgacattctaagtagaggaaaagcatgagcagaatggcatgtagaaatggcggtatttcatgtagtacagagcaaagaggaagagaggaagggttgagcaagtgaaaaggatacaggaaggaactaggcatggtaggtgagcctattgttcttgctacttgggaggctgaggtgggaggatcccttaaggccaggagttcaagaccagtctgggcaacatagcaagaccccatctttaaaacagtcggggtggtgtggtgcctgtagtcccagccatttgggaggctgaagtgggagaattgcttgagcccaggagtttgaggctgcagcaatgatagtgctatgatagtgccacggcactcgagcccaggcaccagaaccagaccctgtttcaaaaaaaagaaaataaaagataccagaagggtattttagtagctttggatatacagttgacccttcaagaacatgggggttagagatgcccccgccacagctgaaaatcttcatgtaactttcaactccccccacaaaacaactactaataatctgttggctggaagcctcactgataacataagccgtcagttgacacatataaa

SEQ ID NO: 126033 - DNA, 1121 bp, Homo sapiens
agagataatcaaatgggaaagggggtcagatcggagatgtggaggtgagctaagaaaatgttatagaattggcatgtgaaaagctattaacgacttttttagaagaagttttagtggaagaaagaactagaaaaaggttctaaggtgatacacttttggtatacaaatattctttctcttttttttttaagtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaagtaagtaattactgaatgacttaaattttagaaaatcaaacccttctggaaattttttttttagttacaaaataaaaacttaattgttaatttgaagtaaattatttcctgtatttataaccaagcaaaagcctaaaatgtctcaactcataaaagactgatactaaagaatatttcagagttttaaaactttctgtccgtttcttttcccaatgtctatctgtattctttttgcacttcccctgtagaaaccgataattatctgaattcccactgttttcttctaaaattatctttgacaaccttttagaaaactttcagtcttaaccatgctactctaccccaccaccattagaaggcaagataaccactattaaccttttcttgacttttctaagacttttctgtgtgtttacacaaatgcaattatgtgcctaaaagtttagaatacaaaaatgagagtacagtattttacaatctgctatttttactttttttcacatgtcaaaattattcagaatacctgcataataaataactattttgtcatttgtctatttaggttattgttgatttttttttccgattataaccacagtgcagcattctgtgtagatactattttacatgtttgttcaattattattttgataaattcccagaagtagaattactaaaacatttgtactaattttttcttttatgagcagtttaagagtagccagatttgccttct

SEQ ID NO: 126034 - DNA, 1044 bp, Homo sapiens
ataaataaataaataaataaataaataaataaataaatagatatgagctattaagctatgaaaagatgaaaaaagttgcaaaagtttaaagatagtcattgcattgtttaaagttattttaaaaaaacaaataatacacacttgtttgcataaagaaaaagttgtctatgaattccaccacccagagatgactattaacagtgtctgtctacctgtatacacattttttacaatgttgtttagagtgaaaaattgtagacaacctgaaagtctgtcaataggaaattagttaagtaaattacacttcaccattgaaaagtgttcaccttatatgattcagtttaaagagtaggccaagcaactataaagtagttttcccctacttccttcaaaaaaatatgaaaacttgaacattaagactctataaaaactgccaattttttgcagacaatagagggaaaaagagcatgttaagtgtccatgtaggtgctagtagaaaaatgaagactttggaaaagaaactctgtaggacaactgacccagtttctttaaaaataaaattgcagataggaaacaagatggtagggggagcttgaaaatagatttgagacacaccgggtatttgtaacgtacagaccttacttggatttctattcaaaccaaattttaagaagtatattgccaatgtattaatatttgttgaagctaggtgatagctaaatggaattcattacacctctctacttttgtatatgtttgaaactgtctataaaatttttttttaaagcagtttacaaaacaaggtaatgttttgtcagtgtatagctggagttagaaagttacaggtgtttttcttttttttctttaatttctgttttttctatgacttccaatgggtttttatttttaaatcataattggaataattattatacactttaaatattgaaacatcttcagtgtccagcatgaatttatctttaccttttatgtaagtgtatgttctcaagtttttcaagattatttataatacatttatattct

SEQ ID NO: 126035 - DNA, 1024 bp, Homo sapiens
ggtatgtgccaccatgcttggctaactttttttttttttttgtggggacaggggtttcgccatgttgcccaggctggtcttgaactcctaggctcaagtgatctcccaccttggccttctaaattgctgggttataggtgtgagccaccctccccagccatattttccattaatctttgaaacctctatacccctcagcaaagttgcttaaacaggttagacacttactttattgcatttatttttctgtcacagaatcgtttatttggtttagttaggattttatgaaccacttaccttttatcaggcactgtgataagtaccaggaaggtacttatcattcatttagcagatacttatttttggagccacattaggttctgggattacaaagactgataaacagaaacagctcctgttttgacttgtattgagtttgtagactagtggagtaaggcgtacatatcactaataaatataagggaatatgaaagggtactatgaaagagtatagatgactgctctaggcttccttaaggatgtgtgatttttggactgggatatgaggaataattatgaggtaattagtaaaatagagtggagggtgaagggtctttaatcagaggaaatagtatgtacacaaagccttagtggtggcagggagtagatttgtgtgtctagagaacatgaaataagggaaagaatcgagatgagcctggagatgtaagagagcatgtcacatagaccatttaggctgtatttgatttttatatcttaagagcaattggaagcatttaagcaagggataaaatgcttaggtttgctcctcacagagatctcggcctgtaatgtagaaaatggattggtgtgggacatgaagggtctgagacaaccagttagtaggctcttgtggtagctagatgagatataaaagaagctttggttaaaagtagtgagtatgataagatctctgccatcattaaaaggacacagaatgccattaacttggaaaataaaatcaagc

SEQ ID NO: 126036 - DNA, 1036 bp, Homo sapiens
gataaggcaaagctgtggagacagtaaaaaaaaaaaatgaatgatttccagggttagggaggaaggagagatgaataagcagagtacagagaacttttagggtacactataaagtacaatacatatagtaaagtatgatactatataatattacagcaacattgtgttgctgtaatggtagacacagtatacatttgttaaaatccatagaatgtacagcaccaagaatgcaacaatgtaaagtatagactttgggtgctaacgatgcatcaatatgggttcatacagttttatgacataatttaaagaaacataaaaaagtatttggttataatagtgataataacagtaaaagataaaaccagttataatatagaatgttaactgtaagtaaaattgtattaaatataggataatatgaatatatagaacaatatttagaggaaaagagaacatcatttataccgaatttttaagggaaatcagtagaggaaatttcaggacatgagacttctgttgtgcatgctgctttgtcagcttcctttaagaccctgaattatttatctacactgggcaagggatgtcgagtactgcctctcattctttattgcacttcagaattatctgggtggtctaagaacagcaatgatgagtgatgcttaggccccagagatttgaaactaaatctcttgggggtagggcctgggcatttgtagcttctaagagttccctacgtgattatgatgcacagtgaggtttgaaaagcacaagtggccgggtgtggtggcttacacctgtaatcccagcactttgggaggccaaggcaggcagatcacgaggttaggagatcgagaccatcctggctaacatggtgaaaccctgtctctactaaaaatacaaaaaaaaaaaaaaattagatgggtgtggtggtgggtgcctgtagtcccagctactccagaggctgaggcgggagaatggcgtgaacctgggaggtggagcttgcagtaagccaagattgccccactccactccaggc

SEQ ID NO: 126037 - DNA, 5794 bp, Homo sapiens
ttctagaatttttttataaataagaaagtggtagcatatgttactccactaagtcttttataatatggggatggaagtgacattgtttactatatcatatgtaagtttggccatacttgccaacatgtatttccttaagatttccagcatactaccatattatatagtatcatagtatctctttcattcttcactgatgatgctagagttatatatgagattgtcttcatacaaattgtcttatcctagttttttattttattaataactgtaattttatcagaataattaaagttatcttaacacctcgatttctgttacttattttgaattactaagtaacaagtagagtatagagaaattgtttttagcttgagagagtaaaacattttaaaacatagaaatgtatagctattcttcgtatgttaaaggctgtctctttccttctcttttttttaggttgatatttctggatttcagctttcttctcacactcaatacaggacagcttttgaaaccataatactgcttacaaaagtaggttttctgttttactgtgttctgtatttggtctaatacataggaatgtaagactatatgaaataacataattacagtctatacatactccacctttaaagctttgatgtcagttaaagaattacttaaacttgttgtctccatttcctctacattcatttgctcctcaaactactgcagtggataaaacactcctgggcttccaaatccccattacatacttcccaggtttttatcttgcttcagctttggcacattgtttaattcctcttgtttctcattcttagttttgtgaccggtaatcttctggttctatttctactcttacactatttctccgtctactttttaggctcttttttctcatcctttaagtaacattattcagagttctgtcctaaccttattttctatcttactcactcccgttgctttagttacaattaataatattgatgactgccagatctgtagctgatacctaaatcttttcattgttctttctttttttttgagacagagtcttgctctgtctgccaggctgtagtgcagtggcatgatctcggctctctctgtctcccgggctcaagtgattctcctgcctcagcctcccgagtagctgggattacaagcgtgtgccaccacgcccggctaatttttgtatttttagtagagacagggtttcaccatgttggccaggctggtctcaaacacctgaccacaggtaatccacccaccttggcctcccagagtgttgggattacaggtgtgggccattgcacctggcctttgttgttctttagaccagatgcccatcggacatcttctttgactagatgtcccattagtcacttaaacttaatatggataaaagtaaacttttaaaaaacttttcggccatccccataacttagtgaatgtgtaagctatgatatactgattcttctcaccacctacacaagccctgtcagttttttatcctaaatctctctgaaatccatcctcttgtctttatctacgctgttataatcatcagcccttcttattggaatattgaatctggtcctttccattctccctgtgtcctgccttgcttctctccagtccattttttatatggcagctagagtgatctttgtaaaagcaccaagctgatgctgatgttccctgcctaaaacactttgatagacccccatagctgttaggttaaagtctaacctgagcatgatttatgaaatctgcaagtttaggcccctacctagcagtcctcctctgtaaccctctcccctagatgctatatttcagccatgtgatttctctctaagacaacatggtattgccttacctccaggattttatagatcctatttcatttgccactttttgtctataatgaataatactgctgtgaacatttgtatgcaggtttttgtatagacatgttttcatttctcttggatgtatacttaggagtggaattgctggatcagataataatgctttgtttaacattttgaggaactgccaaactattctgaattggtagcaccattgtgccattttacagtcccaccatcaatgtatgttccaatttttccacatgaatgtcaacacttgttattgtctgtcgtttttactttagtcatcctagtgggagtgcagtggtattttgttatagttcttatttgcatttctcttaagactaatgatgctaagaatctttttatgtgcttattaggcatttctgtgtctttggagaaaagtctgttcagattctgtgtgcattactatttgtattatttgtcttttaattgttgagttataagcatgttttgtatttttggaaataagtcccttctcttttttttttttttttttttttgagatggagtctcactctgtcgcctgggctggagtgcggtggcacagtctcggcttaatgcaacccccacctcccaagttcaagtgattctccagcctcagcctccccagtagctgggattacaggcatgtgccaccacgcccatctaatttttgtatttttagtagaaacagggtttcaccatgttggccaggctggtcttgaactcctgacctcaggtgatccgcccacctggcttcccagagtgctgggattacagacgtgagccaccatgcccagctggaaattaagtcccttctaagatacataatttgaaaatattttctccccttctgtgacttgtcttttcactttttcagtgtattttttctgtattctttgtggcacaaaactattatttatttatttaattttccagttttattaaagtgtaattgacataaaaattgtgtgtacttaaagtgtacaagtgatatttggatatatgtttaccttgtgaaatgattgaatcaagctaattaacatgatccatcatcttacatactattttatgtgtgttgagaatatttaaaatctgttttagcaattttcaaatatataatacattaactatagtcatcatactgtaaaatagatcttcagggcttattcatcctatttaattgaatctttgttccatttgaccaacacccctccatcttcctcccccaagcaccctggcaaccaccattttctctgctactatgaattcaaccttttaagattccacatataagtgggattatgcagtatttttttttctgtgcttggcttatttcacttagcatagtgttctccaggttcatccatgttgttataaacgacaagattttctttttttaaggctgaataatattcagttgtgtgtgtgtataccacattttcgttattcatccattgatggacactgaggttgattccatgtctcggctattgtgaataatgtttcagtaaaaatgggaatgcagagatctctttgacatactgattttatttcctttggatatatacccagaagtgggattgccggatcatatggtagttctatttttaattttttgagaaatctttatactgctttttacaatggctgtactaatttacattcccactcaacggtgttcaagagttcctctttctccatatccttgacaacacttgttatcttttgtctttttgataatagccatccttccaagtgtgaggagctatctcattgtggtttttcttttcatttccctaatgatcagtgatgttgaacattttttcatacatatattggtcatttgtttgttgttgagaaatgtcaattcaggttctttatccatttttaaatcaggtttatattacccaaagtgatctacggattcagcacaatccatatcaaaattctaatggcatttttcacagaaatagaaaacaaatcttaaaatttgtatggaacatcaaaagaccctgaatagccaaagcaatcttatcttgagcaaaaggaacaaagctggaagcttcacactacctaatttcaaaacctactacaaagctatcataatcaaaacagcgtggtactggcataacagtagacacataaaccaatggaacagaatccagagctcagaattaaatccatgcatttacagttaattttcgacaaaggtacctagaacacacagtaaggaaaggacagttttcttcgtcaataagtgatactgagaaaactgaatatccacatgcagagaaatgaaattagatccttacttcacaccatataaaaaatcagttcaaagttgattaaagacttaaagcctgaaaccataaaaccactagaagaaaacagagaagttccatgacatttgtctgagcaatgatttttttttaatgtgaccccaaagcacaggcaacaaaaagaaaaatagacaagtaggattgcatcaaactaaaaagcttctgcacagcaaaaggaacagtcagcagagtgaagaggcaaccaagggaatgggagaaaatatttgtaaatcatatatctgataagtggttgatatccaaaacataaggaagcaaaacaactctcaatagcaagaaaacaactcaaaatttttaattttcatgaaattccatttgtttcattcttttctttccttttttaaaattaaactaaaattttgtatagagatggggtctcgttatgttgtcaaggcttgtcttgaactcctgggcccaagcaatgctcctacctcagcctcctaaagtgctgagattacaggcatgagccaccatgcccagtcttacatatttatttatttttattacaaacagggcttcgctctgtcatgtaggctagagtgcagacatgatcctagctcattgtagcctcaaactcctggtggccttaagcagtcttctgccttttatctattattttacttgtgcttttcatgttatatctaagaaacagttgtttaatccaaggtaacaaagatttattcctaagtgcatttactttttccaagaatactacaggtataacattcagtgatcattactgacttctgaattttatctgtgtgaagtccagatacccatatttgactctagacgcaaaattacaactgtctctaggatatcatttaagctaaaacatactaacacatgacttaaccagagtcattttctgaaattcttccttttgttttctgttgttgggatttattgcatttcggtgatgtgaatgggttttagatcacctgggtcattaattaccaaataagtagtttatacagaaaccagtactaaaattattgggttttctcttttgatttaaaggagttggaattgtacaaagaggaacttcagacaaaacctgcactcttggcagttaataaaatggacttgccagatgcccaagataagttccatgaattgatgagccagctccagaatcctaaaggtaaacctatttattcatttaattctaatttaaagaataattacaatgtacagagaatgctgttataatcagtggaaaactgacagtttctgctcttaaaagtcaagtttgaagaaagaatatacaaaacatgtaaataacattgtaacataataattaccaaattctagaatgtttgatatggacagtaaattaaaggagacaaaagaaagattaatttgaactaaaaaggtcaggctacatgaagaataaaacttaaattgggcccataaggcatatgtgggatttgaataaaaggaggaaaaagtcagcatctacctgtgaagtctttcactttcattaacatacttcacaagctcttcattcgtctagtactgtacatcataaaa

SEQ ID NO: 126038 - DNA, 1008 bp, Homo sapiens
tttttattatttgagacagatcattgctatgtcatccaggctggagtgcagtggcatgatcatgactcactgtgtcctcaaactcctgggctcaagtgatccttccatgtcagcctcccaagaaactgggacaacacgtgtgcaccatcacacctggctaattattattattattattttttgagccagaatctctctctgtcaccaacactggagtgcagtggtgcaatctcagctcacggtaacctccacctcccaggttcaagcggttcttgtgccttaacctcccacatggctgggactataggcatgagccaccatgcccagctaatttttgtatttttaggagagatggggttttgccatgttggccaggctggtcttgaactcgggctcaagtgatcatcccgcctcagcttcccaaagtgttgggattacaggtgtaagccactgtgcccctgctaaactgcctttttaaaaaacttactgtctgccctttttagtataacatttcattggttttaggtgattactaatcatttcttctaatccatgggaattcaagcagggtttttagagaagtactatgttaatttggagtatttttcctatttctttaggctcagattattgctactctgtattcagatcttcatgtgtctcttctaagctgaataaagctgttttggaactgtcaggtacctcaaagcgtaagtacgtcctttaattatatcttatttccctccctcctgctaccacatctgccaacaatgactctttttttttctcttgttcaacaaaatagaggtataggacagacctctcttgtgagtacaatgactgatgacttacagtttctaagaaaacccaaattataggtagaaggaactctcaatgttaccatcaagaattaagttagggctgggcatggtggctcagccctgtaaccctagcgctttgagaggctgaggtggaaggatcccttgagcccaggagtttgagaccatc

SEQ ID NO: 126039 - DNA, 1033 bp, Homo sapiens
tacatttcaggaatcagtgttacagggcagtttgattggagaaatctcaattacattgaaattccaattatttctatactacttttgttttttgttcctgtttgtttgtttgtttgtttgttttgagacagagtctcgtgctctgtcacccagactggagtgcagtggtgtgatctggctcactgcaacctccacctcctgggttcaagcgattctcctgcctcagcctcttgagtagcagggattacaggcacgtgccaccatgcctggctagtttttgtatttttagtagagatggggtttcaccatgttgaccaggctggtctgaaactcctgacctcaagtgatctaccagccttggcctcccaaagtgctgggatttcaggcatgagccaattcgcccagccagtatattacttctgaaagcaagaaggaattgtgattgcattaggactttgagtgggttatctgaagacttctgaagcttgaaagaaacgagggaacctttttcctatgtcttcacaactttaatcaaatccttattctccttcatttctcagtctttaactcctgcctgataaatttttatgaacaggtaccttattcactttgcttaacacctaacaataatcacttgatacgtagtaattatacagttgattcaccaccaacactttgagtttacataagacagccgtttctttccacaagtctctataaacacattgggagcaaggtccagttatcagtggtcttggtgtctttccagggcctaacagagtgttttgcatatgctagacactcagcatgatgtaagtacttgctgaatgaatgattgcttcttagtaatagctacttccttgtacagttcttcattaccagtggcccacctttgtgagttactggggtctttgtacagagcccaatactcgtttattcaaataatcctagaatcacttgtgtgccaggcacacaagttgtatgggggagatagacagatgaataagcaaagaccaccagagagctgtatcct

SEQ ID NO: 126040 - DNA, 1033 bp, Homo sapiens
taggcaacatgagaaaaccccgtctctacaaaaaatacaaaaattagctgaacatagtgacgtgtgcttatggtcccagctactcaggaggctgaggtgggaggatcgcttgagcctggaaggtcaaggctgcagtgagccatgattgtgtcattgcactctagcctgggcaacagagtaagacttgtttcaaaaaaaaaagaaagaaaaagaaaaaattattcctatattatatgactagattaaatatacaaataacattgttttctaaagaacattgtgccctcccactggaattcatgcaacaatcacattctaagccagcttcctagcattttggtcataattgtctttctgatcctgaaagcttggaaacacaacttcaccatcccagcagatgtttgattctgcaaaggttgatggaactgtattcagaaataaaaattattctcaaccttgccccttcatcatgctctgaacaaaaaagtaaaccttactgaagtagtctgctctattgcctcatagtaggcattatagaaggcagagaaaatacatttgagtcctgctttgagagtgaatatcagacccttgaggaaattaaagctgaataagatgcaagctttttatagtttgccatatacagaaaaagaacatggccttttaatttggaatgaaaggcctggcgactgtttttcttataatagcattaatagaaataggttgtcgttacttgaaaaatgtttgcattcgtcttatatgaacagtagtagtaataaccaacaagtgctgtagatttccctgaaaatctacatcttgaatcaacaaggaagtaattgggtcatgttgaatcaacaaggaagtaattaagcagaataatttcagggaccattgttctcatcttttcatttgactgactcattggagatgagctcatttactttttataatttcctagtgtgcctagtacataggaatgagatcagtttgttttttcttatttaacattcattcaatgaatgttctttgaactcct

SEQ ID NO: 126041 - DNA, 1976 bp, Homo sapiens
taagaagtagttaacacttggcatagcatttgttgtgttctagacatgttttaagcacttgacattatattatctcattgaacccatagaacaaccctgcaaggttggcactgttattttttccatttcacagatgaagaaaacgaggcacagggaagttctgaatctggcccaaggtcagtgagctagtaagtgaggagatggggattagaattcaagcaaccttgctaagagttgactctcaaccattcccctgtcctgtactgcttctttccctacacctttgctttttatgagccaccttcacccctgctgcatgagcatttgaggctgaatttgtggtgtttgtagctaactgatgattgatgagtgggcccttgctgtgtgagtgcctgacacatacagagtgcttgatgtatatgtgttgaaagaacgattattgacaaaaagaagattgaaggtgtgattgtaagagactttaacattatcttggttgtttttttaattgtgaagaaaaataccgatggctaaagattttagttgctctatgacccagtcagtaataaccaaatgtgtgtgcacctgtgctctgaggtcacacacacctgcatgtatatacatttgtactgtacagagaggaaacaagggagagactttccctctttgcattgacatttcatcattagatgtgttgccagttggcaccacccttcctgctctgttctgctattgtcccctcatgatttgtcctcttgtgtgtcaccccctagtctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctggtcaatagtgcaggttgccacctggtggctgggctgctatttttcctggcaggtactgtgagcctctccccatctatctgggtcatcttttataacatccatctgaacaagaagtttgagccagtcttttcatttgactatgcagtgtatgtcactattgctagtgctgggggcctgtttatgacttcccttatactatttatttggtattgtacatgcaaatctttgccttctcctttctggcaaccattgtactcccatccacccagtatgcatacttactcacagccctattcagcacgctctcgcctctctgccattgaaattgacattccagtagtttcacacaccacttaatggggaaatagttaattgttaaagaaaacttcttgtagcctcacattccccttgtgcaaagagctcttttggacctacatacattttcctttgtttttgaccaatcaatgaagccaaatttatatgtcctagtagaatgaagtgctgctagtttttatgagaagtatattatattaaatgtgaattttttaaattttgcttcttatactggaaggaattttagccttcatattgatatctaattaattatttaagtggaagaggcctgcatcacaattgaggtaatgtagagcaacatgttaaagaatgatggttagcagaagctgttgtatacaatcttcatgaaaatttcagtgtgtatttttctttttctataatacctttaactgcaaagaaaaggcagtttcaaatataagaaatttatttcaggtaagggta

SEQ ID NO: 126042 - DNA, 1595 bp, Homo sapiens
acctggcagttggggaataatctgacttcgttggcagttggccttaacttcttaatcattgatccaggaatatttcaaccagagacacaactttctggcagacagacaaattgtacaacaccaacaatatcctggaccttgaaattctgtttacttcagtccattgtatcctttaaggcacctgtgctagcctagattttgtaataacactgatttatgagaatggacaaaagtggtagggaaattgttccctctccacttctgaaagtatgatgatgtattaaggatggaggagttattaaaaatgtctcttctgatgaggtaacaattagatgaaaccatgttaaagctgagatgaacacttagaaattcagggatattgggtctttagccttatgaatttgagctgcttatttaattggtgtaatttactacatattagtactatattcgtaaggattttttattaaccattacagattttacaaacagctagttatatggtaaacagattattatgcctttttgcaattctgaatatgattctagtatttgtgtagatgtatttggtactttttcccctaattccaacactagtttatatatatagcgaataaatctagttgtataaatttttaaatgccgtcagtagaaagcacacaaggttatgatttttttaattactggcttctgatttctttcacttctgatccttttcctttttctcagatgtagctgagtcttgatcattttaagacaacgatgggtagaattttgagattaatgttaattttccctttttgttaatttcagtcccctctcactatgcttttgtccagaaggatcaagaattctaccatcccttgggtctttgtgtataaacaatgttaaataaaggtagactcagtctttaagatattagacagtttttttagtccatgggattgtaaatataaacattaactttcctataagaatattttggctttgtaatctatagcctcaaattggtatttattatggattcactagacaaacagctgtttccttattgtcttttttctttagtgtttctgatttgctatcagtagctgtttttaaagccgtccaaggaaaataattatttacagtttttgaagtcacttttgagccctcatcaagctctcattgtgatgggagggatacctttttgttgttaaaagcctattattgttaaaggccttttatggaaaccaacttggaaaacaaccttaaatgtggatgtatcagatttggtttatccagccatgggagagaaaacaaacctaagtttactttacttgtacatatacactacaatggatagtatatttgctgtaaactacaatgtaaaacctcaataaaagtgcgctgtacttcttaatgtttattaaaagatgtatttttacaagtttctgcttctgtttttttcctcagtgttttaaggtgaaatattttgagaaatgtttctcagatatatgtaaattgaaaaagacagttccatttaaagctctaaaacgtgtgaactggaaggctgggtgcagtggctcacgcctgtaatcccagcactttggggg

SEQ ID NO: 126043 - DNA, 1139 bp, Homo sapiens
ttgtttttgtagagacagggattccccctgttgcccaggctggtctcaaactcctgagctctggcgacccatccgcctcagccttccaaagtgctgggattacaggtgtgagccactgcacctggtggggtagtgtcaactgtagttcttattggatgctttgcttaagaaaacacatggctaaatttccagaacttttataatgtccaaaataaagacagtatatttaaaagtttgtgccgtgaattgtaagtttgctgctgtagctttgcatcttgcatggcagccacatagtgcgcgtgttccattaatctttgttaaatgagctaggtatgaggctgtatggcaatttgcttatgttagactttgtatttgaaatcaatgggctattaatttcttattcctaaaagtttagtttttcagatgaagcaacttgtctctatttagaattacattactaatgttttgtaaaggactcattagtcaaagtatgttaattaaaggacacgccttgggttgagggagtagacagtatggtaatattgttgactggtatttatacagagccttgtagcctagaagttaaattctagtgaaaatgcagtcattaggaattagctaggatcttaatatggttctatcaaaacagattattttagatttaatgtaggttattttagttttaatgtaggttaagttaaatacataattaaaacatgtgcaagtaattgaatgcaagataagccattcacaacaaaggactatctttttattttccattcactttcagaagaaatggttatccaataaagaaagattagtttattaggcaaaagggaaaaataagaaacttttagaaacgttttatttccctcagcctacctgcatcccccttaactcaccgcaatcacattcttcttgaaaacacaaatatatgaaacagagaaaataaccttttcacgattgttagagtatgtatcctaagcttttctatgatagcttcagtttaggcacattacttttctcagagcttaattgccagaataatttgcttttcattgcttttgtcagaacaaagctttccaatagctacccaagtgcttctatccagactaaatcatgtataaagcagcaaacac

SEQ ID NO: 126044 - DNA, 1101 bp, Homo sapiens
tattgaaattgtgacttgctcagagtcccttagctagaaggtggtggtttaatctagtattctaacctagtctctctgcatccaaactacgctgcctcccaggagaagggagaaagggagaaataacatctaggtactactactacaggtgcagcatatagttgggaaaacaaagttcttacaaagaaacaactgattttggtagtaattctagcagatgaattactgctagaattaggcctaaaaaaggcctaaaagtgaaccttaaagattcctgccatagatctatgtcatttttgaactgagttacacacattttacagagaggaaactgagacccagggagattaaatcattatgttactaaataatgttgctgaagagaacatggttgattagtcgttgtgaaatcaagggagtttctttgctgaattactctttaggttttagatttcagtttcaaggttacgttaaaactaagcttgtattgccatttttatctggatttaggtggggagtgggtggattgtttggtgagatgtaaacttgatccttcgggtagtaatttgtttagtaaaaatttcctgctagacatgagggctctgtagtcaatgaagattatggaaggttaactattggttgaggtaccatggaccaccttgtgatatacagactggtttgagctggaaggcatgatgagaaaactgctgtgttttaactagcatgttctgaaaaaagtgtcagaacatctttcaatgggtgtaaattgccttcactgagcaaggcaaatggttagtattgaacagaaaatgtcagataataaattcattcattttcttcgaatcctgaatatatacacttggattattagcttgtgcgtgtgaagccactctggcttcatttttatttcatattatgacagctaaaatctttgtgaagattaaaaatatggaggaaacagacaggtttttaatatttacatcttagaaagatgaagactttaggtgggtatagggagaaacattcaatactttggattcttttttattggtagagtgagtgctaagaaaagggatagaccaattttttttctctctttct

SEQ ID NO: 126045 - DNA, 1074 bp, Homo sapiens
agatttttactcttattttgtattgctttaaaaatctgcttgtgtactttattatacatctcaatttagactagccacatttcaggtgctcattagccacatgtggctagtggctactattggtcagcacagattttttttttttgacagggtctccttttttgtccaggttggggtgcagtggtgcaatcatggctcactgtagtgtcaccctcccaagctcaagtgattttcccacctcagcctcccaagtagctgtgattacaggcgcatgccaccacacctggctaagttttaaaaattttttgtagagacagaggtctgactgtgttgcccaggctggactcaaactcctgggctcaagcaatcctcgtgttttggcctcccaaactgctgggattacaggcatgagccactgtgcccagctagcacagatctttactgtaacttttcttcttactataaaaagcattgcgttatactggcaattattttcccatcaaagtggcctagaaaagagacatgaatctggcctcatgtctttgctcataattaacacatttctagagagatttcctttgttagaaaaactaattgtgggattaatgatctcagaacgtgaattcaactgtagcacctaaacaggtgctactgaagtcacctaaacagcaggctgaattcttgaccaatagtgataaaaactgctttgtcttatggtaggagtagcagtcaggacaagactcagcatttagcgaaatccctggagggattctcccacataggagccgtgcaactcagttttatgctcctaaaatctactgcaaagctgtgaatgctttttgtttgtgatttgcacttcatttttttcttctcaattattattattttttgagacagggtcttgctctactagtccagagtacaagtggtgcaatcatggctcactacggccttgacctcccagggtcaagtgatcctcccacttcggcctcccaagtagttgggaccacaggtgtgtgccactatgcatggcaatttttatttttatttttgtagagacggggttctgctgtg

SEQ ID NO: 126046 - DNA, 1027 bp, Homo sapiens
agagaccacaccttttatttataaaaagaaaataaacatttaaacctaacatgaaagatgttgaaaactttataaaatgttggtatttttgaaatttttggaaataatacttttagtaatttattctggacttattttgcaggtatgatgaggaaaatgttagtatactattataacagcattaatattcacccagtgaaatctactctgtgccaagaaggtcctagatactgagcacatatcagttgataaaacaggaaaagtccccttcatttctggaacttatggtgtagtatatattttaaggaaattttagtttgaagtgatgtaatacataaaatctcagtgtcatgaactgttgagatgatcataacttattaaaaacaaacacttggaggttcaattcatggagaattcagaatatgaattccatgaacctaggtcttgtttttttatgcagttaccatagaaaatattttcaaagacctttttcactatgaaaataatacaaattagtcagtgaaattacttagggggaatccatctttagttgcacttaaaaaatgagtgttgattcaattaaaggctggtgtcctttcagtgtgttacaaggcaaacatagtttcatgcctgagaatgtacttcaagtacacaacctacagaagcatgcggttcctatattccagaactcagttcacaatacgtgatatataaaagttaacgctctcaagagaaatggaaagctctgcgggaaaaaggttgtgtgtgtgttttatgggtgaggggaaaatatctgtaaatgaggggaaaattccaagcagttcctggaatcagttactgcctcctcagggagccagtgatgagctcaactgggctgagaaaaattcatgcagttatcagcactaactgcatcccagcctcaagccctgccaaagtgcttagtcctaaaagatgaagtgaagagtacaaggtgcagtctccagctgaaccccatgtgcatagtaattttttttgcctgcatctgggt

SEQ ID NO: 126047 - DNA, 1088 bp, Homo sapiens
ctgggcgtggtggtggcatgtgcctatagtcccagctacttgggaggctgaggtgggaggatggcttgagcctgggaggctgaggttgcagtgagctgagattgcaccactgcactccagcctgagtgacagagccagaccctgtctcaaaaagtaaataaataaaataaaaagtgttcaagtaactcaaaggatatatgcagcattgcagtagttcctcttccttcctccctctcttagtttgaaatatgttaacaggctaaattgatagcatggtaaagagagcaaattttaaactgtacacattgtcttgtgggtaatctgccagtatcttgagctacttctggacttagcttttgaataccctcaacataggggtcaattttggcctatcaggggcatggtggaaagttatgaatgatttggagataaaagatctccagataaagtatgatgtataaatgacagtcagaagatgttactgttaaacttgccactccataggtaagagtcttcattcttcatgttatttctccctgttgaataaaaagcacaactctcggttgcatttgtactcccactctgaatttcaattggtcagacaaagagtggggctaggtttttgacaagctacctcctggtattgagaatggttttaattcatgagggttacagcatatgcttttttaaagtatttaacctgcattatcataatgagggccctggctttataaatcccttcaccaattcagtggaacaaaacaaaaagtggactttatttgtgctgctacctcatacacacatgcacacaagcaagcctgaatttcaattgcaaggctgtgttcctcttcttggctcttttgagatcccctgacctgagcccagccagtcaaagctgctagaacgtgtttcagctcagctcctctttgggaaatcaaatcaagctcacaggacagaagggttgctcagaaagtctcaaaggttgctaattgaaaagagatttttttaaaaggtgctcagaactacagtcatcagtatataaaagcctttacaaaaatgtaaaaatgtattttcttcacatatatttt

SEQ ID NO: 126048 - DNA, 1973 bp, Homo sapiens
attatttttagagataattgttagcagtcatacttggacaaaaattgtattacaggtaactgtttttcctctcttcctttctcttctcctcacataaacaaaggaaaccaggttagtgatttattatcaatgaagggccataccgcagagatgcagtgatagaagctcaacacaagtttgttaaatgaatatatatataaaaactagcttcatatttctaaaatatagttgactttcctataagctccctctatttaagatcaaggtttaaatgcttgtatatagccaggtaaatttttactttcgaatctataaatggtgggaaaggggaatcagggtatctttagaagtccaaagcctacacttgtgcaatctgaggggctgagcaagctctatgcatctacggaagtagtggaggtgaagtgtgtgcccctccaaaagcattgaagatctgattagatgtcttacttgtctgttacctcacaatttttattgcctgcccccagaaatgtctttcctgaatatatgtgaagcagtcctacaaaacatggtttactttggacatacacatttcataatagaggatttatttaaattgcttgcagttgtagttgatgtggcaaaatacaattctagtttctttgtgtgtttctttatctttcagaattctatgtatggggtaaaaacctgtttaaggtgaatttttgttgtaaaagattatcttcttttagaatttagccctttttccagtaagatataaatctatgagacttgtaaggcaaggtgtgtttgctgcaacattagctatacaatataaaaatgctgacattgggagcctggggcgagaggattgcttgacaccaggagttcaagaccaacctgggcaacatagtgagactctacaaaaaattaaataaaaaaaaaaaatagcagggcatggtggtgtgcgcctgtatgtagtcctagctactcaggagtctgaggtgggaggatcacttgagcccaggagttcgaggctgcagtgagctatcatcatgctactgcactccagcctgggcaacagaatgagatcctgtttcagaaaacaaacaaacaaaaaaaaacccctggaaataacttttaaagacaacacgaagggaatcattttctaagttatataaatatgatggaatattttaaagccattaagattatgaagactgataggaatatgaaaaatagtgtgaaaagggcattatcaaaaatagtatgtacattatttcatttgtataaacgtgtgctttcagattagaactgaaaaactctggattataattttattcagcaaacgtatattgaatccctattttatacctagaggtggtgacagtgtctgctctcaagttgctcactgtttagtgggagagacagactctgggtgataagtacaaagagggatgagctgcagtaggatttgggggatattcttccacgttttgttaaagtgttttaaatactactatgtcattttatagaattactaagaaagctttactattgatattaatgcaccataatataatgcctttcaaatagttattcatacatatttgcttaatgaatgaacagaatgattaatgagtcattaataagtgttactttcctagcacggttgtaatttaataacattaatctagaattctcttaatgtgaaatccatattgctggcatcagaaacaactttaaatgatcattttccaaagtttatctgagacttcattctgcaaatgtctcatttgttcactggacttaagtattgtatttgataatctagttttgcaaaccacaacttacaaatctttttgggggtaatttattgataaacagttccattggaaaattccctttctgtatctaaaccttataaatgatcactttttaaacagtttgtcatgtatgcagtataatatatagtatactgtataaaatgtttt

SEQ ID NO: 126049 - DNA, 1047 bp, Homo sapiens
tagaggctcccaaattttgctgcatataggaaacacctgggaagctttacaaattttttgatgcctacattacatcccataccaaaatcagaaaatctgcagtgtcaggcctcactattttttgtaaagatccccagtgagcaatagactttaggacccactaacatagccactttacttgattctacaatactgtgccagctactttacttggtgtggaactaaaggaatagggatgattcaatgccagaaggaaaattgactatgttggatacaaagagaagtgttttatagtctgtaacatgtttaataggttgattatataaactgtactttatagatgattttaggagtatctgtagattgatatgattattgtatgacacactcattttagaatcctttatataagatgaatctcctcgtgttatctttctggacagcttcttacctccttgttccctaattctaagagaagaatctaagtgactgacctttctttccttatcaaacttagggtgggaggagaggcaggggtgtcatggatgggagaagctatgagcactgaccagttccctcagaaggaagttctacttactttaaaaatacttaaatatttcttctaaaaaagaatatatgtaaaatgtatgtataaaataaagactgatgataaaaagaacacctctatacctatcaccctgctgaagaagcatacacatacgaatatatttgaaacctttcctcatctaatcccaacccctcaccacttgaggtacctatagttctaaatttgtttatttccttgcttttctataccacatatatgtacacatacaacatactagttttcctgtgcttgaacttaatggtatcatatgaagtcatcagtgatttgccttttgttcagtatcatgtagagcatgttcacgtctgcatagtattccattataggaatttacgtcagtatccattgtgaggtcagtaagtatttgggttgtttccagtttttgctattgtaaatactgccactaagtgacatgatcttgg

SEQ ID NO: 126050 - DNA, 1024 bp, Homo sapiens
ggctgaagtgggaggatctgtggagcccagaaagttgaggtgagctgtgatggcgctactgcactccagcctggatgacagagtaagaccctgtctcaaaaaataaaataaaatcttggtgagattatattctcactaagcagtgaatgacagtgcctgatttcccttattctgcctaattctgggcttattttcttttatttagacatgacattttcagttcttacccctcaatatttcagtaggtttattcagaaatgtttctttgcattccagtagttacattaaagactgtaataattgttctttattttttcatttttatttagtgatagtttgatctttaaaagagagactcccaaagctgcttttttcttggtggcaataaagaaaaattatctttgacaataacggttattttcttttttcttagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaagtaagtattctcccagatttttaatcattatggttctcgatggaaagtagtcataacaacagtcattagcaactgtgcgcaatttgatcatgatttttatgtcctcttgaaagttttagtagtatggtaactaaacagtcataactaaaatatttgatcatctcagagagggagttttgtgagtttaatttaatatatgttgaacaactgcagtacaccaaagactgagcaccagagttacaaagatggatatgactatctctgccctttaggaaaattattctagtggagaaggcagacttaaaggtatgcagtgtgctatgattagacctt

SEQ ID NO: 126051 - DNA, 1024 bp, Homo sapiens
cagccgcctgtagtcccagctacttgggaggctgagacaagagaattgcttgaacccgggaggcggaggttgcagtgagctgagattgcgccactgcactccaacctgggtgacagagcaagactctgtcaaaaaaaaaaaaaaaaaaaaaaaactcaattgtaacagaatttgcggataacctgtttatgttcttgaggtaaatatgttaacgaagtaggttgccataccataatcttccaggtggtgagtgatgttttaaagtggaccttgctatggatttcagtatttgaatctctctccctaaggaatattgctaatactgaattctttaaaatcttggattgatttaggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcaggtatgtttattttctgtggcttttgatttgctactcacaaaaacaaaaacaggaaatgtgaataatagtagtctttaaagatggggtttttaaaatttttttttaacttttttcttttcttttcttcttcttcttcttctttttttttttccatacagggtcttgctctgttgcccaggctggagtgtagtggtgcaatctcggcccactgcatcctctgcttcctgggctcaagcgatcctcccacctcagccttgtgagtaactgggactacaggcatgcactaccacacccagctaattttttgtagagacagggtgtcacctcagattcctggactctccttggcctcccaaagtgctaggattacaggcgtgagctactgtgcctggcctaaagaagggggttttaaaatggtaacttagtgggacacagtggcatgcacctgtagttctagttattcaggaggctgaggtgggaggatcacttgagcccacgag

SEQ ID NO: 126052 - DNA, 2042 bp, Homo sapiens
ctgtctcaaaaaaagaacagaaaaacgatgtcagtgggtccttgtaagtaacctcttgtggttagactaacatctgtggttagactgccataactgtctatggcagtcagttatgaaaacaagatgaagtaggacattgatgaggatgacaaaaatacatatcagtttcatcctcttcagaaacaagttggaattaaacatgtctagggtggtgttgcctgggaacagattaggggcacccctaaatataaaggcacttgtccttctataagtaaatatatggataagccagatcaattttttccttagttcagataaattttttgaagttgatttggaagcaccaatttctgtaagttaatagttttcaaatgtggaaaatactgattacaaagtgtaagaattatgccaatgtgttttgaattcttattttgaaaaagttacctgtaataatagtcaattaaaaaaaataaatctagcacttactattttctttcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaagtaagtattactaatgcaacaaaattcattatttttttagtaatgaattttaaaaattcactttcaagaacaaatctaaatttgttaaaaaagccatttcgtattatatcatgtatgaaaaattagtgaatatgtgttgctatattaaccaggaatttaattcatacttcttaaatggttctctactaatattttcttttcatttcctccctgtctctattttgaaatcttacaaattgtgtaaggttgattgagggtatttctgcagaaattaacctgtagtcacatcctacctttgccaattctggtatggtttattttagttaggttctaaatgataacaaaactaaatatattccattttcctttaattagagccacaggaatctaactgcattaatcagaatttctgatggcaagtagcaaaacaatttgaaatagtttaagcaaaagggaggtacttagtgtaaggattcaggctgtttccagaacccaagggcagaaatacaaccaggcctctgaaagggattggaactacaaactggaaagccatagggaattcgggaagtactgtctttgatgccccacttttcttcgtatatctgcctcagtctcaggagacctaggttctctgctgtatcatggaaaagataagtttattggctcggcttgggtatacctatctagtcagccaaggtagcatgtttgctagggtctcaagcctgcagagttcccagagagctattgcagggacaccccaaaggtgtctgttccctaatacagtcacttcagaatttaacgttttgaggtttctttctattttcagttacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggtatgtttattttaaggaagtcagctaacttgtagaagctttagagtttcaagttttttatgcaagtggtttttttttgttaggcacatgaatcacaaaatttcataattaagctctttgtgtaatttatttcaaaagcaaatgggaatctcagtaatgtagtttttaagataatagtcattactgagttccctaaaagtgatcagcctatgttaaactgaattagcaggaaaatacaaatttatagctatagttttttttgtcatttataattatttccacttattttagccatggttgtgaaattcagaaaatattttcacaacagagagaaattttatggattttaatgagaaaaaaatt

SEQ ID NO: 126053 - DNA, 2825 bp, Homo sapiens
tagaatgttgatcagttaataagaaaaatgaaaatgtaacagtttggagacatctaaaatcagactgggtttttaaactaaaaattttaatcacagaaatgttaagagaaatttcttctaagaaggccaaaactactgtagtgtttgctcacaagtagtgttggttacacgagttctaagtgtcattattgtggaaaaaattgaggggcaggaccaacatttactttttgtagaattttttaaaagagaaacttctgtcagtcttttggtaatgagatgaagcagtataatttgccagaagctaaaaatgccattcttacattttcattttttttcctaaaggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaatgaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgaccatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacaggtatgtttacttcttcatatatggtaaagcacaatgaaaaaaatgtacatttcacactaaggtttcaccttcatagaacataagttcatatcctt

SEQ ID NO: 126054 - DNA, 1133 bp, Homo sapiens
gacaaacctttattgatgggaagggaagttcacagaagaaatcgagcagtgacttacacaatagtaacacctaagagcagcctaaatatgcttgaaataatgtggatgccacacagatatctctaatacacttaggtagtttgggcagaaggagaaaaataaaaacatcatagaagtcttttcagtgttgggatgcaaggaagaaggaagagtggcaggaattttttagatactgattaattattgatgctgggagaggtcatagattgaagtgtatgtgtttaaaattgaagatgattattagaatcaaaagagataccggagcttagaaactacaggaggaaccactagaatatcagctccttgagaacagggacccagtctcctgtatctctaatgcctagaataatgtctgacacatgataggcagttaataatttttttaaatgaatgaatgaattcatgaataaaagggggggaataaataaagcccacttaccaagaaccaacagtgaaatagcacaggccttcatgttagagtcaggaagaagatcagaatagcttttgtcacttgcttttctattgtgtaggtcctaaccattgcaaagacaaaaagatatatggtatgaatggagaaaaagatacttaattgtcataattcccatgtataattaaattaaaaattaagcatgagaactgaaattctttttttttttttttttttttttttttttgagacagagtctcactctgtcacccaggctagagtggatctcagctcactacaaactcagcctatcaagtaggtgggattacaggtggcctccgccatgcctggcaaatttttgtatttttagtagagatggggtttcaccatgttggccaggctggtcttgaactcctgacctcaagtgatttatatctttaatgtaaaataaatatgaataaaacaatgtaaataaaattataacactttaatgaaggataggaggcttgaataaatgaaaagtctcatttctgagtgggaaaatttgaatatcgtaaaaacccaggttatctctagattaatctgtaatccttatgtagttccattccaactcacaatgaaaagttactgaagttcaacttagtaa

SEQ ID NO: 126055 - DNA, 1023 bp, Homo sapiens
gcctgggtgacagagtgagtatttgttaatttgggttgtgagtacataaatgtttattacttcattatttccatgtctgtacgtttaaaatcttttagaacaaaaaatcaaagatgagtcatgctagctataccaaatatcacaatttagtataaaactgaggtaatgaaaacattgtgctactttccttgaaaaagaaaggtagatcaatgcaacagcacgaagatagaaaaaaaattagacttcagttctcatgaatttttaaactcttgtagtcagtatatgcaaaaaaaagaagttaaattatttgatttgtcatttaagaatattataatgtttacatatgtttactttaagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtaaaatggtttctgacttataagtaccatgatccaaataagtattggatagagcccaccattctataattttttccttgtcatagaacccacagaggaaggtgatttgtttaccagttgttgatataatcactagacattcatttaagtgcttgagaaagctaaaatcattttcccataggaagtcacaatccattgcgaaagcatatataaaataaacaatttctccaacagaagaatgaatagaaagaatgggaggagaaaggagaaacatctagtacttcctggcaggatgagtagggtgaggtggtagacagtggtggggttggaattttttttttttttttttttttttttttttttttttgagacggagtctcgctctgtcgcccaggctggagtgcagtggcgggatctcggctcactgcaagctccacctcccgggttcacgc

SEQ ID NO: 126056 - DNA, 1098 bp, Homo sapiens
tctggaggctgatgcaagagaattgcttgaacccagaaggtggaggttgcagtgagccaagattgcaccactgcactccagcctgggcaacagagtgagactccatctcaaaaaaaaaaatagaaaagaaatgtagataaatacgtttacttaacaggtagatgaatacagcaaacaggtagatgtcttttctgcacaaggggtaataagaggatatatatttgaatgcagtaaattagctgcaattacagaggcatttcagagttactttgggatcaggatcaggactgcaatacatcactgtgtaaccttttggcttcatcttctaatattcctcctcatttcagccatactgaaatacttagtttcccaaatgcaccctgatctttggcaccctgggcttctttgcatgctgccctttctgcataatactgcccatcccctcccagcctttttggtttgttcctgcttgttccagttggttcaaatgtttactccctctgtgtcatcttctttacctgtctttctaggcttaggcatttcttcctctgttcccttagcaacagtacaggccttgcttatcgcgtttctcttttttcgttactttaaatacttgattacccttctgtccttcttccatgttcctgtagctccttatacacatttgcatttgtatcacattacttttcatgttatataattgtttaccattctgcctctttcactattattctaaacccttcagaataagagaatcttctgtttatttttatttccttctcttaacacagtgttagcatacagtaaaggcttaataaatgtttgctgaatgagttagaaaggttggactggaaacttaataatttacctgatgatctttattttccctgggaactaagaggcaagatcctctgttgaaattactcatggggtaggaattgggtagaggatgtataagagtagtgaacagttaaaacagccttcttagcaaatagctgttttttcttttgctcagctgcttctacagtatcctttgttcatctggtcttgcaagtccatagtctttccccttgcttttaaagtcttctgttatttgga

SEQ ID NO: 126057 - DNA, 1145 bp, Homo sapiens
ttacattgatttttcttggaagagagaaatataagggcttttattttctaatttttactgaacatttatgtctgttataataagaaaacattttactttttatttaaagtggcaggcagtaaaataaatactttgacattagatttattgtaaaaagagaatccatctcggtattactttattataggatttctttttgtttagaaccgtgaggccatgcttttttctgtttatacaattttgagtactaatttactttttaaattcctgctgatatttctaaatctaatcctttattgtttgcttttatttctttaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctgtaagtatgcctccttgaatataaaaaacttatttaaaaattgtgaattctttcactttaaaaatattagcaatagtgctgcttaatgtttggaggaggaaaatatcaaattcagtcttatgactcacgttgttttgttttgttttgtttttgaggctgagtctcactctgtcgccagggtggagtgcagtggcatgatctcggctcactgcaacctccatctcccaggttcaggcgattctcctgcctcagcctcctgagtaactgggactccatgcgcgtgccaccacatccagctaatttttgtatttttagtagagacaggattttaccatgttggacaggatggtctcgatctcttgaccttgtgatctaccctcctcagcctcccaaagtgctgggattacaggcatgagccaccgtgcccagccagttcacactgttaatgtgttttattaattgtaagatatatg

SEQ ID NO: 126058 - DNA, 1734 bp, Homo sapiens
cagcagtacgcaaacacaggtagtatggactttgccccacctaggagcaatggatcaccaattcagtaggatttgtttgtctttgttgttggtatgagatgtattcttttataggtactgagcttaacatatttgtgactgcatgtgtgtaaggtaggtggagtcaaaatgccttacatttcatttaaggtaatttgaatctgacattctgttaacagcaagtattgtttcaccaaagagaacctaacaaactttattgttgcactacagcatggataatttgaacccattaaaattttttatttgtgtacgagaatgttttatcctcttttgataacactaatctcgagtgtagttaaatattataccaaccagtatcaattttgtgcacagaggtttctattttatctcataccaatatagaagaatgacatgctgtttccaagttgacaggttttctttctgtcttctcctctcttcctttacacaaacttaaacagaatggaaatgaaaaccaaggagaagttgaagaacaaacatttaaagaaaaggaattagacagaaaacctgaagatgtgcctcctgagattttgtctaatgaaaggtatacaaaatgtgtactttttcagtgcaaagtaaattaaaatggttgtttcaatgtaatagactttgtccttatttttatcttgtacattgatactttgtcttaaaaatcatcataccatctgtgtatgaaacatgtccatgtatgtgtagtatgtaaaggattttcagtttttcatcattaaatagataacattttaaaaaaatcttttctatataaattttgattggatattaatcacatacttaactgttaatcacctgatgttagcaaaacttttccttactttgattttgtagaggttaatataaaaatgtgaaatattaagtgagaatagttatcctacattagtattaaagactttaagcacaatattttaaactttgttttgttcaaatgaaaataatttctttaattttaaattaaaactaatatttacttcttaatttcctccttttccaatttctgtgactgtcaaccctcttgtgtcctcctaacctccttcctcagcttgcatggaggaatttggcccctaagattttggcttccccattggatcatcagtatggaacgcagtcagtatggaactcaaacaagaaagacagtgtatgaaaattagagttaccacggcaatataaaataaacactttgtttattttatattatttatctctaattggtaaattttgaaaactatgcagtatttaatttctaggaatttttatagtaagtgccaataaaatgagtatttttttttaaccaccatattaattttaatcatttctcttaagtagaaatattttcacattattctagttctggggtttggggcttaaacaaaacctcagaacaagttaaggaaataaaacccttggcttcctactaaattagtttagttttatttttagtattcttgattatataagcagagaacttgatctaggtgcaaaaatagaaccgtctctttcacttgacaaatactaacggaaaacttctccatttattatcttgtcttaaaatagatatgtcatgtgcctgtgaaacaggtatcctttagcctgatttttggcaagctcctacagtgtgaagctaaaagataaaactgtcttaaggcagaagacctttaccat

SEQ ID NO: 126059 - DNA, 1041 bp, Homo sapiens
attttaaaattatgtttcaaaatatgtttttatgtttaacatatagaaagatttaaatgtgcaaaatacatatgtataaccatgggcagcaagctcaataacttgcatatgctttggcactaccatactttttaaaacttaaattttgtctcccaagattttctcttaacctagttactggcttaagactttagttatttttttcaagtcaattaaataccgtacattttaaaaaatggtatgattaagctaattggccaaaatttttcagacaaaaacaaatcattttataatatagttacaaataaaaaacaagaagcactttattgtagatgctattgggtattttaataaaaaggatcatctgttatttttcaaatcaaatattttgcagtgtactttttagtggacataagcaaagtgtttgcttcaaaaatattaaacattttaatcagtgcttctttatctatacaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagaggtactagttttctgtgttgtggaaacaatcatttcaacaaatctgctgagttcaaggcattttgccatgtgttgaaaatatagaagagaaaataagtattttccagcaaatggaccttcaaacagaaatacattagagcaactcttttcaaacaccattattgtatagcatttgcaagtgggtatcatagagttgtcattatatttacccagggttgccacagtgcctacataaaccagaatgctgttacatttctccaccgataaaagaaaatttatatatcagcacttagtactcttaccagtatctgtgaggtatggatgacatcctgaaaccatcctatagattaaggaaagattag

SEQ ID NO: 126060 - DNA, 1760 bp, Homo sapiens
tatataacttgggcttttaaagtttagtcagggttcataagataccttaagtggtatagttttcaactgttacatacagtgtagctttaaaaagaattttttccttagcatgtactctgtaaacaatatgaaaataggttataactgaaatgtctatagttttagtggctgcttgaaagatgagtaatatttctaaggaaatagcaaaagtaagttttaattttccagaaataactttgattattttatatacttgaataacttattactaatgtggactcaagcataattaatttcacatttttaaattaaagcaattttttaatggaacggaaaaacaccagcttatcttacaaacattataaacttgtctaaatgccctttcaaagccctgacgtggaacttggatcctgtctggcaggcttttttgtgggcatattaattcacattccacctgtcagtgtacctataggtaaagacattaaaccacaccctctgttctgaccttttcctcaggggacactgactagaatcctttggctcagcatgagaggctatttgaatagctcagttcagaagagcttttccttttgaatagagtgaagcagcaagagcaagagaaataatgttacaactgcatttctcaagactgctgctatggagatttcaaacttgaccttccctgccaggttctgctttgaaggcttacttattactacagacatcgctgatattaaaagcagttttattgctcgtctaattagatgtttatatttttattcttctcttcaaggacttaattatgctagtttaaaaggtgtttttgtttgcttgcttttatttttgttttttgattttttttggtttttgttttggtttgggtttttttgagggggcatcaagattgatagagacctaagtttttttagatttgtagtttttttcctggactttccccttccttttattgtgcagttgtatgaattaattttataacatttatttgatagtgctaaaaaagaaactttttatactgctatggtagatcttgataaactaaaaagaactttttaatgtattagaaaattgataaagcaaattaggaatctcggcagctgtatcttctgggatggattcttatagcacctatttggcaactgtcaaagtcagtggctcgtggttagaagagcaagatgaagacatttatgaggttgaatctcgcgtgcctttaccacatccttttcctctttgtgaacatttggatgaaaataactcagtaattgttaatacttctattttccattttattcataaaagaaacgggcatatattaaagcttatttctaaaatttcactgcctacccctccttattcagtaagtataaaaaatattcatttagttaaacactataatgagaaattaaattttgagtgtctatattaaggctaaatgggatagaaccttgtttgatgcgttactactcattcattctagatgtatttaagggctaaatttggtctgagttccaacttggctatgtttacaattacagaaagcagaatgagataatattacatttctccaatgccaggcagtttgtttaaaaagatcccgcttttccttaagattcttgcttttgtatgtttatcatgccaatcctgaataagaatggaataattattatatttgagagactcggtattatgatacttataagacagctaagtgaattgtcattgagcaattaggaaatgtttac

SEQ ID NO: 126061 - DNA, 1080 bp, Homo sapiens
tggattataaggctgattaaatcttgtcaggaagtagaacatagaagcaaaggcttatttaatttacttacctaaagcaagcatttattttgttgtaaattctttgttatatccttatagtaaatttaaaaaagacaaaaaaaagcatatcctttttagttacatgtatttactagatagtcattatgtaatgaacagaaaaaaatgacaaacgtgtaaaaacaattgatatgtttttaaaatatggattgtgactgtaaattcccatgtagttgtatataaattagttcatactttattgttatgtttctttgtaataaaaattaatgatattagttatccagactttaaaggaaaaactctttccagttaaaagtaaaaatattccttttgagataacaacatattatcatgggtattttaggaaataatttataatttaaaatgtatgattaattttctattatgagtcttatacgtgtattcatattaattgcaaataagttataagtgatatttgaaatatcctattaaaacaagaataattgcatactggatattttggaaattgatttagagtagccatcaaaagctgtagttactctaaaatccatttgctatgacaaatacctctcagatgtgaaaagtggaagtctttaacaataaagtatcctttagtattatcatgattttgtaatacattttcaatatgtgactataaattagaaaccactacatttgatcatattttaagcttaaaatgcactaatatctttttaatgcacaaagtactttatatgtaaatttacaaattcttatgactttactgtgagcctgttattaatatatgtgatgatttcttcttacaatttttggactaaatactagaaacatttgagttcaattttttcccatgtaattgtttcagtaataacagataagcaggtgctgatagtcaaaagctcagaaaactaaggcagagacagtacttttctgcaatttcacacagctcatttagtagcagtgatcaagagagctttggctttaagccttctatcatcttaaaaaattgtttaagaa

SEQ ID NO: 126062 - DNA, 2252 bp, Homo sapiens
catactagttaaagaccctagggatatgttctttccattttcttcattagaagattgttttatttttactatatacactttgttatattaataatattaatagctaacacatagtgcttaccatacctcagacactcttctttacatgtattaactcatttaatgccaaaataactctaagagatcagtaataatattattctcagtttacatataaggaaactaaaggacatcatcataactgtcacatgggagataagtggctgagctaggttgggcctacggtctgttcttaagcactacaccacactacctctcatacatgtcagttttcccttgattcacatacatgtgaccatgcaaaagcaactcaggaatatggatctaataaggagtaagactaacaggaaatttcaattatagctgtatttatatttctgtaactcttagacttgccttggttaaagatttacagtgtttgatcttcatgtttattgtgtatgcaaataaaattgactttatgggtttggaatgaattgctttttgcctgaggtgaagaaaacggtgagtttttttctgtgcttgaatttaattggactttgttctttgcccagtagtaaaaatagattttttttttttggtcatttgctatgttgttttcacaaaaatattattttcagtgacaggacatattttttgttaataattctgtataattttattaataattgcttgtttacttatatagaaatattttaatataattttgatactttcataagagaatatttactttcatgtgtatttaaaataattctcagcctttcatgaacgtaaaatttggacatagttatcagggatttcattatcataagatcattaattgtgatttaattcagtatattttgtattaataaacagaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgtaagtattctcaagttgaatactgatttttctcagtggaatgttctttgctagtatactaggctatgaattttaaattatgaaaagactgttgagttagtttttcagtgttttattaggtgtcgaatctactaatcgatcaaaaagtactattccaatttaagattccaataatttttattgtgcagcactcagaattaaaatcagtacattttattatgtattgaattatacatgataaaaattatgaataagccccactagttttccaaattcagatcaggagcttattctagttttttatttaaccacagactaagataggcaaagagataatgggccaccactgcttcacctgtaaaagatacacatagaacagtgtggccattggaaatgggcccggaacagtggtcatgctgccattactctcttccaaaaagatgttaaatctctaatttcacatttttttttcctttgagatttcacttaagcctgatactctcttcatagatcagagaatcagattcttactcattttataactttagacataaaacctagattaggattcaagaaactgatttaccaaacaatttgttttatggattttgtttaatggctaaactaacatggaattcctcctttgttccagaaaagtaaattcattttaaggtgaatattttttcatcctgtatttaatattacttgaataaaaaaagaaatgtacttgaaataatattttaatattaatacttgaatttttgttgaggaggccaaataggctatatggcatataaaaaataaaatgttatcttttaaaacttttgtgatttgggatgttccatgatcatcagtcctttgtcttcaaacaaaactaacatatctctaaaggagaagtaagaaataatagcttctctaaatactgtttcttcagctactatcattattgtcattaaactttaggagcaagccattgacagagaacatgagagagatgtattccaacaggaaatacagaaactagaacagcaacttaaggttgttcctcgattccagcctatcagtgaacatcaaactagagaggtaagaacttcactg

SEQ ID NO: 126063 - DNA, 1093 bp, Homo sapiens
atttcctatctgattactgtaaaacaataaaatgagtcaaaaattaaaaaaaaaataaaacacaagtgtggggtgtgacatggcattttgcacacccagcatgctcccacatgatgccaactctactgctctcgagaccacactgaatagcaaggcttcatgtcacaaagttaagaaattgatcataaactgttgtataaaaaaaggaaatttcgtatgagatagggcagcaatttgaacttaaataactatttatgtgttgattttaaaataataccttgtcatcaaagtagttacagaaatgtagggatagttgtaaatactatgttaaatcactttgaagaagatataatcattgcagttttcagcaacctggtaattatttatgttcagtcattaaatgtatttcagtgtctactgagtttaataaccagtgttacagaaaaaattttaagtgtaagtcttagacattagttattagaagcaggataagtgatagtttagagtggaagattcagagataaactcctcaggttcaaaagctggcttctccacatactcgccatgtggcctgaaagcaaattactcctctctgtgacgtccatcctcatctctaaaatggggatactcagaacagatcttataaagttgtaacagggttttaagaaataatacatataaagcactttgtgcagtgcttagcggtaaactgttacaagtgatggctgttactactagtattgatactgtttaggaaatactaagctaactggtttttaaggatttgccagtgttcagatatggttctcagtatgtgatgtgttagtgtgtaatcagcgattccctctttcagtttctaaggcagtaaatgattcataagctgctttctgagccacttgtcactaagtgttgctgaggataggctctgttgccttagataacagagatgctcctgcatcttagtttgctttttgatcagcagttttgatcatgaggtaaatacacatttggaaatcattcattcactttgtattaagtagcaacaaaccagtgagctaaatgaatgttactgtcctcagtcaaaaccaatttt

SEQ ID NO: 126064 - DNA, 1097 bp, Homo sapiens
agacacattggtttaataatttatatgtatttttctcccctcctaatattgtcataggattctaatgtttttcagaaaggctctgtgacttagattttatcatgttattctaaccaaatctattataaattataatatttaatatgagttaagtaaggtaattacctttggtgccatcggttgtagactttatttccgtacttcatccttttccattaagaagtattgatattgactattttcctaatagggaatcagcaactaaaagcttatattactttatacttaacagaactttctgagccttgtttgatatgatgggggagatattggtctataatgaaattaagtagtatgtctgagaagtagtgtattatttttgtgtgtgatcatctctttgaggtactgccctaaaataaagtaaaattttcaaaatgtaaatacatatatattatgtatgttacctttttcattaattattaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataa

SEQ ID NO: 126065 - DNA, 1050 bp, Homo sapiens
tacctatcttaattacgtttcaaagtatatactcttttataacaaatgagctccataacttaaaagctagataaaaagtattttgtggatttgatgaaaactttcattgttataaatttctttaccaacatcttcttgcttggttttcctggaaatctttcttaggaggatactttttatttccattctgttaatgaaggagtagaaagttgttaaagagaactgtatatcccatgagaaccaaaaatagaagctaataaaattatttcatttctatagtaatctatgaccatacgtacatacaaatatatatatgtaaactgtgagcgtttctgaaatgtttttcctactactctgaggaaaatgaacgtataatcatgaattacattcctcccacaccctttaaattctacatttaatatgggaagattttaactgaatgccctactgttctattcattacgttttaggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagaggtatttggtttttataatatgtgtttttcaacattgtgtggttttttaaaaaaaaaaaatcagtttaattcattttgtagatgacaaaccaaaa

SEQ ID NO: 126066 - DNA, 2057 bp, Homo sapiens
gtcagggaatttatcttacacacagtcagggatttgacatagcatcagaaggccgaggagaagaaagtgaaagtgcaacagattcctttccaaagaaaataaaggtactaaaagatagataccttttattaactcagccagtgttgtttctatgttgaacatagcagttcattagaagttatatggtgggatcatttctgaagagagaattgcttagctagaaggaatctgagagatctattttatttccacatttcacagataataaagtaagagattaatgataatatgtatgaagactttttttcttaataattcttattcctgatgtattcgtttgccagaatttttaaagtagtctcaaagagtagaagttagagcccatgtatttattttggtcaaatcagtagcttatcagtaaacctaggaagagtacattagccaaacagaaggaacttagagatgagagctatggaaagtcataggccatctgctggggttggcttacccctccacaggaagaaggcattcagtaatgttgggctggagttttctctctgcaagctatcttgcttaaaatttatttctgtttgtaagtctaatttttcagtctgtgaagaagttgtcataattctggctcttgggttttggtttccagggattactgagagctgtccataatgaaggcatgcaggtgctttctctcactgagtctccctatagtgatggagaggaccattctattcagcaggtttcagaaccttggctagaagagagaaaagcttacatcaatacaatctcatctctaaaggatttaattacaaagatgcaactgcaaagagaagccgaggtaaccaaagaatactatgcatttaaatcattttatgtattatttgaacaataataatacattataaattaaattatcttttatacatatttttgcatgaataactatatatatatattttcacacttgaaactcagccagaagcagtgcctcatgcctgtaatcccagcactttgggaggccgaggtgggtggatcacctgaagtcaggagttcaagaccagcctggccaacatgttgaaacccgtctctactaaaaatacaaaaattagccaggcgtggtggtgggtgcctgtaatcccagctactcaggagaatcgcttgaacctgggaggtggaggttgcagtgagctgagatcatgccactgcactccagcctgagcaacagagtgagactgtctcaaaaagaaaaaaataaataaataaaagaagtacacatgctcctaggcttttaattatttttctttgtagattaatatttttagaatgtttttaaaacatgcttatttgaaaactaactatcgttatatgtactttgctaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacaggtataatgaaacttcattttaaaaacactttaatagaaataaggaaatgactattgattttagagtcttaatttaagtatgaaggttaagattttaataggagccactatgaatattttaaaaaaattattgtaactattttaacgtattatgttagaaggtaagaaagactgaaagttaatgagcttattttctaacctaggaaattagaaaaagagcaacagaataatcccaaacaaatttgagagagtaaattctcattatttgcactggttatgttccataaagttgctctgaacattgagcggtcattgctcctaagggaaatacaaggttaggttcctgtaagcctttggtcacaacattttcatcagtcagcacataaccttgtctatatgtgattctattttaagacaccttatttactatatattattgattgattaaccttgaacaccaccaacagcactataactc

SEQ ID NO: 126067 - DNA, 1049 bp, Homo sapiens
tggtggtgttcaaggttaatcaatcaataatatatagtaaataaggtgtcttaaaatagaatcacatatagacaaggttatgtgctgactgatgaaaatgttgtgaccaaaggcttacaggaacctaaccttgtatttcccttaggagcaatgaccgctcaatgttcagagcaactttatggaacataaccagtgcaaataatgagaatttactctctcaaatttgtttgggattattctgttgctctttttctaatttcctaggttagaaaataagctcattaactttcagtctttcttaccttctaacataatacgttaaaatagttacaataatttttttaaaatattcatagtggctcctattaaaatcttaaccttcatacttaaattaagactctaaaatcaatagtcatttccttatttctattaaagtgtttttaaaatgaagtttcattatacctgttcttgtattctctgttccaaacagtttagtaaaccaactgcatctgtagtacctagagctgtcagctccgtccgaaatgctgctagtaaaacactacgctcttctaagaaaacttgttgaagggcaagcagtagttcacctcgccagtctgagaagctctcatgagattgagaactatcataaacctagcaaagtacatataacgatagttagttttcaaataagcatgttttaaaaacattctaaaaatattaatctacaaagaaaaataattaaaagcctaggagcatgtgtacttcttttatttatttatttttttctttttgagacagtctcactctgttgctcaggctggagtgcagtggcatgatctcagctcactgcaacctccacctcccaggttcaagcgattctcctgagtagctgggattacaggcacccaccaccacgcctggctaatttttgtatttttagtagagacgggtttcaacatgttggccaggctggtcttgaactcctgacttcaggtgatccacccacctcggcctcccaaagtgctgggattacaggcatgaggcactgc

SEQ ID NO: 126068 - DNA, 1045 bp, Homo sapiens
tttttaaaattgaggaacgtacaacaaaatagcctgtagtcttcaaaaattcaaggtcatgaaagacaaagaaagacttgggaatatcactttttttctttttgctgtgaagtacatttcacaaaatttgaataggctctgtatatcacataatagtattgtagtaatgttaattccacttttgctaattgtagttatgtaaaagaatgttcttgttttaaggaaatacactctggtatttagaggtaaatgagcatttgtctgcagcatatcctcatacattttggaaaggaaaaataagaaaattttttaaaaaagaaaattttagtatgtgtgttccattcattcttctttagatttcttggttgttaattgtattgcctttacattgctcttcacttgttttttaccttcctttgttacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaaggtatgttgtatgacaagctcatatggttacacaaacaggtgaaaagatttcactttgttttctttcttattattattaagttaaaacatattttcttggtcacattttcttctcattctcataatgttaaggatacaatctatattaattactctaggggttagaggattgtctaattggtttaaacagctacgttgactttaaaataaactgccattcccctgataaggttaagcccattggattcattctttttctttattttagagctgtatgttaagaaaacagtctttccaatcataaaacagaaaatactctttagaggaaaatccacaatgcatgtaactaattattttttaatccttttttaaaaaaattgtgagccataacatacagaaaattacaaattgcaaatatgcagtatgacgcatttttaaatgagtatctatggaaacatcacccatgtgaatatagc

SEQ ID NO: 126069 - DNA, 1010 bp, Homo sapiens
atggtctcaactcattgcaacctccacctcccgggctcaagcaatccccccacctcagcctcctgagtcgatgggactacaggcacatgccagcacgcccagctaatttttgtatttttagtagagacagagtttcaccatgttgcccaggctggtcttgaactcctggccttaagcagtcctccctcccacctcagcctcccaaagtgctgggattacaggtgtgagccaccatgcctggactgcattaccaactcttgggactataatttttcatgtttcctttgaagtaatctccttaactacaaatcagttcttatcaacaaatatttataaaccaaatatgagttgcttgattatgtttcaaatattaatcatgttctgtgtagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggtgtgccaggcttccttattaaaaacatgtaacaaggagtgggagtaattttgtcataaacactgtgcaaatatagagaaatgtaacatgcatgatatttaaatagcatgcaactgttttttttaggaaaaactataatagaaaaaactctaaatgtttccaaatgatgaacttatgatcgtgattatagcatattctctactgtgacttcagttctgtgtgagacttgtatgaaatagaattttgactttgacctttattttaccatcaaccaatttgaagtgatatttatgaacgcagtagaattcatgattgagtgagctaaaatatgcaaaatatttgaagagacaatgcttgttaaaagaatatatttcttggtataaatactgagatattctgtt

SEQ ID NO: 126070 - DNA, 1050 bp, Homo sapiens
gaggccaagacaggcggatcatgaggtcaggagattgaaaccatcctggccaaaatggtgaaactccatctctactgaaaatacaaaaattagctgggcgtggttgcgggcacctgtagtcccagctacccgggaggctgaggcaggagaattgctttaacccgggaggtggaggttgcagtgagccgagatggcgctactgcactccagcctggcgacagagcgagactccgtctcgaaacaaaacaacaaaaaaaagaaagagttaatttgaaatgaaccccagtcaagaatctttaatagtttatattttcctcttagctagtttattatatgcctcaacttatcagtagaagctgtttttctctctctcattatatgcttcgtcaacatagctttatggaaattcatttgtctttctgacttaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggtactgttatctttgtctttaaatgtctggaaaatccagaatgatagaagagggtcttaaggctttcctccatctaaaatgtcaaccttagacttcttaataagatatggtaagttgttcactgtgcattgaatactacataaaccgtattatgaggaaatgctaatggagtggtgattggttttttttgtttgtttgtttgttttgctacatccaaagatgcatatagactgctctgctgcaacatgttttgggcatgtgaattggtacacacagataaatatggcaatcctgtcagtttaatacagaggtagttttggttcctgttttctcctagggaagaggaacagggatacttttctggagccctcactgcttaagaacatttaaagtgaacattggcccctttcagagagacacacccctgctttgcaaggctctcagctcaaggcaggctgctttgagtatctg

SEQ ID NO: 126071 - DNA, 2634 bp, Homo sapiens
gtttttttttttttttttgagtcaaaagtctcactctgttgctcacgctggagggcagtggtgcaatctaggctcactgcaacctccacctcccgggttcaagcaattcgcctgcctcagcctcccaagtagctgggactacaggcacgtgccattgcacccagctaatttttttgtatttttagtagagacagggtttcaccatgttggccaggctgggcttgaactcttgacctcaggtgatctgcccgcctcggcctcccaaagtgctgggattacaggcgtgagccaccacgcccggccaagtatttttaataatattaacaagttcttaaatttgattttctcgtaccaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgaggtaaactgacagtttctttttagatatttttaaggaaagcactgcagccctttgatcattaaattttgatattggattaaattacttaaatagctatatgtaaatcacttaaaaatgaaatctatagaagtttattggatataaacaataattgtgttcccttaagatagactgtgatatgctgttcacttataattattgttttcttattctgtccaaaattgccagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagaggttagacttttctgcctgatctttgggaaagtagtattcttaggctgggtagaccccatgcctctgggacagctagccaagggtggggaattgaaattttaaaggtaatgcgtgtttacattaggaggtgatattctttaacagaactcaaatgtctgaaaacaactatctaacactttgacccagggaagaaagcatgggatataagggagaagtgataggtgaagtagaacgtcgcctgctctgtaatgtttgtggtagtaaacacccccaattgagaaggtatgttttgactttttgtctttttcttgaagactacagtttgaaacagcagatgatgaagatttcatttgggttcaggaaaatattgatgaaattattttacaactacagaaattaactggccagcaaggtgaagaggtaatactttttaaaagttatttctgaagcattgagagcaaagatttaatagaaactggataatttgaaacttgcagcatattctttatactctttatagagttttatttgtatctttttatttattttaaatatgaataataatgcttgctttcccccaagagaagataatgaaagcttagggggggaattagctttcattattgtcattgaataattatgttgaccttttactgtatggagacaagcttcctgaaagagtgatctggcttctatcctgtctactccatgaaacacccttagactcctacagtgtctaaacaattgactagtctggtgaatcttttcagtttatctcttgacttctttgtagcatttgatacttttgacctgttttattttcttaaaaccctctctttccttgcctgtcatgtcagtattctagcatttcttctgcttctttcatcagttgcctttatgattcctcttcctaccctcttccttcttttctctaacctataactatgaaagctcacacagtccgacaccctgagctctcactagacttatttattaaacaaatacttatattgaacacttattctgtgccagataggttctggagatacagtgaacaaatctgactaaaacctcacccttatggagcttatctttagtggactgtggttctagtctagacttctgtcctgtgttccaggtttatattttcaattagttactaaacatttttcc

SEQ ID NO: 126072 - DNA, 1050 bp, Homo sapiens
ttcccctgctttgtacattactaccaaaggaattttcccaacacataaattttgtgtcatatttttgcatcaagcctttcgtgactctccattgcctacatttaggtctgttattcataaagtgaagcaatctagacttaccaggcaacctacaacaccccgaaaacaatacacactcgctcaagccttcgtgccttttgcttaatatgcccttccttatcttttctgcctggtaaatatctacctattactgaatactcaactcaagcaccaattcatgaattctgttgttctcggtgcctattcacactttatatgcattattcacatccatttgtgcttaagtgaccttacaccattttatttttccagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataatgtatgtccatttttagcatctccatatatgagaattagtgcatgcttatcatttctgctgtctagttcaagttttaatcctgttaatgtaaaactatcacacacctgattcttaggatctgtagaaaattttatagggatgacaataataatattattactaagttataataattactgttatttattggaaaccatctctgtactcgactctgggttgtatacatacagaatctctaatccacatccaccttatacctgagaaaactgaattgaagtcgtagtcaaaccaagatacttgtatctccaaagccagatactttgctacctagggaccaacaacagatacacgagatgttcaaatgtgaatcctgactgttctcttcatttaattattagttattgtgttgatgactcaattaaaaggttctgttaaattacgtctttcagtctgaaattactctgagaatttacttaaaatttttccatttaaaaa

SEQ ID NO: 126073 - DNA, 2485 bp, Homo sapiens
aggaccgtgctcctccttaaggttctacaggagaatccttccttgcatcttcctagcttctggtggctcttggcaacccttggcttgtaactacattgttccaattactacccctgtcttcaacaggctttcttcttgttcatgtctctgtatcttaacatggcattcttataaggacaccagtcattggatctaagtcctaccctaagtcagggtcatctcatcttaaataattgtgtatataaagatcctatttcccaattaagatcacattctaaggttctggatggacttgaatttatggggggatatatgatcttacgttaatcttgttaaatatcacattacatgtctctaatttctttactcattcttttacctcgtaattgtgctgtttatttatgttggtgcatatagttcattcattttcataatattacattttgtgaatcatcagaatttatctactcttatgttgattcaattaggatacttcttgcttgttgcgattaaatccttggactattcttcctgtaagccaagcttctctttagttgttatatttgaaatatggaccaatttgtaaatgctcatcttaaatgtcactcctagaaataagtacagttatgggccaagcaagcactgtgctaagcactatcagtttaggttttttcttttgatgaaaaatcttgcaatgaaatgcccaaatcttaagtcaacattcattgagttttgacaaatgaataacctttagtttagtccaatgtatcaatcttttaaatggttattgctttctggccctgtcttaaaatttttgcttagcccctgagtcatgaagatattctcctgttcttctctactgaaatttatgctgttagcatcatggtttgtgacccttcttgaattagtatttgattatggtgtgacataggagttgaatttcatttttcccccatgtaatatctagttattcctggaccttatgttgaaaagacttgcttttcctcattggcttgctttggtgtctgtactgataatcaaataaccataaaaatattctgttctgggctctctgctctgttccattgatctatttgttgatccttacctagtaccactctgttttatctttagtcttgaagtcagatttgaaatcagttttatgtcctccaactcagttctttttccaagattgctttggatatcctaggtcctttgcatttttatatgcattttagaatcagcttgtcagtttctacatgggtgtgactttttagtatattattttgggttcattaaatctcattttcttccatacatttataatgacatttgaggtttgattggaaggttttcatattgacttttaactagggctttcttgggacaaacagaatattctactatattcccaaactagattaccatcttatgattcaaactttccatatatttaacccagatatatattttcagaaaaagtaattggaaaagttatgtgatcagtcaagtactgttttcctaaaatgtggtattgaaaatctcctggaatttttaataattcatgttgttttatgtgaaaagaatgtcatctttttattatattatctgtacatttgctgttcatctaaaatgtagataatatcaccccaggctaaaaaggatgagaaagaatttaaactgattcttataactttttcttttttttagggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttgaggggggatctaggtaattggcagattctaaataatataatttccagatagtaattttaagagtactcatcgctcttgccaaataagttcagggtattcaaatcttggactagtcctgcaaggtataaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgg

SEQ ID NO: 126074 - DNA, 1107 bp, Homo sapiens
ttaaaaatcaaagtacatatttttcttggttttaaaaataacattttgttgtaaaaaattgttaatatgaagtgtacaaattgatagtgaaagcctctctgaaattccaaccctacctccaaggcattatgggtttgatttgtgtactgtgtacttccaacccaacgctggctcactggaaatcatcttgagttaaaataatttttagtttgcctattatctagccagtttttaaatatatgtacagatggttcttgatttatgtgattcaacttataattttttgactttatgatggatttatcaggatgtaaacctatcataagtcaaggagcatctgagtatcccatgtatattcatgctttattacacaatgatctgattatttgtcagcacatttttaaattctctaatgaaatgtgtggcttttgtttatagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctggtaagatgattatattttagattggaaatgtttgttctgataacatatttgtctctgtcaaaatattccgaattgtgtttacaaattatctctccctttcctcatagggacatttttgcaaacttttttaggagaagaatctttataagttggagaaaaatatttcctttgtaccaaatggaattgttccataaatccttatataatgcttcactacttcctaacctgtctggttttattaggtctaatttttatagaacatccttgttttcccttacaatggtatttaaagctctttgtggattctcttttaaagaaccattggagtcagcacaccattcagggaataacagattactagcatttcacaaaaaagcaaaggcagtcttttaaaattaaagctcttctcgatcgttagtcaacatttttgctctctgaatatccgtatgagaaaatggtctttaaatttgggcaggttgtgtgtaggcttgcaaatttca

SEQ ID NO: 126075 - DNA, 1003 bp, Homo sapiens
gactccaatggttctttaaaagagaatccacaaagagctttaaataccattgtaagggaaaacaaggatgttctataaaaattagacctaataaaaccagacaggttaggaagtagtgaagcattatataaggatttatggaacaattccatttggtacaaaggaaatatttttctccaacttataaagattcttctcctaaaaaagtttgcaaaaatgtccctatgaggaaagggagagataatttgtaaacacaattcggaatattttgacagagacaaatatgttatcagaacaaacatttccaatctaaaatataatcatcttaccagctccaaatggcacataggcaaacttttcccctgatgctgggttatcctgtaagtagcgatcaggattaaagtccaggcgttctacccatgagtctttaagtctttgattgacagtgggagaaacacacacctgatgtcctggaggaatggtataccctgccacagtctataaacaaaagccacacatttcattagagaatttaaaaatgtgctgacaaataatcagatcattgtgtaataaagcatgaatatacatgggatactcagatgctccttgacttatgataggtttacatcctgataaatccatcataaagtcaaaaaattataagttgaatcacataaatcaagaaccatctgtacatatatttaaaaactggctagataataggcaaactaaaaattattttaactcaagatgatttccagtgagccagcgttgggttggaagtacacagtacacaaatcaaacccataatgccttggaggtagggttggaatttcagagaggctttcactatcaatttgtacacttcatattaacaattttttacaacaaaatgttatttttaaaaccaagaaaaatatgtactttgatttttaaaaccccaattgttaaagaaaaatgcagaacatgattagcattaaagattagcatgtaggccgggcgc

SEQ ID NO: 126076 - DNA, 1050 bp, Homo sapiens
cagctgctatagttgtcatgctgttggtttccggggctaccatggatttggggagaggaggatgaaagaaatacaacttacactaccacaaagcttactcttcttaccaagattcagatttctttttcttgaattaactctccttagattgttgcaagcctttggttaatcttccagaattttgaaaaagttgacattaagattgttgctactgttttcattttttggaggagtgaatttttgtaggttcttacttcattcttcagggcaatcgcttctgttaccttgccctcctttttcaccatggacagtggtagagcatgataaccccagccaccctgaaccagttacctctgtacttttagctggaatgcaagctgtcttgtactaactaagaagttaaactaattttttgtactgttgaagtatgttatttataacaatcaggaaatgctttctcattttagctcaaggatctaaatttacttgatcgctgtataaaagaaacattaagacttagacctcctataatgatcatgatgagaatggccagaactcctcaggtgagtatcttggctacatcttcccctctatacccccagtttttatcaaaaagaagaaataggtgggtgtggtggttcacacctgtaatctcaacactttgggaggctgaggtgggaggatcacttgaggccagaatttgagaccagcctgggcaacatagtgagactgacctcatctctacaaaattttttctaaaaattagctggccataatggcacatgcctgtggtcccagctgcttgggaggctgatgtgggtagattgcttgagcctgggaggttgaaactgcagtaatccatgatcacgccactgcattgctgcctgggcaacagagcaagaccctgtctcaaaaaaaataaaaataaaaaagaaagaaaaagaaaagaggaagtagagtagcataaaagagatttttttaaattaaaaaagtagaataatcacttctacctaatcttcagttttatatactctaaaaacatatttttac

SEQ ID NO: 126077 - DNA, 1036 bp, Homo sapiens
cctaatcaaagtgtatgaagatttatttctgtgtattcttcttagtgttttgtagtttcatatcttacatttaggtctttgatccattatgaattaatttatgtatatgatgtgaggtcatcattcttttgcatgtgtttatccagttgtcccacactgtttgttgaaaagactattttttccacgttgaattgtctttgtaaaaaaatctattatagccaggcgcagtggcacgtgcctgtattctcagctactgagaagctgagatgggaaggtcgcttgagctcaggacttggggtccagcctgggcaacatagcgaaaccctgtctctgaaaaaataaatacattttaaaaagcctcttgaccataaatttaaggctttatttctggactcagttctattccattgatatgtttagtctgatgccattacgtagttttgtaataagttttgaattcgggagtgtgagtcctctgactttgtccttttcaaggctgtttatctactcctagtccctttagtttccatatgaattttggggtcagtgtgtcagtttctgcaaagaagctagctgagatttttgacaatgattgcattgtatcgccatattaatttgggagcacaattttagtctttaaatctgtgaacatgagatgtctttctcttattttagttctttaatttctttcaacaatgttttatagtttttggtgcacaatgtttaaacttctcttgttaaatgtattcttaagtattttattattgttatttttttgatgttattctttcttctgccagtccaaatctgctgttgatcccctcgggtgaatttttcatttcagttctcatacttctcagttcttgaatttctatttggttctctaaaaaaataatatattgatattctccattttactagagatatctaggcatattttgctatagttctttgaacctgtttataatagctgatttaaattcattatctagtaagtccaatgtctgggcttcttcatggatagtttctattaaac

SEQ ID NO: 126078 - DNA, 1604 bp, Homo sapiens
ttaaaattggaattttatgttaatttaaaagagtatcctactttctgttgaactggaaaatacttctaaaggaatttcttgcttgttttaggcctttagtttgaacacaggcaatgtgttaagaatctgggatatatatgttaaataaagcacagttcttgcccttagggactatggacatttttaacaatgtaagattttcatgacttccagtatgttcctggttctgatttttttgtcaattattttagagtcattaaagttggttaaataagatgctttatgctcggtcctggttctcaaaatgaatttgatcctagaaggttatttctttatttaagaaaatcatctttatcttttaattacagacgcagggacagagctcatcgggaaatcaaggatattttctataaggcaatccagaaacgcagacagtctcaagaaaaaattgatgacattctccaaactttactagatgctacatacaagtaagagctattcagataacatattaagctgaagcaggaaattacacattaaaacacagttaaatagtatttccagttaaaaaacagtgatgctggcaaaataagttggtagctgtgatctttggactctttaaattgttgagacataaactattggcatcctgtgtcttactgtaatcccagtgactgggtatggtaaaagtttgctaatgaactgtaatggagtcttttgtaatcaaaatcgttttgtgctggtctgtctcttccctaagagaaaaaaaactcttgacttgtgatagtcaaatataagagaccactatacctgaaaaatgtattcattatgacactttatttaaaggttgaggcatgaaatgtatctgccaaaatgttaaatttgtgtctttggttcattccttagggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccaggtttgttggatttttcagtttcattgctgccttatgactttgaggatctgtggctaatttttaaaagggacaatttgagattttctatatactatagcttaaattgatcagcttctctatttttagcaaattccctataaccttacctaaaatatcttaatgttattgcttcttgccattaagctttatcagatatgttttgggttgatggcttagagatccttggggatgtttctttggtacttacttcctctgcttcaaagtctggcttctgtacatagaggatattatgtgcatgttgtgtgtcttatgaagtgtagaagcctctgaattacttagaattctgtatgtccagagtggcctgggcatgagcagagacttctaaaagtagtagtagtagtagtaatgaggacaagacatttacaaatactacatgcaacttgctgggtggaaaggaagagaggacaactcactgcacaacctgacattccatcttggaagc

SEQ ID NO: 126079 - DNA, 1089 bp, Homo sapiens
ccagtgttgggatatactaattggtgattatagttttcttttacatatcgccagtaattccattttggccctgatcttcctacttttaacctgggaaataatctgatctttggctactattccttgggaagtaccttattattgtcatatgcactataaataaccttttttctgcttttgttattgtgacctggaaatcaaataaccacatttattcttttcatgatgaagtgctcatgagtggggttttgagatgtgtttctgggatctgttttggctgtttagagggacagggtgcttcacattgtttggtttattgcccctctttgttgttgtacatagtcacatgtctgtctacagactttttttgatgatatgaataggatcttgtttcttcttgagttctgtttttaattctcaattttctttcactttttggaaatagtaatgagaataatcttttttttctccctagatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcaggtatggataaagaatatattacactaggttatttaactttgtataattattgtagtgttggtatgctttgccttaacaaagataaaaattaaacaagtaaaacatacaaaatgggtaagattatgaatcccctttcttctataagaattcaagacaaattttctttatataatgagctcatttaaagtaagtttcagtttattaaaaaggtgatttgttgtctgtctagtctaatattttatttatgtttttgtttttgagatggagtcttgctctgttgccccagctgtagtgcagtggtgtgatctcggctcactgcagtctctgcctcctgtgttcaagcaattctcctgcctcatcctcctgagagctgggactacaggcacgtgccaccatgcccaactaatttttctatttttagtagagacagggtttcatc

SEQ ID NO: 126080 - DNA, 1250 bp, Homo sapiens
cataaccagaaaactgcaagggaaagtatttaacatctaaccaaattaatataaaataaaaaatgaagtcatttagtgtaggtgagatagtgctaaaatagataaataaacttgtagtgtcttcacatagcaggtactatagaaaaggtcaaattctttggctagtcttgtaaaatttgtttttaaccaaagggggaagaagtctatattttcagaggtgttcatcacagaattagctgtaataactaaagaaaaccctgacatatcacccatatgtccaataatgaaagagtagtcagtaaattaacattgtgatgtttatatagacaatagaaaacattgtcaatataaactgaaaaaagcataataaacagttatatttatactacatttgcaactaaatgaacataattataaatttggacaaaggaaggaggagtatggcaagatgaaaagaattgctttaaggtttatatatgtttttatttttttaataatgcattattttgtgattttaaaaagttactgtcgtagtgttgcatattttttgtaacatcactatatgtacttttctctttttagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagtaggtgacactgttaccataaataaagacaaatctatacctcagtagttatagctaatagtgagacattatacatttaaaatgtagaaacagccaggcatggtggctcattcctgtaatcccagcactttgggaggccaaggtgggtggatcactcaaagtcaggagttcaagaccagcctggccaacatggtgaaaccctgtctctactaaaaatacaaaaattagctgggtggggctggtggtgcacacctgtaaattccagctacttgggaggctgaggcatgagaatcgcttgaacccaggaggcggaggttgcagtgagccgagatcacaacactgcactttagccttggcaacagagtgagaccctgtctcaaaaacagaaacaaaaaaccaaacacacacacacacacgcacgcgcacacacacacacacacacacacacacagaaaccaaccaaacaaaaatgtaataaaatgtagaaccag

SEQ ID NO: 126081 - DNA, 1197 bp, Homo sapiens
cggacagggggcggtgctcacgcccaaggccccgctgacgcgatgtaggccgagatcacctcaggcgctcgcggtgcaatcacagagcgcgccgtcgccgctcgagctcgccctgagatccctccgctcagcgccttcaacgccgtgtcccggcaccccgcacccgggcacacaaaaaacgggtcgcccgcgattctcagggattgatcgcctcttcaggtaagttatcttccggccccgtaccactgtgccacaggcgcagcccgcttcctcaggtgccctatcccgcgcaagaagaccacggcttcacagagtgttatttaaggggcgtggccagcggaacatcccgccccattctgtgacgcacggggtggcgcgcgtgggacccgaggggtggggctgggtttagtaggagacctggggcaaggccccctgtggacgaccatctgccagcttctctcgttccgtcgattgggaggagcggtggcgacctcggccttcagtgtttccgacggagtgaatggcggcggcggctgggatgctgctgctgggcttgctgcaggcgggtgggtcggtgctgggccaggcgatggagaaggtgacaggcggcaacctcttgtccatgctgctgatcgcctgcgccttcaccctcagcctggtctacctgatccgtctggccgccggccacctggtccagctgcccgcaggggtggtacgtacattctttagggtctgagtggggcgcgcgccgcagctgaggcggccgaagggctggcgtgggcggctccgtggccccgaccggctcagtggatggcaagggcgggggcgactgcggccatgcttggcgtggctttggtggcaggcgcgctgggggctggagtagtggctgcggcggcggcactgctgctggtggcgctggctgtagcacccgccattgccttgtgttggggggcggtgctggcctccccggctgtgtatctgatcctagacggggtcgtggttgcggcatttgtggttgtagcggtctgtactgaccgcagcagtggtgcccctagtggcggtggctggattggcggctgtgggtttgaacgacccggtggtcgttggggcccttggtgggggtcctgacggagatgctgttggcagctggcccgtcatcctggaggctgccctgtgtggttcagtgttctgtgggct

SEQ ID NO: 126082 - DNA, 1165 bp, Homo sapiens
tgcaaactcctaggctcaggcagtcctcctgcctcagcctcccaagtagttgggactacaggcatatgccaccacacccagctaatttttttattatttgtagagataggatctcactttgttgcccaggctggtctcaaactcctggtctgggcaacaaagtgagaccttatctctacaaggtgattctcccaccttagcctcacaaagtgctgggattgcaggtgtgagccaccacaccatcctcattttctgttaaaactattttgcccacacaaaataggctgctgtttattagcttgtaaccacttttctatttctcttgtactaagttcattaaaggaaatgaaggagaaatgccccccaccatttcaagaaatttttcctctgctgtttcagagcattttataccaacatctgcaaatcattcttcatagaactggatggtgatgctgtgccatttctctaaactatattttatgtttgttagctttccaatttttggcaataatacaaagttttatatagtattcaaatgaaggtttagtgatattatttaacacttaaatataacatttcatattatgtataatactttgatccaggattcaaataaatgagttagcagtaacagacagaaggatgacaataatattcttaattaacagtctgctttttccttagataagaggttcagtttcttgaactataaatagaaatgctatccttgggtatctaaacaggtgattgaaccaaagagtaaaggtattttctatccatctagtcattaccttgttctctgtaaaccactgataaatttatggcacctttgaaagctttaagatagttgcatatttcagccgtcaaatgtgggaacaaccagcttgtcctcagttgtcttagattcaccaaggtctactaggattgcattcaacaagcttagcaaaaacatagcaaacaccttcatctgcaaaaataccttcatttgcatttaaaacactacatgggatacattagtgtcagagataggaaaagccatgggacacagttgtgttttttgtgtcagttgtttctaccttctataactacaggctcagtacttttgttggaaatttgacttctataattgagaagtaactatactacagttgtatttttttctgta

SEQ ID NO: 126083 - DNA, 2064 bp, Homo sapiens
aaaatattatactaaagcattcttaaagttatactctccaattttacttttcttatatttgactatagtttgatatactttatatttttctttatctttctttatgcttaaataagttcactaaaacctgactcgaataagtagtaaaacattttataaggcagatgtacttaagaatcccaccataaaaactagttttatgttcagtctttgagagaaaacactgaggttttaagcatatctgaatttggttattgtggttttcaattttcaaaaatattttctggttattgaaagaagaaacatttatctaaattgataatatgagatttgtggctttttgcttaacatttttagagttctctgatattttacagcaaaatatttttcaggttaaaaattacgttactgaaagccatttgtaacagaatgattactatactttagctactaaagatgatttatttaaaggatgttggcatgtgtgcttacagtgaagaaaatctaaaatccatcgtacctgttaccaaactgaaaagtaaggcacctcactggacaaatcgcatacttcatgaatacaaggtaagctgtttaatagaaatgaaaagacattttataggctagttgaaactttgttagtgttataaatattttaaacagaggtagattaaatttatagtcctgaaattaaaaatgtatcttctagttcacaatgcttgaaattgaaagtagcaagatatttttatttttagtaatatataatcttttactgaataccttcaacatgccaaatactgtggtaaggactaaagataaaaatttgaaataatatactatccatgcccgtgaagcaattaaaacccaataacatagacagtatttttagacctcaatttttttttttaatattaacatcacaagagaaaaagtactcctgatacaatgtgccataattttattctttaggggcaatcttgattttagaaactgcttagttgatctatttggattatcaatggtacattttcctttcatatctcttttatttttaatttaccttgtttgtttttagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggtagattttcagctcttttttaccaatcatgtcatataatagttaaaacaacagtaccaacctacatgaagaatttagaaatggcatatatacaagactgttcattgcaactcattcattacataagaggaagggggacactaaatcactgtcagtaaggcgttaatattatattacatttctgcattagaatacccttcagccataaaaaagaataaagagtatttttgtgtagaatgatctgcaagatacatttaatgaaaaagcaaggtgctgaacaatatgtaatatgctgcctactcttgctattaaaatgggaggaaatgaggatgatttttacataaatacatattgcttgtatatgcataaaatatttcttgaagcctttagagaagggaaccaggtaactaggaataaaagtaaggagggaaacttttcattacatacctatctagttcaggccactataacaaagccctatagactgattggctaatgaacaacagaagttttatttctcacagttctagaaactggaagtctgagatcagcgtgctagcggggttggattctagtgagagcgtttttctgggttggagactgctgacatctccttgtagcctcatatggcagaaagaatgagggagttatcttggggtcccttttataaaggcatgaatcccattcatgtgggccctgctctcataaattatggcataattacttctcaaaggctctacctcccaataccatcactttaggagttaggatttcaacataccaat

SEQ ID NO: 126084 - DNA, 1022 bp, Homo sapiens
ttttccattttattttgagaaatttgaaaagccataggcatattaaaaagtaatacagtttacaccatttaccattcattagatcacaagttgttaacaatttggtttagtgtatttactttctttgtgaaccattttaaactgagttgcaggtgtcattcctacatattttgacgtgcatcttctaagaataaggacatctctacctaccacaataacatttccaacctaataaaattaataattccataattacataatatctgattcaaattcagatgtttcccagttgtttcaaaatacttttatacctcccagccccgggatctagtcaaggctcatgctttatatttggatgtctcttcagtctcttttaatttagaacagtccccttcattttttccccatgaaattttttttttaatatttaataatagagtattttaattaattttaaatagagtattattaatatttaataatatagagtattttaagatagaaaaatagtattatttcagttaatgttgcaaaaatcttttttttttttttttgagatggagtctctttctgtcacccaggctggagtgcactggtgcaatttcggctcactgcaagctccgcctcccgggttcacaccattctcctgcctcagcctcccgagtagctgggactacaggcgcctgccaccatgcctagctaattttttgtatttttagtagagacggggtttcaccgtgttagccagcatggtctcgatctcctggcctcgtgatccgcccacctcggcctcccaaagtgctaggattacaggcgtgagccaccgtgcctggccgcaaaaatcatttttattcaagcttgggatcgttgtgaattgtatttggaaatactttaagtatttattcagaaactttataaccggtgactttgtacaagtaggaatatattctgtaggctaggatttctcaaatctttattaatcttattggataaactttatagttttaaaaaaaaaaaaaaag

SEQ ID NO: 126085 - DNA, 1575 bp, Homo sapiens
aaagaaaatttaaggcgtcagaaatgttcttctctatccctaatgatcactttttgtccccatctctctcctgtatcatagggtatacacataaaaattcttcttattccccttaaattcacttttctttttccacacctactttcttctttccctcaaacatgcatgattctcttccttcttgaaagttgctttcacctgaacctacttcttttagctaccatcctgtttctttccttcctttcacagccagatttcaaaggtgagtgggagacacactctgctttctctttttcactcttcataaaccttaactttttctgagtttttgatctgtttccctgctctgcagcatttaattcttgactacttttcattttaagaacaaataggagttgaaagagcataatggagctataatgaaggtcagtaaaaatgcaaggtattattgatatcttatcattgctgtggaaacactcactggcctccattctgtgatccagacctgtgtcttagtagtagtactactaagattcagaaaactggcttctaactctggctagtcaccatgagacgttgggcaagttagttaactgcatcaagctccatttttctcatctgtgcaataaaaaagtacctctgcctactttataaatttctatgattatattaaataattatataagaaggtagctgggaaattttaaagcaccatacaaaatgtatgtttgtattatttttattattacttctcgaattgctacctcactatcttttcccttttagatgtatttcagtgttctaaggtgatcacatttctctaaattcattctcagatttcatccattctttcagaccatttaattcttttcagtgagatgattttacatattctcaaatagatactctaagcctttgccttcccctaagtagtttcaagttgcctactaaacatttcagtcacttatcttttgtatgtagggcactttggagaatataaagacactgtccctatcctcaaggagcttccaggctgatagagaagaggtgtggataaacaaggatggaattaggtagaatgaaataagtcacaaaaaagaagcaaaaatagaatgctaaaacatagtgggaatatagagaagatagattttaaaccgtttcagaggcataatggaatttaacctgaacgaaatcaggaagggggaaaggatgtcttaagaatagcaaagaatattgtggctttgatttgcatttctctaatgatcagtgatattgagctttttttcatatgtctcttggctgcttgtatgtcttctttagaaaagtatctattaatgtattttacccactttttaatggggtggttttttcttgtaaatttgttaagtttcttataggtgctggatattagacttctgtcagatgcatagtttgcaaatattgtctcccattctgtaggttgtctgtgtactctgttgatagtttcttttgctgtgcagagcagctgtttagtttaagtaccatctcacaccagtcagaatggctatgattaaaaagtcataaaaataacagata

SEQ ID NO: 126086 - DNA, 1053 bp, Homo sapiens
gaaaatactggcggcaaaaacaatactaaaagaaatcacatgcagccgggtgcagtggctcacacctgtaatcccagcactttgggaggccaaggtgggcggatcacgaggtcaggaggttgagaccatcctggctaacaccatgaaatcccgtctctattaaatatacaaaaaattagccgggtgtggtggcgggtgcctgtagtcccagctacttgggaggctgaggcaggagaatggtgtgaacccgcgaggcggagcttgcagtgagctgagatcacgccactgcactccagcctgggcaacacagtgagactccatctcaaaaaaaaggaaaaaaagaaatcacatgctttaccaggagctaaataaaaagaggtagagaatatagttcagattccaaaaaagtatactatagatttggaaaaggcaaaggcagtgaattttagttgaggaatcccaagtttatatttgactgtatagttgctcctttttgtggcaggggtgtttttttttttttccccctctaatgaaagaatggtaatattttcaactattacataaaaacaaaagcatggcattgtatttaatatgctttggaatgtacctatgtttcagtaccatttttagttcctaaaatattacctttggtaagttactttatgtctctaagggtctgtttctttatctatacgagatgggcttaaaaatggtaccttccctaatagtaaaagaaaaattacaagtaacgtgctttgagagcacataatgagcactcaataaatcttggcttttaagaataagtgttggccgggtgtagtggcccacacctgtaatcccagcactttggaaggccaagaagggcagatgactggaagtcaggagtttgagaccagcctgccctggtgaaactctgtctctactgaaaatacaaaaattagctgggcgtggtggcaggcacctgtaatcccagctgctcgggaggctgaggcaggagaatcgcttgagcccaggaggtggaggttgcagtgtactgagatcccaccaccgcac

SEQ ID NO: 126087 - DNA, 2349 bp, Homo sapiens
gaacaatttattttatacttaacaagttttcattttctaacatgtatttttagatgaaaacatgcagatgtaaaccttttatatggtagcataattcttcatttttctttttcagataatactaaatacacatataccccaggatgcccaattttttactgcttacaagatattatgcgagtctgtagtgaatccagtactcattttgctacacttacagcaaggatgttaatagccttggataagtaagaaatgccgttagaagtatcttttaattaatcaaatacatgtttatagtagaaattagttgtcatagatacagacactttgagaagaaaataatgaaaataatatatgtattaaaaaatggtaagtttttcaattctaatataaaaatgaaaaacccgaagataaggttgtcctggcctgggtacagcatgttaattttatttttcagaaatggtaaacactgccctggcttaagaattaagatttacctgttatgaaactatacatttaatattgagttactcttatcagtgaagaagtcattcaacctcttatgcctttgtctttctgtaagaacagggctaatgtcacctacatctcagtagtttgaattttaacagtacttttatgttttttgaaaggagtttttattactataatggcacatacatttaaaaaatttatttgctgtatccattaacaaaacttttattaataaatgaagtatttgtatactgacttgatctttatagatcatatgaacatattatcacatgtgcccctaaagtatgtacagtattatgcatgtttttttgttaaaaaaatcaatttgcaatataaataaattttaaaaataataaagtacttaactaacactaaattaaaattataaaaatctgaaggtaatattcacaagtgtcatatatcagagttagatagtaatctatctttttcatcttcactttcgaatggctacttctacctgtttttttattttgccaggtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtaagagttgaatgaattttagctctgatttaaaagacgttttatctcaagtgtaattttttttcctgagatatatacatctattactaattataaacatgaaggcctggtacagtggctcacgcctgtaatcccagcactttgggaggccaaggagggcagattgcctgaggtcaggagttcgagaccagcctggccaacatggtgaaatctcgtctctactaaaaatacaaaaattagctggatgtggtggcgtacccctgtagtcttagctaccccggagactgaggcaggagaatcgcttgaacctgggaggcggaggttgcagtgtgctgagatcgcagcactgaactccagcctgggcaacagagcaagactcattctcaataaataaataagtaaaaatttaaaatataaacatgtaaacattaagatgacaaagctcttaatgggtttttgttattgttttccctttctaggtagataaagtggtaataaatccatactttggtctaggagctccagactactcaaaaatccaaatacctaaacaggaaaaatggcagagaagcatgagcagtgtcacagaagacaagtactgtttcggttttactccacattgcttttataaaaacttacattctaatttaaagtattgtttaaaattatatatgcaatttgtatgcattgtagtcactattgagtttacagcttcttagtgatacagagctttcatagatgtgtcacatttcttttgaaacaatttttacagtcctgttgtatttttcaaaatttctttttaatgattagggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtaaatggaatatttattcttttctttttagaaagaatacattttttattataaatgttagtccttcttttcaagactgttctcattccaaatactttttctctacctgtttgccttaggagttttctgttttgatctta

SEQ ID NO: 126088 - DNA, 1461 bp, Homo sapiens
gttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccaggcaaggagtttatttttcacatgtagttacagagaaaccatagccactttttgggtggaaactctttgagcaaagaggcttacgtttttccccagtagtggacgttgacgggtggtggcgcaggaaaaaacctcccaggcagagtgattacgtatttttgtcattgcagggaaagggattcacagcttgtcattctaactcacttctccccctgtaactcacttctcgcctctacacttttctccaccttttaaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccaggtaggtgccacccccctaattaaggaccacttccactgctttatttataagatcttattacttagggagcatattatcatttgtgcctaacattttccagaatggagtgagccatataacaaaatgccacgtttcctgtacttattcacttgaaccctcatctcagactcagtctaaacatattgcaaactctagttatacctttcttgtattttagttcaagctactcattttctatcagtttgtctgtgtttctcccttagcagttttaccttcctatgttagttacttttgttattttcctgttaagcctttgtttccttctttcatgtcactggaagaatgtagattttaagtagtcaagtacgaatagttcttgaaaatgaattttaagaatattttggggatatggtaaaaaagtatttggtttaagaaaacaaaatactgttactgtcatagttatgtctttttaaaatcacatttgtttaccttttaaaagttcaggcttctgtgcagtattaattaaatattctagagaagtgatgagtattgacaaagtactttgctagtaaatgttttcttaacatgagttgaccaagacaggaattgatttgctttaaattgtctttagaaaagtaagagttacttgatttttcttttaggtccttaatagataaaatggtttctgtaattgtgcccatatatcatacagtgtattcacaatacaatgtctttctttttggggcttgcagtcttcaatgcgtctgtctcataatttgtaaacgtt

SEQ ID NO: 126089 - DNA, 1830 bp, Homo sapiens
tggggggcgcccacccagtctgagcctcgccgcgggcgccttcggctcacgcagcgcttcccgcgggccgccagtgcgcaccctcggccacatcagcctccgcctggcgggtgcacccgggccggcgaggaaggggcaaccgtccgggtgggtggggcgggctgggtacctgaggtcaccagctcggctgtagaggcaggggcggcggaggcggaactgcggagttgctgggtccaccgacccttaccctcagcgagagaagtaaccgtaagtctcagcttcgcggtacagatgtgtttgaggctgcctctacccatttgtggctccgagttcagagctacctacttcacaccctcccggatctactaggagtgtgtctgtcgcctgttttggagcattgttgttctgtctgtccccatccctgaacaggcagcattctctgccctacagggcttttctcccagcgaatttgcaagcctccgggtctccgtgacgcgtcccatcctccccatctggatgcatctccttgtccctctgtcctcaaaggatctgtgtccttcctcgcagcctcccccccacccccatcctttgagacgtggaaagccacgggttctgccgacctcgggggctagagagagtcttgagaagcggatgggtaaaagtgctctgcagggctgtgatgggtggggataggtgcagatggctccagtgaacctttatttttgcagcttctgccaccaaaacaaaagaatggagcgctcccctgtattcttattcttctccgtatgtatgagctgtttttctgtacgtagctgtttgagtcgcaggaaattgaaactagagctgtaataaagcatctcctgaggagattttgagaattagtctcccaagctctattcacacggaatggcatatcgaacaatcttgtattggaatgaccatttcagaagagctttactggtagatctgacagataaatgtaaagataagagtctgctgtttcaaatagtgtattttagatacctttaaattttagtgttctaattttcatctagttcttaatttgtgaagtatgtgggtatgtgtaaggtgtaaaaatctgtgtattggaaggttttgctttgttacaagcttttgctttgttgcttttgagacagacgtttaaagatcatattagattgtatttgataattattttcaatcattaattccagagaaatctttttttgtatcagccactcacagatgttacacaccttggtgcctatgaccctcctgctgcttaaactgtgaatgtcttcaaagtatattttcagatttttgaactaggcgttttttctcattagaatttgatttgcttttcaaactgctcctgcagaactttccagaaattagatttaaaaataattttaatgctgtcagtgattggacaatagctcttatatgactttatgcatttgctacttttcagagcaccataggaagcaaacgataatttaagaataattttactgtgtactgcaggttgtcattctgcaaactactgtgtagtgtagactggtagctttggtgttttgtgttgctgaaaaacattgtcatttcattaagaaagatggatgtgtttaatgacttttccccccaacctcctttcagcagttgattttgggctattatctgatttgtaacttctcactgttcacagattttaatttgaagtaggctcaggagatgtagctccaactctgtctctggaaatgtacttagcacagaagccaagcactgtgcagagttgagtgtattattaagggtgtggcttttgctttctgtaaa

SEQ ID NO: 126090 - DNA, 1029 bp, Homo sapiens
ttagcattatgttcaataagtaatacttattcaaggtgttctgtgtgccagtaactatggtaaacaaggggtataaaactgaatatggtgtgattctcatccttaaagagtttaccagataactcaagaagcagataaacatttaattatagttttagatggtaagttgagtgtagtatcaagttatggaggaaggactttgaagttagttgagggctggggagctattatcatgaaacttgatagagaaaacaacttttaagctgatacttgaatgagtagtaggagttaccgttttcaggaggaattggtagggaagaggagacaacattctaggagctttagtagtttagtgggcagggctgagttataagtgataggctgtgaagagatgaatcctggtcttagcagggacttttccttagagctgagaaccttaagaaggttttaaaatggaattggacaagatcagatttgccttttaataaagttaatttggttatagtagagaaaattcagttgggggtgggatctggaagcaagggccacctattaaggagtttatctaatacattaaaatctattccagtattagtcaaatatctcttgagcacctgtgtaaatacaatgtgggggaatgcagaggtatgtaaaacatataattcctattttcaaggagtttgtattttaaaataactgagaactaggtaacaacaatatgaggcagtatactaatgttacggcttctatcttataaaatgagggcaaataaggctagaattaagacttgaagccaaaagatcttcatggctacaaagcccatattctttctaggcatgctacactgcttcccatggcacttattaccacttgatttattatctgtatgttacctcagaacccttgtgacataagattagagtacaattaaaatgattttcaacttggaataccaagtatcatatgatctccactctggctttctccaggtagtctctgttggatggaatataaccagaaaaataaatg

SEQ ID NO: 126091 - DNA, 1071 bp, Homo sapiens
aaaataaagattattctatctttcaaccattctaactcttaaatctgttaaaccaactattgaaactcaggccttgtaaagatggctaatttattctttgatctttctctatttctgtaagaggtgtgtttgccatgtggtgacattttcttacctgtatgttgatgcatttgagtaatcttctgagagtctttcttgctctgaaatgtgacttgacatgatatctacagaattacttaaaaaaattaggatatgatattccgatttgaaaaacattacttttcttataaaataggaagaagtaaaaagggagaataaaggttgggctgataatttggtattataggatgaggagaaacagggaaactcagaggggatacttatcttttaactacccaaaaactctgaatgtggattaaatgtcagatgcataaggcaagagaaaatgaaaaataataaggttccaattcagggattttatagtctagtagtcttttctactgataatccttgagagaattgagtgttaatgtcctaagccagaggttctcaaagttaatgtgtatcacactcacctggaatgcttgttaaagtgcagattgctgggcctcacccccccaaatttctaattcagtaagtctgagtgggatctgagagtgttcatttctaacaagttcccaagtgctgctgctaattgctgttgtcttttgtatgaaattaatttgtttctctcctgtgtcttagaatggtactggttatatacgatcattgggagaattttagaaatagttcctcaaatcatttttctgtgtagtgagaaactctgatggagaaacttaatttttttaaaaaaattgatgaaattaattataattccaaacttcagctcataagagaaggtaaaaacaaaattgaatagacatagaaaaattaatctggcagccatttgcaggatgggttggaatgggaaaagacagagtgtaggttctctcatccatctgctatctagattatgatttaaataaaagagatcataaaagagatctctccatttggaattttttgccctta

SEQ ID NO: 126092 - DNA, 1034 bp, Homo sapiens
ttactctctatgctacagtaacactggcctcctttttgttcctcgaacacacagggtatgctcctatgcatgcactggctatttcctctatctggaatactctttcccctagataccacatgactcactacatcaccttctttagctcgttgatgaaacgtcactttgggcttggccggtggctcacctgtaatcccaacactttgggaggctgaagcaggagaattcacttgagtccaggaattcaagactagcctgggcaacatgatgagacctcccctctacaaaaggtaaactaaattagctgggcgtggtggtacatggcggtagtcccagctgctcaggaggaggctaaagtaggagaatcacttgagcctgggaggctgagggtgcaatgagtcatgattgtgccactttactccagcatgagtcacaaagcgagaccctgtctcaaaaaaaaaaaaaaagtcattttggtaaggcttttgctggctacccttttagacattgcagcaccacaaaactctccttgctggctttatttgagaaagaaacaaaaagcagtgattttagtttattttgttcctgctgcattccccttcgcctacaataatgcctagcacatgataggtggttgataaatagttgttgcaggagtttattattttagctgtgaagaagagtattcctttcctctgagaagtacacttgaaaaaatcctgtaactctagcgtagactaccagttattgacttccaacatttactctgctttcctttttctaaaattgataaagtccaaacctctcttgtttggatttgaaattactatgttttttggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccaggcgtggtagcgggcgcctgtagtcccagctactcgggaggctgaggcaggagaatgg

SEQ ID NO: 126093 - DNA, 1059 bp, Homo sapiens
gcataaatcctttcattctctctaaggtatatgagttattaattgctattgactgcaatgattcctaacactcgtagtgatattttggtatgcattttgcttttagatgactttatgtcatgatttataactttaaagccatagctttttttcatattctccaagaaatgttaatacctctttcttcctttaagcctagattgagagtattgttcctgttttgattttgagggttttgttcattttagtatttttgtgtagctagtgcttaataactgcgtgaattggaggagttaggttccacagaagcaccttgctctcttactcaaacttgaattttatgtgcttgctatggaagtcatatgcttcagatatttcatttcaggtattttgcgctagtgtcagatcatgttttgaatcatgtcctaacttttctatttgaaagagtcattgtagcacttaacgttgatcctgctgccatttcttcaggatgtagggaagcgcagtgactctaatctcacttcttcgtatcttaaaagagataggtgttacaggctgttatactgtgcccttcattacttcattaagatatacggaaaataagtgaattcgaagacattaagtcaaatacataggattcaggttcttatttctgatgttggagaggtgctagtctcagactagatctatggccttggcaacagacagtagacatgggagctcttaactccctcctaaatgtaactgttatattttgttgctatggcaatagaatgtgcttaatgctaagattccatatctatagctgaagatgtatgcagtataaattaattctttttctcatatccaagccaggacttgaatgtcaacatgcatagtaataggggctttgctgagaaaacagatactgctacatgacttaagataccctgtaggaaaaaaagcctgggttcaaagataaacacaactttacccaaaatagtgataaattagaaccaacttaaatgtaaagcaaaaactgaattatctgtatagcagaatttgattattattaaaatg

SEQ ID NO: 126094 - DNA, 1055 bp, Homo sapiens
aaagaaggctatatacatacaggaaagagaagaagaaaatataccagtatgttgacactgattaattcaggatttggagattataatgatctttttattttcttctttatacttttccatataattcccagtttagataactatctataattttattatttttaaaagaaagaaaaaagattttagaaacagatacagctgtgtgattctaggcaagttaattagtgatcacagtgatgatggctacattttactgagtacctactatttaacaaacattgtgtgtattttacacattttgtcacccttacttcataatggccaaggaagggaggcctaattgtctacctttacatattggaaaaaagacttaaaaactttaagtagcttgtaagctagtaagttgtagagccaggattcaaaccaagatttgtgttcataattttctcaatatactataaggtctttccaaaatgattaaacttccaaaatctgtgatttcttattgtaaaatgtaggcaggattgtatgggaatgaaatgacaggaggtacataaaccacaggattaggtttttacacatgtattcttcaagctttattattaaatatgttcatttaacaacattatctaagatttaattctgtaatattaaacctgtaagttgcatttcttcaaagaagagcaatgttaatccattggttaacattttgtcctgtttttgtgtttacacagtacagttttacagtcagtttttgaaaggttggatttcataaagataaatgatactgtgttaaaagaggtaaagcttatatttcccactttccttaaaacatgtcttaacaaacctgatattttgctgggatttgaagggacctctgttccttacttgagttctgaaccatgtgagtagccaaaacagtaagcatatccagttttttcttcccagatttggtaatatctctggggtagctaaggtcaggaatattattgcaaatggaaaagaagtattactgtcaatacctctctcaagtttcatacttttgtttagaagtt

SEQ ID NO: 126095 - DNA, 1049 bp, Homo sapiens
ttcgaagcaaaatcagcaaagggaaagggttcatggagtgaagcccagaggaagccaagcacaagcttccaagagtcttcttcccatggaatcatacaatacttatgtaatttacataatttatccagtgttgaattatgacaatgtgtatgaaatgtaatctgccaaagaagttccttagagactcggtgtccaaggttttgattgacagctggtcacataggtaccttctaactagcatgtaccaatattccagactttctgaagaaaagcaggtgattagcatatactgcattatttatacaaacaatttgggcactttgaaggactcctatcagttagggtggtgggaaccctcctgaaatccaagttcccagacaccagccatggatcaaccttgcaagaggcttttctaaggatagccatctgaagcctgctatgttaactcttttccatataataaagtagaatgtcctcagacaaatggggctgaaattgtaatattgaataaacttagtttaacttaataaattcatttaggttcagcaggacaatggagaaaaaaggagagttcctaggagtgaaatagttttgtactctgacacaatataatacctctagattttcccttgtagtaataataatgggtaataaacagtacctaatggtggaggacacagcaaaattaggaagactcaatgactttgaaacagtgggtggtggagcgagttcttttccagtgaatataatctaaacagttttgtacagcagcaatttgtagttgttctttgtagttagtttgagaaagggaattgttgtcttttaatattattttgtaaacttgtactaattttatatgtacataattattaaagatatattagagagaaatcagttccccaaagtgtaaacatagaattcactttttaaaaaaatttcaagcatttaacactgcttaaaagcagtaaaaattatttcaaaagatatttgactatagatttctaaacttcgatacatagtgtgtaatttttattttttctttaatagaa

SEQ ID NO: 126096 - DNA, 1009 bp, Homo sapiens
tggtcttgccaagcaatccacctacctctgcctcccaaagtgctgagataacaggcatgagccaccacgcctggccagcataagtactttttgtgtctgtcttagatgcatcagctttgagaccttggcttcctaattccaagataaacccttccagtttaacatgttcacttatatttttgcattaaggacaatacattattcaaaaattatgaaagccaacactgaatagagatgccgaagttactaaaattacactatttgccaacagcaccacagtgtaagagcttgaaatgtttacttttcagtcactgtataaaatcctgaattcaaagtttgaaaaatagttgtgaaggggaagttaaagtataacacaacattttgagtagttgaaaagtcaaatgtttaaaagctgaatactgcctatgaaaattttcagctatctgaaaatttacttatttagagagctgtgatcattataggtaattgtgttttcatgggaaataaaaaagtaagagtcatgtttcatacagtagttgtattccaagtttcgacagttttctgcttgtagacctcatgctagctattttcagtgttcatttgccagtttgtcaaaaagaggcaggcttttgaatatagcttttgcagctattttcatttcttctctaactacagtatcattttttacactgtgaaagctatgtagatctaaaagatatctaagaggagccagaatatattgtattatctccttgcttactgagaaacctcagacagccaaactgccatagatatttttattactgtcatgataatacttttgtgtttatgtagccattttatttggaatgctgccatgttaagatactggaataacagaaaagtgaattttaattctggaatttatattatagggaagttgctttctcggttaaaatatttttctcagctcaggtaattttcgctaccctctaatacttggaagttttcctgcaaactgggtattcat

SEQ ID NO: 126097 - DNA, 1056 bp, Homo sapiens
gaattagaagcccaaaataaggaattcttttcgcctgtttggtactccagtacttgcctcatgaagctctatacatagacatattttggagttccagaaatattacttaaggttttgattcaaacagagggaacagtcacctcaggcaataatagctgtggctagggaaaagtaaaaggatacatgtggcaaatttctaggcaaggtttgtgaagataaatctgaggggaattgagctgtgaccgtttagatgatgcatttcttagtgactttctggctcattgatcaaaattttaaaatgaaacagatatgaaaataactgaaagccacaaaatgacttctcaatgccattatccttttcaacagagtaacagtaatatttaatgcacatttagagtattatagattttttttaaaaacttgttgctttaaatgagtactccatgataacattactttcttagatatttcttttttttacttcttagatacaaattatttttcttatagaatatttcactaaagtagtaatataaatctcagaaaatgtgctatttattaatctaatccagaactttggaaatgtttataatttgtgttttattctatcaaggaccaaaacaactgaaagtttcccaatagtagctgtagtatattgtgtatagtatgggagagaaggatttgctcctcttattggatgaaacaataaaagtataatattttaggctaaaggtttagcaaccctctgaaaaattaaataaaaacttaactatgtcatatgatccaattaatatatacatgtttatgttgtgtatatgcatacatattttatacacacaaacacacacatacacctttaaatagggtggttatgtatcaaaatgctaccagtggttttcttgcagtaaaccgtgaggtaaaccatgagcttttaaattctttctctttgttcatatattcaaaaagctctactgtatgtatgtatttgcatatttaaaattaaaaaaatcaataataacgcttaaaaaacccaaatggtgacctcattacatatag

SEQ ID NO: 126098 - DNA, 1049 bp, Homo sapiens
taaagtgtaagttccttatctggtcccaacctattttttcttttatctcttgttaatctaatgctagagactctgaactctattcatacttaactgttccttgtgtaggcctttttttcatacctgcctttgcatatgctgttttctttgtcactaattttcatcatagctcaagaatagatccagaaacaacgtttattggaatagaatgaaactagcatttattggactcattaactaaggactgcagtaggtactttaagtaactcttataatcctcacagccatacctaagaaatggtcattttccatgctgtacagatgggaatctgaggcttttaggggatgaataacttgcttaaaattacataactagttgtaggcaaatacggtattttgaacttcatgtccagtgtttgtttctatgaccttcccccacccacttcacattgcttcagtagtaaataaattagcaatcacattgcccatgtgatgattatcataacctctttccagacatagtatgcataaacatttgatgttttcagacttaaattctgtatagcagaaagaaataaatttaatggtcttaaatggtagaataatcactgtattgttctgtgtattatcagttttagtacttttctgtgataatctaagtatcattgaattgtgtattcctgtatgtttacattttaagtcttttctgtgatgtcctcataaagtactgagcagtttcacttttcctttactgcattttaacgcctcttctgcagttcttgtttgggcaaaatttcctacatttttcactatcccacaaattggctgagtaagatttatacataatttatacagaaatttaagtgttttcaaccataaaattcagtcaagctcattttctgccatgtgaagaggaaaattgaaaagttttatatatagataatttttgtaatccgaaggactgcctgtgaaaccttaacagtctctgtgtgggaaagtgttaaagtttaacaataagttaatttggacagtgttaaaaatttgagatt

SEQ ID NO: 126099 - DNA, 1050 bp, Homo sapiens
attaaataactatgtatgcaacaaatagatcagagcaataaaagaagaattaaaaattagtgtggaatgcttaatacacccttaggcatctgtataattgacattaatctgtaaattaccactgtgttttcttttcctgtccattcctcacctgttatatttctcatcttccttttttcttccttttcccttcctttccctcccttttaattagcaagtagtataaagatatttacatttatttttcttagtattgttattctagaatagagttttttaaaactaagaattagtcattcaagctgttgtaaaccagaccctcagtataaattggattatcagcttagaagtagagtttatcttttaaaagtgttatcttcaatgtatttcaaggtagaaaataagtgattttcatcctttatttttccctttctttccattttaggacttttcttggtagagatggaaatccaaataaacggaatgtgcacaatgaaacatctatgcatttgttgtgtatgggacctcaaattatgatatctgaaggagcccttcatcctcgcttggcacgccccacagaagatgatttcagaagagcagattgtctgcagatgatcttaaaatggaaaggagcaaaacttgaccagggtgaatatgagagagcagctattgatgctgttgataacaaaaaaaacacacccttgcactatgctgctgcctcagggatgaaagcctgtgtagaggtaaattttttttttttttaatattctgcattgtaaaatttgtatccaggtgatatgtaactgtcaggtttttttttttttgattgtcttagtaatttggtcattttttttctcttttgtcttctaaaagacccttttaaataaagggcctcttttttttttttttttttttttttgagacagagtcttgctctgttgccaggctggagtgcagtggtgtgatcttggctcactacaacctctgcctcccaggttgaagagattctcctgcctcagcctccccagtagctgggactacaggcacgcg

SEQ ID NO: 126100 - DNA, 1052 bp, Homo sapiens
ggctatacagaaacaggcagcaggtttgatttggcctaagatgactccatacttgaagcttattttaaatatgtaaaataacattatcaatatgtaacaggtcctataagcttcagttatacaaaggacttaaaaagtactatgtaatggatactcagcacacaaaaataaagctccattaaaacataagtctgacaaaaatttaataaataatatactgttcttagttactgagagtttttgttttctacttgggaacaggaatggacttgagaggggtggtgggttaggtctattagcatggcttagtaaaacatccagtgatatttcttcctttggtagacttccatagagcaaccctagtcattaggcctcattatgtttccattagtgcttaacctgtaatagtgattcagtaaatggtgaatgtgacaggggttgtttttgatagtgctttactctttgtgaaaagcatttttttaaatgagtgttatcttagatatttcctattcagctgtgccctacttgcttattcagagttttaagtgtagctgcttcatgtcagatcaaatagaggtcactataaaaccaaaggtggtaagtcacacttttcctttacagctacagggcctatttgacactttggcagctatgggagcgtttcacacttcattgaaaagtcgtaaaaaccattcacaggtcagactgaagaatattacctaattatattgtgtttttagcacctagagttttaaaactgtgtaaagaatacaggaattatatttccggttcagtagctgagtaactttgcctgtctgggcctctgttttctaatttttaatcaagatacttatgatctcattattgtccctcaactattatgatgctaaggcctatattaactatttaggcagtgactgttacaggtattgaagagataattttttaattttacatatcctggaagatttcatgggtagtagtaagattggagtgggtaatatttcagtttaagtatttggaggaggctattcaaaatgtggctctcagac

SEQ ID NO: 126101 - DNA, 1027 bp, Homo sapiens
cttaaaagccttgctactcaaaagaatcgtccttagactggcattgacatcagtcacctgagaacttgttggaaatgcagaatctcagctccatccaagaccaaccaaatttgaatgtagtttaacaaaatcccaaagggattcttatttaaagcttgagaaccctagcttggggcataatttgtgggctacctatattggaatcacctgtaaaaagtatacatacctcttacagtcccctctccatatctacctaatatgactatcaagctacccaaataattcttacacagtttgaaaacctttgtgctagaacagtagttctaagcatggctgcacagaaacctcagaccaataaaatctaaatttgtgagaggggaccccagacattggtaagttgagtaccaatgtattagaaggagtgataggagttagaagattaatgcgctaattctattgtgaactgacaaagcgtctgggtttgtgtggtggtactggagatggaaagaatgaggcagatgccagggacattgtgaagaactgttagcctttggtgactcagtcagttgataataagaaagcaagggaaagaaaggttaaaaaaaaaaaggatggaggctctataatgtttaatattgacaatagtgagctctctctttttgatttgtgtacattctctatacctgctatcacatctataattagagtaaaattaattaactttatttttaaataagatgggcatgattttgagcccaagtgacttcgaagcctgctaacaattaacagacattagaaagtaaggtgaaatggagaaattggttgaaaggaagagagaatatattgagttttcatttagaaggctagatattgacatcctagcttatccacatgaaatggtaggcaggctgttgataattacaactaaagtgttagggaataaagaatatagacactcatttagaatttagaattgagtgttatctacatagagttgacagctaaaagcaagataatgtatagatga

SEQ ID NO: 126102 - DNA, 1034 bp, Homo sapiens
ctgaatatgctgcattagacaaacgagaggtcagtttattttttcttctcagtaaaaaaattacatgtaattttagattttatgttgttttgtatttttcttctttaaaactcagtttgtgtgttcttctttacagtattctaaatatcctgtcatcttcatagccataaagtataaaaatacatctaggccaaccacagtggctcatgcctgtagttccagtgctttgggaggccaaggcaccggagttctgagaccagcctgggctatagcaagactctatctacaaaaaattttaaaaatttgccaggaatggtggcccacactcattgtcctaactactcaggaggctgaggcaagaggatcacttgagtccaagagttcaaggctgccatgagctatgatcatgccaggacactccagcctggcgacaaagtgagaccctgtctctaactttaaaaataaataaataataacatctaggaaacctggagctatgggtcttttgtctatcatatatgagtgtgtttacttacaaataaataaggtgctgatgtgagatatgaatcccatttactcctcctactacaagactccagtcctcctgttcatcagtctcaccttctcttttggattgatcatatcaacaaacatgctttggtagatcccatcttaaaaacaaaacaaaaaacataaaagcagccattgactcaacccttccctagccctgtctctcttcccctttagttgtagccccatatcatcttcttatgagagaaccacttcctcactttccattcactctttagcccactgcagtatgactttcttcccttctactctgatggaactgccccccgtcatggagtgacatgttgccaaatttagtaggtacttttctgccctcatcttacttgaattcctcagtggcacttgatgcaattgaccaatcccttcttaatgaaacactttcctcttggctttggggacaacattctcttctgattttcctttatgtcttcccggtctcaata

SEQ ID NO: 126103 - DNA, 1001 bp, Homo sapiens
atgattaaatcaagctaattaacatatccatccctaactcacctatcattttttaaagatgagacatttgaaatgtactcttattttgaaatatacaatacattattattggctaaagtcaccattgtgtaatagatctcaaaacctattcttcctgtcttatctgaaactttataccccctgtttatttttcataggacctatcacatgctataattattttatgtattttgtttacttgtttattgcctttctctcctattagactgtcaattccatgaaggctagagccatatctgcctattcagcagactgttttcagtgtttgaaacactacttgcacaaaacaggcatccatagatatttcttaaagaaattataacacagtaaattttttcctcccaaaaggattctgattcctcagtgtttagtgctaacttgattctaaaaggtattatgtaactactggtttgtacatgtttagaaaaataatcatacaattgtgttgtttattttccccatggattcccaacaatttcggagctttatactctccatatggccaaaagaactgagtttcttgggattaaaatttactttttaaaaaatctttgtttctgtagttaggttattttataggcaagcttattcagattaagtacacatagaaagacagaaggcctatgccctaagcgttttgctggcccttcacatggttatttaatccacatgggaaccttgaatgacagttgtgctctcctccccacctttttttagtgaggaagtaaactagaaaataactgaataacttgccagaatcaaagtgagctgaacttgattcttctgacttcaggtccaaacaacttccgtttgccatattgcctcctttttgacaatccattatcttgcgtcaaacagaaatttttactgtaataattagtgtagtcatttagtcagaagacatttaagcagtaatattccagaaataatattgatgtaat

SEQ ID NO: 126104 - DNA, 1030 bp, Homo sapiens
attaaatacctaagaattgtgctattagtattgtcagttgtatttattttatatggtagctatttctccccatgaagtgcacaaagtgaagttaaagggtcaccttggaaatatattgtcccttttaagggtggttttcttgtttctttgttttgttttgttttttagacataactaactttatataagaaaattttcctaagtgctcagtttaagttccctataatccttatgacaggcattctgggagctctcacatgctggattggatcttctcattgcccacatgatatatgacattttggctggtttcatagaaaagtattttctggtttaaaaatattcttaaaaagataaaggtaaatgcaggatttaaaaaataaaaactaaaaacacatttaaaaagaaaagtaaatggctattctattccagtcattttgaggccctagctggctattttaactataaatctttatgatctatactaaaatagaatgccatcttccaaaatttttatataatcttttgatcagaagaaaatgtaaaactccctattttatcattcattgatcaccactgttaataatgtggtatacaactctccagaatcactaccaaaaaaacatatatatggaatatatatattatatataaaacatataatatatatatacacacacacaaacacactttttttttttttttgggacagagtcttgctctgttgcccaggctggagtgcagtggtgtgatcttggctcactacaacctctgccttccaggttcaagcaattctcatgcctcagcctcctgagtagctgggattacaggtgcacaccaccacacccggctaatttttgtatttttagtagagacaaggttccatcatgttggccaggctggtctctaactcccaatctaggtgatccaccccctcgccctcccagagtgctgggattacaggcgtgagtcaccgcacccagcctaccttcaatatcgatgtttctgacagtctacaactgccattctt

SEQ ID NO: 126105 - DNA, 1049 bp, Homo sapiens
atctttcagcctcccttcactctccctagctctttcaattccactgccactgacttaaggctgtcattacttttcatctaaattgaagtacccagagtcctagtctccagttttaccattcttctttcacccaactaatttctcatactgccactattgtgttcttttaaaatggaaacctgagcatgtcattcccctgctgaaaacccttcagtggcttgctacagacttaaaatcatccaaaatttttggtagactttatgacataatctttacctagactgtcagtcttcccatttctttccctttaccaatccgaattgtccttagacatcatttcttctaggaaacctttcctgagtgtgtcttccgaagtctcagttgggacccatataatgggtctattcctattttattccatgcatatatgtgtcatacacttagaatggaatattacaatattgtaattacaatctctttatttgcttcttttcctttatattaaccttgaagctacttgaaatggcagcttttaatttttattgttaggtattgtttccataatacctaatatatattaatcactcagaaaacagttttgtaatgaatagataataagccaaaaatgtttttttatattttttgaaaatcaatgtttttgttgtaaaattacattttttattgccatgtttataaacttcaaagtaaattctatagaaaaaaatttagacctgagtaaaaaaattaaatttagaaattctgaatagtttttaaaaacaaaatatttttggccgggcgcagtggctcatgcctgtaatcacagcactttgggaggccgaggtgggcggatcatgaggtcaggagatcgagactatcctggctaacatgctgaaaccccgtctctactaaaaatacaaaaaattagcagggcgtggtggtgggcgcctgtagtcccagctacttaggaggctgaggcaggagaatggcgtgaacccgggaggtggagcttgcagtgagtggagattgtgctactgcactccagcctggac

SEQ ID NO: 126106 - DNA, 1039 bp, Homo sapiens
ttacagtggatttatcaggacttaaccccatcgtaagtcaaggagcatctatatttatatacgtacttgtttattttccctacctggaaatatactccttctattttcattgcatgtcaaagtcatatttatcctgttaaactgccaaatacatcggcttaatatagttgaaaaaaaaaaacctcgtgtagaaaatttccagttatttgtatttaagctataaaattttatagaatgtgcctacagtgaataatttaccctttagtcttctcagaaatagtgtgtgatcatgggacgaacacagcctttggaatcacagaaattggtttcaaatctctgtgtgagcttggacaagttatataacttccttcagtcttgatttcttcgcctaaataataattgaaaagtttgctgggaggaataaatgaaattatgtaaaacacctagcaaagtaattgaatgtattagtttgttgtttttaaagggttaggtttttatggctctagacattatagtatgttttacttggcaatttttaaaatgttcacagtaggaagataattttttttagttaagccaggttcaagatcacttaatatagaatttatacctaattcactaaaactttatttataactctaatttcttcggaagtttcttctgctttcaagctgtttattaaatgatttttaggacctgtaattggcattttgacatatctatagtgaactatgtaatcattttacaacttgatgccagtgaggacagttaaaaaattatatatacttttggaaagagtaaagaagctaaattaaacctatgccagcgaaaatgtagtgaattccaagagtgatttgtgagtgacctgttttgattgttagtagaaagtactggaaattttgaccatactgctagatcttgacatggttgtaagccatgatcaattatgaaagcttaaattttgtgtaaaaacgctaataacaagaacatacctagacattcatttgcagttactacttttatatacttttttctttag

SEQ ID NO: 126107 - DNA, 1092 bp, Homo sapiens
ccagctaatttttgtatttttggtagagacagggtttcaccatgttggtcaggctggtcttgaactcctgacctcaagtgatctgcccacctcggcctcgcaaagtgctgggattacaggtgtgagccaccgcgcccggcctaatacttagttttatagcagggttctctccctggaaagtgtggatatcttgagttgctgcattaaaaatacaaagttactctgttttcatagattttgaagggtaggtgtaatgtgaagggcatgatactgaagtggttttttgcaacatgtaatttgatgttggcccaaatgatttgtttcttgtacttcgttttccaaacgcacagttgctgattaatacataaatttggaatttaagggtttgatttttgcattaaaacatttaaatcccacttttatttatagtgaggtagtcatggtatttgttactgaaaggcacactaactgtccttaaaactttgaaagaggtaactttcaaaaacttttaattactgtactagtatttttgccttttaaaaaagtaaacaaaatgtattgttctctttcagaagtacatttctgtttaaatcattgttcttcttcatctccagtgtgacatttgtatgtgcagtatctctgtatttgaagaccctgtggatatgccctgtggacatgacttttgtagaggatgttgggagtcgtgagtatatgagcaccttagcatctcttactgcatgatagcactctgatttgttaataaaattgtttgctttcagtatttaatgatgcaaattgtttatattgacttctgagttacacagaaatgaatttagactttactagtaaggaaaaatatttttgtttttatttttacgtcttccccagctattttaattaatgctatttagcttaatgtaaggtacctttagaaacaaagcaggtatacaaataatttttcttagtattttagtttatattacatctaatgtaaatttcaggcaagaatcagtttgtcttatatcccaggaatcttaagcatttggttttgtgctgtctcaattttttgtgacaaccaagttgccttgaaaa

SEQ ID NO: 126108 - DNA, 1033 bp, Homo sapiens
gccactgtgcccaacccccctctttaacatagaaagtataatattgattattatgtattatttgggtaccatttagaaatttactgttctaatacagctacatgcatgtttctacttaagaattatattcatcaaaaagtgacacattgtatgagaaaacattttaaaattacatattttctgtgcaaacaattacatttttgctttatcatcatttacatggtttttagattaaagaaaacataaattttaaaaataattttgttactaagttaattgccactttccccttaataattttttcagtactttgcagtactatttaaatttcttgagactgacaactccatgcattttatttcactctttttctttctttgctttatagtaaattaccatagaggtacactctgtattagaatttagcattaaaatattttcttttgtgttttgttattgctgtttaaacaggcctttgttgaaaataatcctgccattaaatggtgtcctactccaggctgtgacagagcagtaagactaacgaaacaagggtcaaatacatctggatctgatacactcagcttcccattgctgagagctcctgctgttgattgtggaaaaggacacctcttctgctggttagtataagacaagttggaatcagcctaatcacctttctttccaatagttattaaagactttgcaccttgagtcaggcctttaaattgtagtatacttgatagtattcttcttaatttaagaaatgtgtaagaagtagtaatagttcatatttgttgtgtgcttagtgtgtgccaggcactacaccagctattttttacatattgaattctcccaacaatgctgagttgagttgatgttattatgcccattttacagataaacaaactcaggcacagagaagttccccaggggtatacagctaggaattggcagaaatgggattagaacccagctgtttgatttaaagcccatgtgcctaaactataataccaaattgctgaccatagattag

SEQ ID NO: 126109 - DNA, 1050 bp, Homo sapiens
aatctacacttataggggccgggcgcaggggctcacacctgtaatcccagcactttgggaggctgagaggcaggcggatcatgaggtcaagagatggagaccatcctggccaacatggtgaaaccccatctctactaaaaataaaaaaattagctgggcgtggtggcacgtgcctgtagtcccagctacttgggaggctgaggcaggagaattgcttgaacccaggaggtggagattgcagtgaggcaagattgcgccactgcactccagccttgtgacagagcgagactccgtctcaaaaaaagaaaaaaaaaatccacacttacatgagcaaagcacataataaagatgatgccagacttcagggcatgcagaggctagagggaagcagtcggacattgcggtatcatatgataactgatatagttgagtaaagatgagagtacagaaacaatgacaaactcaggttgggggaagaaagggtgtcaaagaatcttcttgaaggcagtgagctatgaactggagtttagcatctctgcctcgtagtaggtaattactgtcagcaactgaagtggcattgagagagatggcctggcggccatgatactttacaggcttgtattatatcaggggatttaccactgcctgagggctggtcctcagcattttagatctacgagggtcattttgtccactgactcagggttattctgacccacggagaagagactaccatataaaccaaaatgccacttattagttgataatgaaagagattcctttcacttgttgcgaaggcttcatgtccattatcaggagcaaagagaagtggataatctttggatattttatagtgaagcctgattaaacattcttgtcctgttcatgcaccgtttagtcaacagattttttaagccaggcacaatggctcacatctgtaatcctagcactttgggaggccgaggcaggtggatcacttgaggtctggagttcaagaccatcttggccaacatggtgaaacccaatctctactaaaaatacaaaaattaa

SEQ ID NO: 126110 - DNA, 1028 bp, Homo sapiens
tggataaaaaagatgttgatattttttgctttttactatggtaaagagtttctgatcattatatttgcatctggcctgttaagtaaattattttctaaagtaattgttctttctgtaattttctgtgatacaatagttattttaaatggagtaatatgttgcttttttttttttaaatttttttgtgtatattgtttttgatcccagtttatttgggcacaagtttatggagaaatcgcccttaaaccaggtttcacgaataggtcttttggaatagagttccttatcttaggctattcaaaatgaagcagtttaaaagtgttgccacagaccctgatcagaaaataaatattttattaaaattgagagacagcctgcaaagaaaagtgtggagggtttttttttcccccagaagttgtacactaaatcatttatttttgtgattgtgtttaatatcccaaagttgtgggagttagtgaagcctacgaggatgccgccaattgtctctggttattaactaactccaagccttgtgccaactgtaagtctccaatacagaagaatgaaggctgcaatcacatgcagtgtgctaaggtaagaagttaaagaggattttgcatgctttgcatttggaatcttaatttagtttgattgtcaatccaaaggataaattatttgagggggcctggtgcagtggctcttgcctataatcccagcacttcaggaggttgaggcaggaggatcacttgaggccaggggttcaagaccagcctgggcaaaacaccaaaaccccatctctacagaaataaaaacaaaaacaaaaaggtaagtgtaagaacctatggtattcaaccagaagatcagaaattcatgaatccttccttgctagtcaccttccccgctagtcaccttccccagtgagagtcttgagagaggggtgtgtgtgtgtgtgtgtgtgtgtgtgtgtgtgtgtgtgtgtgtgtgtgtgtgtgtgtgtgtatcaaatgattaacaaagtgctgccttat

SEQ ID NO: 126111 - DNA, 1129 bp, Homo sapiens
ccaggaccccaacatcaatgacaatcttctcggcaacatcatggcttggtttcatgacatgaaccctcagagtattgccctgattcctccagcaactacagaaatcagtgcagattcccagctcccctgtatcaaagatgggtcagaaggtgtgaaggatgtggaactggtgctgccagaagattcaatgtttgaagatgccagtgtcagtgaaggtagaggaacccagatagaagaaaatcctttggaagaaaatattctggcgggggaagcagcatctcaagctggtgacagtggtaacgaggcagccaacagaggagatggttcagatgtttcaagtcaaacacctcaaacctcaagtgactggcttgaacaagtacatttagtgtgaactgcacacatctgggctctaaatgaattacaggtacagatggtatgctaggtggagtatgcttgatagagactttgattcacttaattccaactcagtgataaaccactgacattagggttgaatacagagaagttcccttgaatggtagcttcattttttattttaaccttacagggaatttcctttgtacttaattgaatagcttttcccctttttgctgacaaaaagaagagcaagagaaagagaaacaaaaatgaaataaataagttgtattccacactctaagaaaatgcagtcctctatttagcctaggcttgacaatacttaaattgaacatttaaactaaaggcttactccctaatctttgggtggctttcctttaaaaaaaaaaaaaaagttttcttcattctagaaatttattttggataaatccgataacatatatgtcctcaatctctttgtgctcttccataacttacttcctttttgtctgagcaatgtgaattgaagtctctttagtaccacatctaccatagtgtaattagttttaattttcacatgaatcaaaggtttcctttcatgtctatttacagtccaattgtgccaaactcttacttgtgtgctgactaacaaggcatttaggtgtgcagcatcctagagtgctccagggcagtgtcagcgttctcgggagtaaaaggtgccacttggtagcaatgatattccagaattaaatgg

SEQ ID NO: 126112 - DNA, 1018 bp, Homo sapiens
gggtgcaattacttttaatcgtgttttataaaatagaaaaaaagtggagttttcatgagttatagtaaatcccacgattattaagaaattcagtaaaacatcctgcgcaacatgttaccgtgcctttgcctaacctaaatggatagttgccagttaaataagtgagtaattcaaatttcaatgtctcttctgaagtaactatgctatgaattgcaaagacctccataaaaccacccatggccttgcttttacactaactataacaactaaatgttcaatcagtttgtttgcctaactagcaaatgctgacatgtgtttgttctactgcgcaatactcatttgctgtgtgattactgtttagtgttgaaaaaaatcaacttcctagttatcagtgtcttactgtgaagaaaatactggtcttagttgtaattaggatacaatggtacagtgtgtaattaaaactagagtaaactgttggaatggctgttttacttaaatattatcaaaactagcataacataagcaaaatagataagtacaacactccatttagtgttttgccagattgttaccagaagtctacagataccaaactttcagttctgagtttgtacaggcaagtcctgggctgggtaaaaagttatattaatattgttatccacaagagatgtgattatgggttttgattactttttttttttccaaaccctgcttttgaaatatccttgtacttaaaattcatattgctaagacactgtattagaatatttaatattccccagatcctcttaggataaactgtgggaatcctcctatgccatggatatcaaaggtccacattagtttttatttctccagtgatcagaaacattgatatcaatccctattaaattagtggggggaatattaactttatctacagtgtattactgtatattaaactgaaatagtccattaaaggatttttttataaatttattttggattaaaaatatcaacaccaataagtttttagacc

SEQ ID NO: 126113 - DNA, 1078 bp, Homo sapiens
atctctgaagagtaaaaccttggaatctaaatattaagtgataatacaaactttgggggtgttttaaggctgaaataactccaaaggaaaaaatttttcatgcagtcagctcttggactgagtagtaggtttttttttgtttgttttctttgttttctcttctgagaaaaacaaaggatcttactctgtcgcccaggctggagtgcagtgatgtgatcatagctcactgcagcctcaacctcccgggctcaggtgattttcctacctcagcctcccaagtagctgggactacaggcacatgccaccatgctcgctaatttttgtattttttgtagagacggggtttcaccatgttgcccaggctagtcttgaactcctgggcttaagaaattcgcccatctgggcctcccaaagtgctgggattacaggtgagagccactgtgcctggcccagaagttgtttcatctcagcattgtgctacaggcataattactgggtcttctccttggcaacattatattgtcttgtcagttgttacagccttctcaccggaatgaaagatttctttctagaaagatagaagtggcttcttctagactgtattatgtgacagtactttaggaactggcagtagacttatttcttaaagatgaatcagaaaagtttcctttagacctcagttccacttaggactcacaggtagctgacagacttagtggtggccaaacttctgaaggaattattcttcttcactctttgaaactgcaatttgacaatattcttaatcaagctgtcttcatgtcttagccagctgtcccattaagtatttattgcataagtgcctagcctgtgtgagccatcagtacataacaggttgagacaaacacatgagagtgaacaaagccaaagtacaaaaaggataattgttggaggattcagtcaggcctcttatcttactaggtgtgccaagactgcaaggccctgttggcaattttgcctgagccatctcaggatttatgtaactagtaacttgagatcaaggagcaggcttaactgcttaagaagtggattcctcaca

SEQ ID NO: 126114 - DNA, 1030 bp, Homo sapiens
atgatgctatgtcagtgtacgttcatccgtgtaacaagtgtaccactctagtggtgggaggggttattgataataggggaggatgtgcatgtgtgggggcaggaagtatatgggaaatctctctacttctgctcaattttgctgtaaacctaaaacctctgtaaaaaataaagtctattttttaaaaagtggggatggtattacggcaatataaaatcaaaatactttatgaacaaatcttttctccagatgtaaactgtcatatatgcaccctcgtatgtgtatgtataattttcattcaaacgtgaaacaactttagaattggcaccaaacatataaacactgatacattagactatctcgaacaccttttactgaccactttgaaaacttgcttacctattaaggttcattcatagctgtgatgttctatttttattttcaatgtgggattatcttctgtttcccccagggagtatattaccaaattggtgatgttgtttctgtgattgatgaacaagatggaaagccctactatgctcaaatcagaggttttatccaggaccagtattgcgagaagagtgcagcactgacgtggctcattcctaccctctctagccccagagaccaatttgatcccgcctcctatatcataggtaagtttgacaaatggcacaggtttttttttaacttagttaactctccaatattatgtaaaagagtgtgttagtcagcttgggctgtcaggacaaaatatcacagactgagtggcttaaacaacagaaagtcactttctcacagttgtggaggctgaagtccaacatcaaggtgctggcaacacggatttctggggaggcttttcttcctggcatatagatggtcaccttcttgctgtgtcctcacatggcctttcatggagtgagagctctttggtgtatcttcttataaggacaccatttctgtcagatgagggccccacccttatggtttcatttaaccttaattgcctccctaaaggtctcatctccaa

SEQ ID NO: 126115 - DNA, 1302 bp, Homo sapiens
accactgttattctcacctatatgtcaagtttgatacattaccaaacaattctagccttctgcttataagtatatagaatttttatttaccttatctatggatcaggatctcagcagaggcagtgatgtatcagaatcaccttcgggattcctctactgcctcctctttctaatccccagattctgatatgcatccttgtcctacagcgaggcagcatggcatgaggtcagaacaccagttctggagccagactgtctaggttcacagcctgccatttaccggccatgtgactttggcaagtttcttagtctctcttgcctcactttcctcatatgtaaaatgggaataataatagtgcctacctcagaaggttgatgtgaggaatgaaggtattgatacatgtaaacttagagcagtgtgggtacaaaataaacatgatgcaagtgttcaatcactgtttttgggagaatgccatattctttaagccgttaaagaagaaaaaatgattaagaataatttcaaagtaatgcatgtttcaagggctaatgccaggttgctcccagagtggtctctcccagtgtctagaaattttaacatcttatgaaaatgatatatatggtcaaaaatgtatttaacctttcccttggctgccttccagggccagaggaagatcttccaaggaagatggaatacttggaatttgtttgtcatgcaccttctgagtatttcaagtcacggtcatcaccatttcccacagttcccaccagaccagagaagggctacatatggactcatgttgggcctactcctgcaataacaattaaggaatcagttgccaaccatttgtagttcacaaattaaaactgggtttccaggcctggtgtggtggctcacgcctgtagccccagctattgcaccactgctctccaagctgggcaatggagtcagattctctttcttaaaaaaccacaaaaaaactggatttccagttctctaatattcttagtaccacaagatatgtcataggtatctttaaatgaaattcttagctggaaaagtgactaaaaagtttttctcctgctacctagtaataaacaaatcattgtttattactggtcacttagaaaattaaaagggatagggccaggcacagtggcttatgcctgtaattgcagcacttttagaggccgaggcaggcggatcacctgaggtcgggaagtggatcgcctgaggtcaggagttcgagaccagcctggccaacatggcgaaaccccgtcgctactaaaaatacaaaaattagc

SEQ ID NO: 126116 - DNA, 1121 bp, Homo sapiens
agctgggattacaggcacatgccaccacacctggctaatttttgtatttttagtagcgacggggtttcgccatgttggccaggctggtctcgaactcctgacctcaggcgatccacttcccgacctcaggtgatccgcctgcctcggcctctaaaagtgctgcaattacaggcataagccactgtgcctggccctatcccttttaattttctaagtgaccagtaataaacaatgatttgtttattactaggtagcaggagaaaaactttttagtcacttttccagctaagaatttcatttaaagatacctatgacatatcttgtggtactaagaatattagagaactggaaatccagtttttttgtggttttttaagaaagagaatctgactccattgcccagcttggagagcagtggtgcaatagctggggctacaggcgtgagccaccacaccaggcctggaaacccagttttaatttgtgaactacaaatggttggcaactgattccttaattgttattgcaggagtaggcccaacatgagtccatatgtagcccttctctggtctggtgggaactgtgggaaatggtgatgaccgtgacttgaaatactcagaaggtgcatgacaaacaaattccaagtattccatcttccttggaagatcttcctctggccctggaaggcagccaagggaaaggttaaatacatttttgaccatatatatcattttcataagatgttaaaatttctagacactgggagagaccactctgggagcaacctggcattagcccttgaaacatgcattactttgaaattattcttaatcattttttcttctttaacggcttaaagaatatggcattctcccaaaaacagtgattgaacacttgcatcatgtttattttgtacccacactgctctaagtttacatgtatcaataccttcattcctcacatcaaccttctgaggtaggcactattattattcccattttacatatgaggaaagtgaggcaagagagactaagaaacttgccaaagtcacatggccggtaaatggcaggctgtgaacctagacagtctggctccagaactggtgttctgacctcatgccatgc

SEQ ID NO: 126117 - DNA, 1007 bp, Homo sapiens
aacaaagtgcaatgcagggtgacgtgtctcagtttaatactagtgatccactaagtctttgtttctatcccctgggattctgagctttgctggtttagaaccttgaacctcctgggagcaagtgatcctcctacctcagcctcccaagtagctgggactagaggcataccatcatgcatggctaattttttttttaagagatggggtctcactatgttgcccaggcttacttgtatattttaattaatgttctcctttttgctgttcccttaccccattactatatagttaagatattagatacgcagattgtattgatggtggctaactttataatttagttcatatatgagagaatatcaagataaaatcataactggaactaggagaggaatggatgtcatttaaatatcttgggcttggagctggatgtagtatagtagagggatgtgatttcatttctggttgagcggataattaaatgtatttgaattatgtgtaaatttcacattttttgatatacaaagaacagataattgtatcagtaggtaataggatattttatttcaaaacagtgaagaagctgctaagcataaaatttgtcaaatgctacaaaggtgatgaatatacaactgggaattccaagaaatttaaatttaattacattctttattatcttttcctcaaaagaaataaattagttccaccatttggctaatattatttcattaaagactgaatttagattttaggaaataaaatatggaatctgttataatgtcccaatttatactacagtattaatctcaatcctgatcattacataattatagcatttaccaatctgtgattttataaattaaccaaatttgttaaattaagaagaaattcatagacaccatttttttcctgttacaacatatggaaaagccatcaaaaaacttaacagaaccaaatcaaaaagaagtatattttatgctaaagttactttctgtccaggtcgaaac

SEQ ID NO: 126118 - DNA, 1032 bp, Homo sapiens
tttttttttttttttttttgagacagtctcactctatcatccagactagagtgcagtggcacaattatggctcactgcagccttgacctcctgggcttaggtgattcttccacctcagcctcctgagtagctgggactacaggcacatgccaccatgcccagctaatttttgtatgttttgtagagacgaggtttcaccatattgcccaggctggtctcaaactcctgggctcaagctatctgcgtgccttgacctcccaaagtgctaggattacaggtgtgagccactatgcctagcctaactcagactttaaaaatataaaagcaattcatttttattcccaagaacagtaaggtggtggtttaattttagtctttaattctgtttttaatttattctatttagaaatgtcccagaaacttagtataactttactttctgaaaatgaagaaacctgtccttgggcattagtgtgttggatttaagcaacaaagttaaaaaaacctaccctgtgttatggcaattttcacttgatggtggttctataacacaggtatcagtgaacctttataaaagatgaacaacttttcagcttgcttaatttcagttaattaacatgtatacttatctatgttaatgttttattgcttaaaatgtttaatttttatatttggtaaacagatagttttttctctccccctcttccttccatctttcattactacaatttaccatgcagagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagtatggctttttccccctcattataattgttaaaacttcttaaaaattgtttcacccttttgatatatatttctttgacttataaacgagctat

SEQ ID NO: 126119 - DNA, 1020 bp, Homo sapiens
tatcttgtctttataattttaatagttaaatttttaccatgtgcctcaaaaccgttagagaattaatgagctctttgaaaaatgcttctaagtttcttgtattgctctaatagaatgctatctatgttattatttatttctgagactaaaattgtttacatctttaaactggttgtccttttgtgtattttaggatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttggtatcttgtgcagtcatcattatacagttctgaaatataaagctatatgttggtgtaaagttgcagtgatttctctcctaaccagccccacatattcttcctggttggttggttcttcagtaaaatagtcttgtttcttgcttacactaattggtaatttgcattccttgttaagattttcaagacagggctgggagcaaggaaccaaagtagcgcgtggttgtgattacctttggtttctttgaggtttctcttacctagtggctttaaaacatctttaggagcagttccattttatagtaaacttaaattctgttatcatgaacagttgaggataatgaataatttgatacaataatgtaagaaattcctgaaaacaaagtgttatctgtgatacttttgctgcatagtaagcacaatgaagtgtactgataatgtttcaacaggaaagtgttttgattaaatgtgggcagtatcactgttctactagcattcaacatctcttctaaaaattaatagtggttcactgtaattttattggtacatgtaacatctgtacatgtgtttggttatctatatgtttcctggttttttgt

SEQ ID NO: 126120 - DNA, 1844 bp, Homo sapiens
gtgatactgcccacatttaatcaaaacactttcctgttgaaacattatcagtacacttcattgtgcttactatgcagcaaaagtatcacagataacactttgttttcaggaatttcttacattattgtatcaaattattcattatcctcaactgttcatgataacagaatttaagtttactataaaatggaactgctcctaaagatgttttaaagccactaggtaagagaaacctcaaagaaaccaaaggtaatcacaaccacgcgctactttggttccttgctcccagccctgtcttgaaaatcttaacaaggaatgcaaattaccaattagtgtaagcaagaaacaagactattttactgaagaaccaaccaaccaggaagaatatgtggggctggttaggagagaaatcactgcaactttacaccaacatatagctttatatttcagaactgtataatgatgactgcacaagataccaaatcagaagaggttccatttccaagttctgattcataagagcttccaaagtagagccggtacatattgaattttgattcatctggaaggatctcggacatctctaaagaaacaagggactgatctaagccacattctccatctccagctgaatcgtcagagccactgctatggttaagaaagaccattgaagacagacttaggtcactatcagagctggaacttccatcctaaaatacacaaaaggacaaccagtttaaagatgtaaacaattttagtctcagaaataaataataacatagatagcattctattagagcaatacaagaaacttagaagcatttttcaaagagctcattaattctctaacggttttgaggcacatggtaaaaatttaactattaaaattataaagacaagatagaatgtgtagataatttaccaaccatcccccaagaaagtctgtaatgaagctaagactcagacctctgggctttatttttatgtctctgactttccattcatacttttctactccaaaatgatgaatcaaccatgttatagagtgctttctcattatagagagctctacaaatacacacctttctggtagtaaagggagagggaagaacttcaatggcttgccaaaatagcaaaaacctagggagtttctgatttagaaactgtaggttctgtagacattccaaacaaatgtggtaaagaagagtaatagaataatccttcctagaaaatatatggtaaagtctataatgtaacagttcaaatatctactgtaaatattaaaatcataatactgtctttagagaaaaggctgatgctagggctgggatacagaaagtacaagataaaccaagaatatttttcttttttgggggcagggtctcattctgtcatccatgctggagtgcagtggcacaagcatggctcactgcatcctggatttactcaagcgatcctcctgccacagcctctcccaagaagctaggactacaggtatgtgccaccatgcccagctaatttttaaatttttcacagagacaagatcccactctgttgtccatagtgggtacagtttgtgcaaccatgatttggtctcaaactaggcccaaatgatcctcctgccttggcctgccaaagtgctgggattacaggcgtgaaccactgcacctggccaagaataacttactgtatctggaagtgaggaagtgattcaagaatgatgaggacatgtcataaagatacaggagccatacaaaaggggctcctattggccagattggaacaatgtgagcttcaaaacaacaactttaactgattattttttaaaagttaaagtacaaaca

SEQ ID NO: 126121 - DNA, 1022 bp, Homo sapiens
aggaaacaaacattttcatcactccagaagtctcctagcccttttactacccattcctcccctgctccatccccagacaactaccaatttgctttctgtcactatagatttgtcaacctgattttctccaaatatacattcaaaaatatacagttgaatacaattggaaattcgaattttgtgtttttttctttaggaacaaagatgtgaaattctgtgtaatgtaataaaaaataaattggactgtgatataaacaagttcaccgatcttgacctgcagcatgtagctaaagaaactggcgggtttgtggctagagattttacagtacttgtggatcgagccatacattctcgactctctcgtcagagtatatccaccagagaaagtatgttttactattaaaacctgaacttggaatcttctttctattgtggagaaatgtaattgtagtaagacaagaattaaatatattccattgtagtatttgaataagcagttatttgagtagaaaattagtgtttccagctaagatgatggcatattttgaaaattcatatagtgaatataactagtaaaagaagttttgtttatttttaaacagaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaaggtatgtttaaaaaaagaaaaagtgaatacttactcccagaagaaccactgtattattggctttggctttatgtgtcagcttgcccaatctccgtgtgagtcaacaagtgtttactgagttaccaaataaatgtcttaacactattttaggtactttaacaaattttaattttattaattaattttttattagaattgagacctcactctgtcatctaggctggagtacactcacagctcactgcaacctcaaa

SEQ ID NO: 126122 - DNA, 1067 bp, Homo sapiens
aggtgaaaattttaaagaatttagaatatgtttgccagtcctggaacatatttctttcagctcactaccactaaaaccctcatgagttcccaaaggggactaagtgccattatgtgatggtggaaaaaaaaagtttaattaatgaagtgtttaaaagccatctatctatttctctctgttctttctcattcaaagaaataccattttcaaaaaagtcattttcttggaaagcgcatactaacatttcaggtggctataaattataatttatgcctctagcacaatatgcaccaaatgttgacttacatatccttaaaatcattaagagaagcataaatttaaagccacgaattactaataaaattgaaaaataatttctataaaagggacataattcaataatccttacaagtagtgtattacctgattaggaggctgaatgtgttggacgcactgaaatatgtgaactccttgagcagaaacaagtaaaggatgtagagattgctgagactgacttgtggcaatcagtgcaaccaaacttcccatggagataaactcttttatcatatcattcaaagctggaattaagcaatatagtgcaaaagcttaggaaaagtaaacatgaaatttaaaaattatacattcattaaaaataatgatactctaaggttgacctttaaggtgcagtatgtatggtatcgctctttcatgtctttaaaaaatgaatccatctagttattccctgatttatctattgaggacctaataaatctaatggagacacaagaggtactgcaaactcagaccatatactcagagcaatgtctagtgaggttccctactcgtggatcttatgaaataaatgaacgaatgataaaaatttgtctctgaaataaatattctggaagggtgataaatttccatactgtattgtttgttaaacaaaatacagttcatattcctatgacttccagaacaatctcttcctaccccaggtcttataaggtttcatatgagaaggtcagaactgaaataggcattaataatgtacatctgagtcctgtcct

SEQ ID NO: 126123 - DNA, 1069 bp, Homo sapiens
attgactgaataacattcttctcattttctcattgttatatatttaatagttcctcagttattgaatgttttatgattatagtatctttcatctgatttttaaggcatgaatcccatcacagaaatacatagtgctgaaaaagcttaattgggtatgaaccaactcttcagggccacagagaaaagctccattttatgaccacagtttacatacttcaggccaaccagctgggtccttagttgtttaaagactagggaacaaagaggctcaaagggaaggaaaggggaggctctacgagtacatactcgatcaatgggatgaatactgtccacaagcagagcatcttaattcccaatccacaggatatatatacacgtagcaaaagctggactttgctctttagatccagatattgcatactagttaagctttcatcccaagtaaatctagattaaaaaactatgctatcttgtatttccattcaggacagccaagagaaaaatggatgaacagagtttcttcggtggattgcttcatgtgtgctatgctccagaatttgaaacagttgaagaaactagaaaaaaactacaaatgcggaaggcatatgtagtaaaaactactgaaaataaaggtatggaaagcatattgctaaatgcctcctgtgtgtcaggcactctgccaggtgtgtcatcatgcaattcccagtctagtggtaggagaggcaagtaaaccatcacagtattcagtaactgtgaaccacagggttctctgcagcacactacataatctgggttgagaagggagaaatattggttcatagaagacttcctatagtatgtgagaagtggctgaattttaaaggataagtagacgttaactaaatgggagaggaaaagatggaaaggcaagccaggcaagatgtttaaatgtttagaggaataaatgagcatcatgcatttaaggaactttaattaatacagtataaccaaagcccaaaggtttcagtgagagataagtttagaaaagtgggtaagaagtgaatcatggagggccttgtgtcccatgcta

SEQ ID NO: 126124 - DNA, 1026 bp, Homo sapiens
tatggggatgaaaccagacccatggagagcaaggaaagggtgacacttgatgctatatatctttttatccgttttaggttttaaaccatgtgaatatatacccttctcaagaaatgatttttttggagtagaatttgttaacatttttaagtgatttttttaaattatatgattctgaatgatgaaaacaataaaccacttctgtttccctttccctcaacttttaaattgtaatataaagaccattacgtgacaaagaagaaattggttacagagcataaagacacagaggattttagacaagacttccactcagagatgtctggattttgtaaagctgctttgaacacttctgcagggaactcaaatccttatcttccgtattcctgtgaattgcctttatgttatttctcctcaaaatgtatgtgttcatccgggggacctgtagacagagcaccagactcctctaaggatggtagaaaccatcataaaacaatggggcattataaccacaatgactctttgcggaaaacacagataaactctttgaaaaactcagtggcctgccctggtgcacaaaaggctattacgtcttcagaggcagttgacagatttatgcctaggacaacacaactgcaggagcgcaaaagaagaagagaagatgatcgtaaacttggaacttttcttcaaacaaacccaactggtaatgagattatgattggacctctgttaccagacatctctaaagtggatatgcacgatgactcattgaatacaacggcgaatttaattcggcataaacttaaagaggtaaggttatttttaaaaaactattctaagacacgatttggttataggattaaatggagaattatttgtgggaacaatagtactgtaattttttttcactttttagtgttttgatgtgtttttctacagttctctgttgaaataactgaatttggctaacattttatttgctttaaactgttaatacttgctttaaacaatgaacagacattttat

SEQ ID NO: 126125 - DNA, 1030 bp, Homo sapiens
cattaagtatgggtcaaaaaaagaagaaatgggccaggcgcggtggctcatccctttgggaggctgaggcaggtgtatcacaaggtcaggagttcgagaccagcctgaccaatatggtgaaaacccatctctactaaaaaaaacacaaaacttagccaggcatggtggtgcacgcctgtaatcccagatactcaggaggctgaggcaggagaatcgcttgaacccgggaggtggaggttgcagtgagccgagatcacgccactgcattccagcctgggcaacagagcaagactccatctcccaaaaaacaaagaaatgactttagacaaatggcttgaatgaaattacaaagaggagtgcattaaaaaataccagcagtaaaatctcttgaagaattaaaatgacaggctaaaaataaataataaatgttctttttagaaaatactaagttgctgctggcactctatattcttcttctttgttttaatggatgacttgtatgtacatcttctggcttgtcctctggaggctttggcacagatgaaattacctaattaaaaaaaaaaaagaaccattaaaacttagtttctatagcacaggagtaaataagctattagaagaggtaagactacatccaatagttcaatccttgatgtcactttcgaggcagagttcgcctaagttcaaggtacagcctatgacctaggcacagagtggagtcttccatttgaatactgatgacagtaaaatttctaaagctatttaaaaagaaaaaaaatttggaggaagaaaagtgaacatatgctctactttaacattcctttatagatctaaagacacttgttatattacggattcagatagatatcctggttttgcattcttgaaacactgataacgtttgatagatttggggggatgaaaacctttggagaaatgagcaggaagcagtataatcctcaatttcctggagaaaaaggaaaagcaaacacaccatcagaaaaagagtgtacaaagagtatacaataag

SEQ ID NO: 126126 - DNA, 1050 bp, Homo sapiens
ctccaattagagtataagtgttttagggacagggctatattttatatatctagggtaactcaggtatgcctattagaatagtacaaataaaataagtggcctctgtaaataaataattttttatgtatgtagggtgtctacagaagtgtgaacttttatttggtaaaatttttttagtctagagagctatttgccatgcaaaatttaaaactagtatttaccaagaaacatcttcctaagattatgacaatgatggcaagctatcgcttgcagactttgaaaaacagtaagagaagacagacttctgttggaggtgtttggaccatgtttaccagaagcaaatgtatagttactagtgccaatagcccatatagattcaggaaaaattttaaagggtcagagagtaatacttgctagacactctcctctgttgggctgcagcccactgctgaagtcaaggcaatcattgagagttcagccccatcctggcatttgggccccaagaagacattcatgattatttcagtaactatattcaagacttccattgagcttttaacctctttagcaatagacaattcctgtttcctgtaagtatggtgtatttcccaaaccaaatccagggtatattggcttgcttaagggatagaacactgaatagagtttcagcaagtacaccacaaactgctagaacacttgatctctttcaatacaattgctgtcaatgtttttaaaattttggagacatagagtactttgtgcttatgaaggtttttcatgtatgcatctgacaaaagttttctgagctgcaagtatcagtctaataattgatttggctcataaaattgccttacatgttcttcctttatcaactatgcttttcaaacatggtatacaagaacacttttttttgagacacagtctccgtctgttgcccagactggagtgcagtggtacaatctcaactcactgcgatctctgcctcctgggttcaagtaattctcatgcctcagcctcccgagtagctgggattataggcatttgccacca

SEQ ID NO: 126127 - DNA, 1049 bp, Homo sapiens
tacagtgaagggtgtacttcgtttttgcactctatgtaagaagagaatcataatactgatatagatacacacatgcatatacatgtatgtatatatatgtattgcatgatcaaaggtttaaaaacttcatctcaaagctccttgattgcagcttcatatcatttttaaaccttcaatataaaaatccagaaattatgtttttcatttcatatcccaaggaatatttaatctgatagaaaaaaatataaagagtgctttattctaaaatctctctaccatataataaactagtcattgcgtggaatataaattgtttttgtcttttagtatcataaattgaaataactaaagagaagactaatgacactttaactgctgttattcaaatctttaaacttcttatgctttaaaaagtctgtttcaagtttattatttgaatggagatggttacatttcttgagagcaaatatttgacatgttgaagaacagtctacaccaacagtcatctgaagaagagactgatgaaggaattaaagaatcggtagatataacactgtagaaaatggtaagaatgaaaaattacaattcatttttgttagataaagctaaggaaatgatttcttttcttccataatgaatgcagcctttatgagtgcaggggtttttgtttgttcctgacctaactattgcctagaacaatgcctggctgatagtggtgctcaacaaatatttatagaatagctgggcaactaaatgaatcactatacaaaatgaatgtttattttgttatttttaaaaattttactcagtaaaacctcattagtttagggggagaccagatgcaatgcatgtacaattggatgctactctattttgtctttatgacctaactcctccaatccacctacatattcattataatacaataacataataataaaaatagttgacccctctagagtgctttctaaatgcaggacccttcagggagctttaatctgtgaactcattttattttatttttatatatatatatatatatatttttg

SEQ ID NO: 126128 - DNA, 1026 bp, Homo sapiens
aaaatttgacagaataattttttaatttttttatttttttttatttttggcgacagagtctcactctgtttcctgggctggagtgcagtggtgtgatttcagctcactgtagcctcgacctcccaggctcaagtgatcctcccacctccatctcccgagtagctgggacttcaggcgcacaccaccatgcctggctgattttttttattttttatagagatgggatttcaccatgttgcccaggctgatcccaaactcctgggctcaagtgatccacccacctctgcctcccaaagtactagggttacaggtatgagccactgcgcctagctgacagagtcatattatcagttatgtttattccaaagttattaccctgtgcaagttactaacatctcttcctcccttccaaactaccctttttcttgacaaactttacaccaattttttacaaatacaaggcatgttactaggataacggtactggaataactgccataaatctgtggatgttccagatagaaaaattggctttatactcatgctacctctttgtaattgtttggattcctttggctgcccttagtatatttagttgttttaaataccattagagtgtcctgaatttattttaactagaatacagatttacattccttcaatcaagttgtattaaaaacctattgcttaattttctgacatttcatggagacccatagacaaggctcacagaaaccaagtgagaacagctattcttcaaatttaagtgacagggttcatagttttttaaaaattgctactttttaacttaaagtctatgaatactcatttatttatttgcttaagaaaagttttgagaaaccttttttccccccaactgtatttaatgatagatcactgcatccttgacttcccaggctcaagccagcctcccacttcagccttcccagtagctggaacctgtgacaggcatgcaccgccacacccagctaattttttttttttttttttttttttttttttttt

SEQ ID NO: 126129 - DNA, 1049 bp, Homo sapiens
gccagtctgagcagtacacaatgcctgtgtacctatttacttaaaactggcaaatttaatatctctgttctgtctgaaaactattttacaaaaacaattatgtttttatttggttactccattccagtaactgcaattactttacctttagaagttatatagcatgaaataatagtgattggtagcatgattcaattgaatttatttcctacaggaaattttgttagaagttatgttaatatgctaatgacttaagagtttctccctatctttttgaaaatcgacaagaactgttttagtcctcatatgatactggttgttgagactttttgaggaatgttttgagtagttttcttggttgtgtggattgtttggaattatgtggtagcttagaagcatggtaaagatgcttttaatttgcgtatttttatatagtaatgtctaacatggaattatctttacaggaaaaaacaaaaaagaaaaagaagcataagaaacacagtaagaagaagaaaaagaaggctgctagttcaagtcctgactcaccataacattaagaaaaatcaggattcccttataaagaaagtgcaatgtctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggt

SEQ ID NO: 126130 - DNA, 1033 bp, Homo sapiens
ccactgcactccagcctcagcaacagagcaagactccgtcttaaaaaaaaaaaaaaaaaaagaaatataagctcaaatttctgtttgacttccttaagctacaatatgaaatacgagagaccaaagtatggtgatttctgttatctttgataatagttacttccaaatcagccaaatctggtaataacagaaaaagcctctccaagcactagctgcaatgaaaaaataataatatgacaacataaatgactcattaataaagattcttttgatagcttttaaagccaaactctgctattaatgcaaattgagaagaaaagagaaagaagaggcgaattaaggaaaatagaagtagtatccaaacaagaaacagatcaaccaagagaaaatggttaacagagattattttcaaagagtaatgccaacaatatcagcaaagtaatttaggggccctcagtataaatgtgagctatgacctttgaaggcattttcttagggaaaggtgaaagaaaaatgaaaacatcatcatttgtaggtttcagtaaccccttcccagaattttcctgactcttaaaacgaggtaccttctctgataggaaggctcccctagtaatgattcagaaataacattttatgtgctccaagcctacgatgacgaataagtttttgtttgtttgtttgtttgttctgaatgtgaaagtagtttgggtgaagatagctttggtctgtggttcggattaattaattaagacataaccaaataagtatttgcatactttcactgtttcatgctttcagctagtgtgtatgtatgaagcaactctatgcaggcacttttctaagtcttaagagtacaaaagagtatgagatagaagaatatgatacgtgagagagatactgtggggacgggctcatgaaatcctcgctgaggaagtgaaattaagctgaaatctgatttacaagaaagagccaaccatgtgaatatcaaaggaaagaatatcctaggcagagggaagagctcttagagacctat

SEQ ID NO: 126131 - DNA, 1053 bp, Homo sapiens
tttaaacacatatttacatttaacactttgcgctaaaggaattactacatagagattcttttagatcactgcaaataatcacccatttattttcttttctgcagtactaggcctgtctaatccaatcctgggtagaaacaaaagaattagaatacaaaggaaccaaatcttacattatctgcatatttcatatgactgtataaagtctattctgtataatttaagaaaataagatggatattacatctaaatggatatgtagttatttcttttcaatatatttaatattgctttagtggaattaaagacttaaatcctggtaaatgttacactttttagacattctaaaataaaaatgggtaattataataattagaagaattaaatagaacttagaaacataaaatgtgtgtgacaaagtatgtctgagtcaagataaatgtatttatttttcataggatattaaaggactcagcaaaaagagaaagatgtattctgaagataaacctttatcatctgagtccttgtcagaatcagagtatattgaggaggtaagtatatgatcaaatccattttctctattttaaaatgcttagttattgatttaataaatatgacttagaaaaagaaatacttcatatttaatttattcacctttctagtatgaaaaaacaaaatgaaagttatttcatttcagaatgagttttgcttttttccagaagataattatctattattttttataattaactgtatttccacatacctttctaatctgagatatttttagtcttctaatatttcctttttattgtgctaccattcttgttacatgaaagaagctgtgtaacatacagcatgttgaaaccaaacattctcttacattgttaaaatagaacattgcatatactatctcagtttagttgatatttagctgtgttttgagctacttttcggggagtagaaaggtgatgaagtggagaagaaatgttggcaggaaacatatcatattacttcgttgtgagaactaaatgagatgataaattacgaaag

SEQ ID NO: 126132 - DNA, 1052 bp, Homo sapiens
gataaaaagcattggcttaaaatgatacagctggaattagaattaaaagttgagtctttatcttctaaaatctggtccaatgtcctttctactataccgtacctaaatttgttctgtactaaccaggattgtcagacacacagttggctttcaaacattactggtcagaaaaaagttaagaagttctcggaaaaaagtgttgattcctgagccctacctccagagtctgttttagtatctgattaggcttggaaacctacgtctttaacagatgccctgtgtgattctgatactggggtgtttatggaccacaatttgacaaacactgtactagagtctcaggaaaccaaagcagctgtctgcatttataacagatagctgcctgcccccgtgagagatcttctggcaaaatacctagcatctagaaagtactcagtaaatgttggttttctctttgtcttttaaagcagaagagctagtctcatgataatgatagctaacatttattgagtgcctactatctgttaggcacaattctaagcacttaatttattaactcattgaatctcaacaacttcaggaagtaatttggtaatccgctttatggataaagtggataaggaaactaggcttaggaagattaatagctagaactcaaaggattcaaaagcagaaattgttgcctcctcaaattagaatacaactccagtacatgtgaccaccataagcaaacacaggcaatgacacgaagtcctattttaaaataagctgtgtgggtattacagacagtacttatcattttaagagtaaatttggtatacagccagataaagaagcctgtttgcttacaagcaaatgtatacataacttatatttctcttaaattttcggaataatatactgggattggagtagccttttttcagtcatagagcaaatcactttttgggtgtttttgtccttgttctgtaatgctgtgtccttggcatttaaaattgatacatatatttctttgtttaggatagtttaaaaaagaaaaagaagtcaaaaga

SEQ ID NO: 126133 - DNA, 1605 bp, Homo sapiens
aaagagacctcagcttcagtaataatgcctgctgctcaataatacagaacccctatcccttaatatgctctttgaaaagagctagtagagggtcctttggtgatagggtcaaggattggcacctgtgtttcttttgactgtaattagaagctgaaatgggtgagaggtattaagaggatggagggaaggaagcagtggctgtctctgtatattaggtgtattggaaaggttagatagtctctgatggtgttcataacctttttgcagaactggaagaaagaactggaaaaacacagggagaaattgttaagtggaagtgagagctcatccaaaaaaagacaggtaataccacttttagtttattgctattcttaatctcatagttggattttcataataatgctgtatactactgttaatagatgcatttgcaaactcacatcagcttatttagacttgtacttttgtttccatttagagaaagaaaaaagaaaagaagaaatctggtagggtgagcaaaaattttccatttttctaaacgttacaattaagagccaacaaaaaaagtaagaataatttgtttaacctgtatgctaaaggtagcttaaactccagatgagtcaaggaacttagaggttctttgattgtgaagagtgattttgttctatcactgacataaaaaacggtgccaaccaccttataacgtagtacattttctgttgctatttaaagagaaagattggtgaccatggccacatatgttaacttgttgagcttttgtacagggaacaagtgtgacattttatattttcatatttatgacttatgaatatggcatctgtttctcagacactagattgatttcactaagtatttgagagactttgtaaaagaaaaacattctcgcatctcacaagctttaattgttttgtgcttggtcaagtattcatcttcttcttcatcaagctctgattcttccagcagttcttctgattctgaagatgaggtaaggtttgcttataatggttcatgaaataatatctcttaatttctttaatgtcaagtggaaacccattgtgaaatatctgttagaaatgttgacttccaggttttgattaattatccataacttagaggactaacatgagtgagtggtaactaggaacttaaatattggtatataatatattttttagattttaaaatttgttttgttgacctaaaaatatcagtagaagaaaatatttgaaaaatcaaatgctatttgactagatgctaggcattacatgtgattcaaatcacttgatctttataacaggaaagtgatgtattaagtattaagaaaaaaatatagaaactgatccttttgtgaaattttgttcactgataaaagttttatattaataaatgtgtaaattagatttttgagacagaaagcaaatgtttctaaaaatattttatgtaggataagaaacaaggaaaacggagaaagaaaaagaagaaccgttcacataaatcttctgaaagctccatgtcagaaactgaatcagacagtaaggtaaattatttaaattattaatatattggatacaaagacatttaatt

SEQ ID NO: 126134 - DNA, 2489 bp, Homo sapiens
tttgggcggggacacagatccaaaccatttcaccatcttaaaaactttgtagttctgtatagtctttataatggaaaatgtctaggaaccactgtggtagtgaatcttgattacaagatagcgggttgttctttctcctggctgtaggtgagactttgttgtgctatcttgattgtcatggcgttgaaattatgtagcataacaccatttcagcataggagcatccttaggtgtttgagtattttgggctcttctaatacccttgggccttgaatgtttagagatcacctgaccttggatgcagtttcatatacagacctaaaatgtttcatattactgaaaaaacgttttggttgaaacattcctctaaaacatttgaaaaacttaccaaattagcttcatttactagaacattttgatagctctgggctctacttactacttttggtatgcagctatggcacagagtattctggtaacattttgtgtgcacttcaaagattgggattaagaacaagaaattaagaggtagaagacacggattgtctaattcagtctcctcattgcatagaggaggggtaagactttaaactgggaccaaaacttcagtcatctgacactcaattctgtacatcttaactcttgattttctttttaagacttttttttttaagcatttttagttttacagcaaaattgagaggaaggtacaaagatatcccgtttacctcctgaccccactcgtgcatagcctccccattatgaacatccttcaccagagtggtacatttgttaaaattgatgaacctacattgacatgttactatcatccagtcagtagtttacattagtgctcactcttagtgttcattctctatgggcttggacaaataaatttatttatttatttatttagacacagtatctcactcttgcccaagctggagtgcagtgtcgccatcatggctcactgcagcttcaacttcccaggctcaagggatgctctcacgtcagcctcccaagtagctgggaccacaggtgtgtggaaccacacctggctaattttttgttgtttttttgtagagatggggtttcaccatgctgcccaggctggtctcaaattcctggcctcaagcaatcctcccgtctcggcctccaaaagtgttcggattacaggagtgccaccacatgcgttcaccaatatagtatcataaagagtaaaaatcctctcttcggcctagccattcctctaccacccctgtccccaagtgtggcaaccactgatctttttactgactccatagttttgccataacacttgatttggagcaacaaaatgaatatttgcttgtgaaaatattggcattttttgagattgtctcaaaaacagttcctgttctttcttacattgatgaaacaatcatagttttaaagatgataggattgctttccaaaaaaagccccagtgaatttcaggttgaacagtttttttaatttttatttttagagcagttttaggttcacagccaaattgaacagaaagtacagagggttcccatatacctccacacttgtgcagctctaccattatcaacattcgccagcaccagcagggtggtacatttgttacatttcatgaacctacatcgacacattatcatcacccagagtcagtagtttgcattaggggtcactcttggtatgcattcttgtacagtttttataactgaacgttttaattcaggacttgtaaagggctcttaagttcatgatggccaccttttgtgcttgttattttccgaagtgttcttcatgttcttttctgctactttgggacctctaaaatagatgtatcctctagataaaaataggtaatcaaattgacaaatgaaattctgcacattgtgtctttagccagttttactgcattgctctttttgtacctgcccccatacatatccccttgagaccaatttgccatcctgagtttcagaaacaaatcattttctgttatctgaactcatgcagcagtttgaagccacagagaattctagttacatatggatgtgaatgtttgatttacaaggtcacagtgtttataatgattaagtcatagtgaaatgtttcaagaaattgcacaatctctatattttagtgaatgcttaaccatgccacccacttaatgttagaagcattatttttcacactgatacaaaaatgaaaactcctgtacctttgtgaaaatagttgcttgttttaaaagctttctgttgtgcatagttttaaagaaaagtattgttgcttaatgaataagagcagactatcaagtgttttgcatggagcctagaacataagatgcactttaaaaaatattgctattataattgaaataaacaatggagatatttggagtgtacttaagcagactgagatagtgtttgtggtcaaaagcttaaaagtaagccttattcagcagtagttcatgtaat

SEQ ID NO: 126135 - DNA, 1042 bp, Homo sapiens
acagattgagagttaccacagtggcctgtcgggtccaccctgtgggtgcagcacagctctctgaaagcaagaaccttcctacctattctaacgtttttgccctctaagaaaaatggcctcaggtatggtatagacatagcaagaggggaagggctgtctcactctagcaaccatccctccattacacacagaaagccctcttgaagcaaaagaagaagaaagaaagaaagcttatctctaaggctactgtcttcagaatgctctgagctgaatgctcttgctcctttcccaagaggcagatgaaaatatagccagtttatctatacccttcctatctgaggaggagaatagaaaagtagggtaaatatgtaacgtaaaatatgtcattcaaggaccaccaaaactttaagtaccctatcattaaaaatctggttttaaaagtagctcaagtaagggatgctttgtgacccagggtttctgaagtcagatagccattcttacctgccccttactctgacttattgggaaagggagaactgcagtggtgtttctgttgcagtggcaaaggtaacatgtcagaaaattcagagggttgcataccaataatcctttggaaactggatgtcttactgggtgctagaatgaaaatgtaggtatttattgtcagatgatgaagttcattgtttttttcaaaattggtgttgaaatatcactgtccaatgtgttcacttatgtgaaagctaaattgaatgaggcaaaaagagcaaatagtttgtatatttgtaataccttttgtatttcttacaataaaaatattggtagcaaataaaaataataaaaacaataactttaaactgctttctggagatgaattactctcctggctattttcttttttactttaatgtaaaatgagtataactgtagtgagtaaaattcattaaattccaagttttagcagaatgtgttttttttctttctttttttttttttttttttttttttggtgcttcttatttgcaacctggccatgtggtagaaa

SEQ ID NO: 126136 - DNA, 1055 bp, Homo sapiens
gttttctagagcaagataataaaggagatgggccatacaaatgttttctactttcgttgtgacaacattgattaggtgttgtcagtactataaatgcttgagatataatgaatccacagcattcaaggtcaggtctactcaaagtctcacatggaaaagtgagttctgcctttcctttgatcgagggtcaaaatacaaagacatttttgctagggcctacaaattgaatttaaaaactcactgcactgattcatctgagctttttggttagtattcatggctagagtgaacatagctttagtttttgctgttgtaaaagtgttttcataagttcactcaagaaaaatgcagctgttctgaactggaatttttcagcattctttagaattttaaatgagtagagagctcaacttttattcctagcatctgcttttgactcatttctaggcagtgcttatgaagaaaaattaaagcacaaacattctggcattcaatcgttggcagattatcttctgatgacacagaatgaaagggcatctcagcctctctgaactttgtaaaaatctgtccccagttcttccatcggtgtagttgttgcatttgagtgaatactctcttgatttatgtattttatgtccagattcgccatttctgaaatccagatccaacacaagcagtcttgccgttagggcattttgaagcagatagtagagtaagaacttagtgactacagcttattcttctgtaacatatggtttcaaacatctttgccaaaagctaagcagtggtgaactgaaaagggcatattgccccaaggttacactgaagcagctcatagcaagttaaaatattgtgacagatttgaaatcatgtttgaatttcatagtaggaccagtacaagaatgtccctgctagtttctgtttgatgtttggttctggcggctcaggcattttgggaactgttgcacagggtggagtcaaaacaacctacatataaaaagagaaaaagagaaacttgtccatttagctttcataagaaatcccatggcaaaggg

SEQ ID NO: 126137 - DNA, 1046 bp, Homo sapiens
agtcttactctgagccacaggaagaagtaccttacgccagctcacaggggaactccaaacagtcagcaggaagaaactcagtcactcagatgaaaatgatggtgtctcaccattcttctatgcagttttctaaggggcaagacagagacatttggctgtgagacattaattaatcgaacagaatgtactttaactgttacctttcttatctaaggctgtgtggccggctcactggttttagtcaagtaaagagcaatgacttatgcatttaatgatctcactagacataatttcctttcatattggtttgtaagacaggtgctatcctctcccatctcaggtggagctcagaaggcccatttgttctaatattcctgaaccatgtaggatcagcaatctggactgttttttaaaaatcttataaaaatctgtataatgtatgcatcttatgtaagattattttttaaatagtatgtattatgttctttcatttaacaaaaatatacatggttgttgtagagcttttaaaatacgagtaaagagtataagtctatagtatcttgttataccagaaagtaagaaaatgctcaaaaaatatgggaacataccagaaaggcacagaatttagcttgaaggagccactggacaaatataaaacaatttgggcatcaaaatacataattatagtaaaggattataacctcctgaataaaattaaaatccatgagtccatgctgatataaataaagtgggagaaaagagagctttgtcttacagtagactgacaatcaataataacagagtgaatgatggagttagaaaatcatcaatggatgatgctaaaactactgagtggaaatttcatcaagagatttacgtagtgtcaaaatggctctttacaagatacttactttaaaaataaaaataggaaaagaaagaggaaagaaaaataaaccataaaccagtgaccaagagatgaccattactaatggtttaatagttatctttcaactgtttttcctatgcattataacattttaattttc

SEQ ID NO: 126138 - DNA, 1060 bp, Homo sapiens
tgtcaaaagattctactaggtcttgtactaaaatgatagggggtagtgacaaaccaagtaactccatacgggcccttgctgtggagtggtctgtggctgtctgatacccttgctcttttgttttgcgctgagcatctacctcccatctggtgttcctatggtggctgaaggagctggtgtctgataagacccagcacttggtttaactgagaaacattgggtatattcttacagaaataaaagatattacctagcttcttttatcccctcccttcatcttctttctcttcttccctccctccacgctcctgttctcctccttctcttccttctctttccctctctccctttgtccttctctccctcccactttaaccataggaaatatagagcattccgcatggtctttcgcctttaaccttctctggaaatacatgatagaattgggtttgtgatttattgctccagttttgcttgccaaattaaatttacaggtattagaatgtactcatagataggattgtttaagagttgttggctgcttaggagcgtgtgtgtatgtgcaaatgcacatacatgcacttttataacaggaaaaagaaaggtgtgacagacagctgcagacatatggattgtacttacttgctaattgaaacattgcaagggacaattcaagatggcagatttctagtggagattagattttaccatgaactgaactggatactaccagctcttctcttatcactggcacagagtttgctggacattcccagtctaaaacttgggaggagatccaatactttgaaagttgggcaacaagagcgtgccaaatgtgtttgcactgtgttgcccaaccatttaattgtaataatttgacatgctaatatttcaatattcagaagtaatttggaagccaattgctttatctgttttgcttatcagagtcatattgaattctctaggcatcagcatgcaataaacttgttttcaaaggcactctgttaggtggcatacagccctgattaaaaacagcactgaacttagacatgtttcattt

SEQ ID NO: 126139 - DNA, 1125 bp, Homo sapiens
caaagtgttgggattacaggcgtgagccaccgtgcctggctgggaagatctctttaaaaagcatttttatgagtgaggaaatatccaagatggtacccaggaaaaggtccaattttggttgagtaatgcaaacaaggtagttctaagtaagaacaaattaatactttggtaatgttattaatattgattttttaaattcttttttttttttggagacagagtctcgctctgttgcccaggctggagtgcagtggtgcaatctcggctcactgcaacctccgcctcctgggttcaagcaattctcctgcctcagcctcctgagtagctgggactacaggcacatgccgccacgcccagctaattttttgtattttagtagatacggggtttcgctgttgttgcctaggctggtctcgaaatcctgagctcaggagttcaccttggcctcccaaagtactaagattacaggcatgaggcaccgtgcctggcctgattttttaaattcttgatgtgtactttaacatgaatttgaaaaatatatttgttttcatgacatatattgagaagccaccaccagacctggcctttccctgtggcggcatctcttggtcctccaccttcccactccagggcacctccattctcatatcctaggtctgcctgttctgtgatctttaccacaaaccagattttatctgcttagtcttcttctaaccattctatcacatatcatataccactctaccattctttcttccctcttacttcccaagccattgcttccctcttactaacaactgctggtttattacttcttcccatgttcccatccctgttcttagcccccaatacctcccctcgctgactctctacttctgttactcctttcaaatctgactcttggaatccttgtcacataggaagaagttcctttcttccccaaacttttactcacaatcttcttcaaggtaactaaaacccggcctttttctgtaggtgctctatcccctcaagaagggaattgcagtgtttttagctatctgcttcttgggggcacagttccgccaaagcctcccaacttctctttgcaatcctcttacactcctgtctccccagtcctaatgg

SEQ ID NO: 126140 - DNA, 1184 bp, Homo sapiens
gtagagcaggcttcctgagatggacattgactttgtggtggcaacacagtcagttctagacagctttgctgggaggaaaatcaaagagttgaggatcctgacctcatgcttctccttctctctgaattcctgccgagacttcccattggccaaagccagtaagaaactggaggcatatggcagatacaggtccatttctagggcagagactatctggggcaacaaaaagaagacatccagcacagtgttcataccatgcttttctgccattgtggccatataatgaggatgaatcagataacatctaattttttcaagaccttggtgaaagggtacatgataaaagattgttaaatataacatcaagtgagagcggtttactctgaaatgtattttaagtcagagttggccttggctgtactttttcttatactattattgaacaggttcaaaaaaatgtgaatagagatcaaagcagtttaaacagatacatccacttgtgtaaatatccttgaactcccccctgccttccgctccccctcctgttgccacatccattcagcacctctagaggctgttaatacatgtaatgattgtaataaacatggtatttgctttggttccagctggctccaatcaccaaactctgtccataattcctattgtctttgcttactagacaactgcattgttaccattagtagcgacttttgttacggatttctaaatgttgatctttatatattgcactcattgttttcctcaacatgttttaaaatttaaatttaccattatattttctttttaaggatatttagaattattaaacagaacttctggtagaattgattatattgttgagaactttcacgagctaaaaccttgaaacaattttattgatattattcattctttataaagctttcaaataaaaataagcttctgctcatgcatgacttaaactggttttaagttcagcagtcttccatcagaagtttttagaggcacagaagtataataatgtctaagcaaagggaatttatattttactgtcaggaaaatttgttgcaatttgttctcaaaaacttggatccagatttagttgcagtagatattttaaatcctatgaaattacagaagttgtcataatttgagataattaaaatttcagtgacttaatgtag

SEQ ID NO: 126141 - DNA, 1128 bp, Homo sapiens
ctgtgcctttcattgccctgtgagtcttcttacacaatctctgaagctaatcaggtagtgctcttccctccacaggatcatttcctctgttaaagatacatgattactcaaagatattaagttattatgggacagtattgtcctcatattctccagtctaggtgattgcctctatccatcttcagcactgccactgggagtttcctgtggttattgatgtatctagctatcagataattactgagcaccttccatgcatgacactgtaaatgtattgtggccaagaaatggaaaagctataatgcaagatagaaagggtcaagtactatagaagtgcagtggaagctcagagaagagccattacttccagctgggagatcaggaaaggctttgtggatgaagcaatatgtgagtgaggcttgaaagatgggtaggatctggacctgcagagactcagagaaagagaatcccagagagagaatcagagaaccacaccagcaatagcaggtgatgggacatccacatatctaaagggagccagtggccccatgtgagccaaggcagctgtagatgtgaggaaatacagcccttctgctggtaatggatgcatcagagcagaggtgaggacaaagttattggcacagcgctccctgctgtgagactctcatctttgtattgacctcagacatttttttgccatatgtcaaaacatctccttctagcccttagattacaaatgggtgaatttgagatgactccattattattttatgggtatttaatgctttttttttttttttttttttttttttctgagatggaatttcactcttgttggcccaggctggagcgcaatggtgtgatctcggctcaccgcaacctccacctcctgagttccagcgattctcctgcctcagcctcctgaatagctgggattacaggcatgcaccaccatgcccgactaattttgtatttttagtagagacggggtttcaccatgttggtcaggctggtctcgaactcccaacctcaggtcatccgccctcctcagcctcccaaagtgctgggattacaggtgtgagccaccacacctggccagtatttaattcttaatagtttccataacca

SEQ ID NO: 126142 - DNA, 1571 bp, Homo sapiens
tgaaaagttttagagaagagaaaacattacaaggccccacagtaatccattctggtatttaacagttcttattgtcagaaaatacttccttctgtctaacacaaattcctaatgctgcaatctaagtccttctctcagatgtgtcctccttttctgtttgcagttttaatcttgctaaatgaacagcatgaaacaccctaatcttcagaagcatattttctttatgtctttcctttaatagcttaaagcacaaaatatagtggggaccccccccccaccacagtcctctgtagactataaattcatttctggtagcctggattactgggaaatgttgtggctggttttattttcctgcatgcatctcgatgacccatttcagatgggagtgtttgaggaggagagcgtactgcagaatgagctgaatgagctataccttcatgactgcttccacctgacaatctgcaaatcctccccatttaaggaaggcagtgctcatggaattttaaaatgttgaagaatgtgtgtgcctgaacttggattttaaaactatgcttccatttccctcatcacttgcactaaccatataacctgctagtactcatttagtaggtttgcttgcaacctgtgtcaaaaggagcatagtaaccaatgagaaagaaggcacggaccttagaggcatttgactgtttccatagcaaggaaaaacccaatttttaaattcttttacaaatctgagtaataatgtggcctctcaaagcaaatagatttccttaagagttaaaacaacttctaagaggaaacaatgagccctgcagcctgccatatcctgtgttcagaataattttcatttctacttatctgtgaaggttgaaggaatgtctgcaaatatttgcttggtttctatggtgaaagcagagggagatcaaatgtatgattgtttagtgtcaaaatcaaaactatactatactgtacttctacaaagagaatgagtttgttactttaaacataatagacgtttaataagtggtaactattttaagtttcacgagttcaagaggaaatttaaacagtgcagcctgaaggaaaacataggcccttcaggcattttaaaacttcattttacaaaaataaaatggtccttgcactttattaaaaagtcatctgttgactaaagatcatgttggtggactctcagaatgcctggtgtggacatggggacacaactatggcctataaaatttatactataatagaaacactctgtcctgccctgtgttatccctccttatcctgtaactctccattctgctgtcttctggctacccatacatttgttggaacatatgtttattttatgcttgctttatacaacactctgcgagggactgggattaaaagtccacttagaaatactctctaccctcaaagggctggctttgggcctagtagaccgtaaggatacaatgattgagatgcaatgtaagtgctgcaatcatttatgcttgcggaggactaggcagggcaaggttcacaggaattaagaatggggttgtgaagagggcattcca

SEQ ID NO: 126143 - DNA, 1031 bp, Homo sapiens
tgtacacctcagtataaatagataaataaatgccttaggcaattatacatgtatatgaaccaatgccaacagaggccaaaattattctttacaagaaatcttttttaagctattatgtataaattttattctattgccgtagttgttaatctagaacacttttcataccttcagaattacacaaacacatggattttttcctccttgttttgatttgctgctttggacagagttcattttttggagtttgggggcaaatttggaagaacttctttatcagaaaagatacttttcttggtcatacatttaacaaatagtcattgaatgcttgccgtgtgtcagatattgcactaagcattggggatccaaagattagctagtaaaccccagtccctgccactgtagcattcaattttatgggggtaacagagatggaagcagattcttctggtcacaccagatgtcagcaagggctgtaagagaggtgtactgcaggagtgtggagtaggaatctgcttcgtctctcagaatattctggaagactttcacagagggtatcacgaggccctgcttctatttttgccatatgtcagagttctcttttaagtatctacaatagtgatttaaaagtacttttcttcacaatctatacttccaacaaaggactaatatccagaatctacaaggaactcaaacaaaatcagcaagaaaaaaaccacaaacattcctttgaaaaagtgggctaaggacatgaatagacagttctccaaagaagatatacaaatggccaacaaatatatgaaaaaatgtccaacatcactaattatcagggaaatgcaaatcaaaaccacaatgcaatactgccttactcctgcaagaatggccataataaaaaaaaaaatggatgttggcacaggtgtggtgaaaagggaacacttttacactgttggtgggaatgtaaactagtacatcactatagaaaacagtgtggagattccttaaagaactaaaagtagagctatcattggatc

SEQ ID NO: 126144 - DNA, 1049 bp, Homo sapiens
atcataacaaaaagatcactcatcagcttctcctttcctaggcaattctgctttggtctcctttgtttaacttcattactggtaatcaccaaagctagaatcttcagatttttttctggacccatttatagcatcatatatttagttacaagtacaaaatatccaatcaaagtgtcttgaataataataacgtttaaatctgatataagaagtctggagataggtaattctgcaattggtgctgttgcttgatggtatcatcttggttccgataaccgaatattgggaaaataccattccttcttctttggttagttgagagtgtcatccctcagggcctcaagatggctgccacaacttcaaaagcattatatcacatacaacagtattctaagcagtaggtgaggaagcaggggccaaaaagggttttattgtctctttaatcagggaagacaatcttttccaaaagctcttttcaaacttccactttaggtttcatcactcataattgaatcccgtacctacccattgaccaatcagtctgtagataagcatattgctacccaaaagaaaatcaggttatgctagccaggaaagcaggggatggctgttgggtgaacaacgaatgtacaggcccttcattagtctagagatacacccccaccaaggcagcagggccactgtataggtaggaacatctgctgttggtttctttcagaggcgcactgatatattcaccaatctctaataaaatgttttataaagcacagtgcatttttccttacgtgctccacatatgttgaaagcagaaagctttagagtttcatggaaatgttgattagactaagaatgattgcttaccacacccaccaggactatgattccttagattccttaataatagcaatcagcaaacactttttgagtatgagccatctatcagcaatcagcaggtaacattcttctcaggcaaattcaggaagctaaggattgcttttaaaaacagtgaggcaataagaaaaattatgttaaactaagaacttttaaaa

SEQ ID NO: 126145 - DNA, 1044 bp, Homo sapiens
aggggagtagatggaaggaacttgtctccttgggtacgttaattgaaggaaggataagctgtaactgagatggacgcttttattttaatccccccaaatgggcactaataaccataaataaaaacaggaaacccagttggtttgtgtttgattttttttttttttttttgcttattaaatttgagcttgtgcgtaacatcaattaacattccattcttgctgaaagttgatatgttcaaacaggaaaatgtagacaaattatttcatagaggaaaaggagaaaggcagtcataaatacacaatttttcagtatctagtttatactgcatgctttatatttcctatagtgacataagtaaaacatgttagcagctgagaaggattctaaaacaaaaatcagactttattggaaagagtgacggttggaatttaatggtaataataaagggtatgttcctacagggtactgcattttaaaatttccccactcttttgtatttttctatttaaaggaaatacccatttaatatagtaatgcgtcgatttatatacacatggtgacataaaaacttggaatcatagttttttagactgaactggtatgtatttttagtgtctcttgaagagaaaaagactacactcctcttcctggaaatacacattttttagtgggttatgtcatacaggaactgagaatcaacttaatttgtggaatgttaaaggaattacaagttaactgattcaaaactgacatcttaaaactatgagaaatgctagtattttacttaccttgcaaagcctgactccagaggtaccctttctagtatccccttcagaaattaatttctttttcctctctgtttccagagtaatattttgggtttttttgtttgtttttgtttttgagacagagtttcactctgttgcccaggctggagggcagtggccctatctcagctcactgcaacctctgccctccgagttcaagcgattctcgtgtctcagcctcccaagtagctgggattacaggccaccccaggctaa

SEQ ID NO: 126146 - DNA, 1025 bp, Homo sapiens
tttagtactaggtgctataaaataataatcaccattaataacaatattattattcactggattttaattgttgaaatggcacattaaacaatagagaagcaaaaagtgtcccctcacgacctcctccttcctctccccagcatgagccactgaaaccagtttggcagatatccttccagaatgtttcctattccatcaaaaactattttaaaattgtcctttcattaataaaatacaggttgagagtgaaattttttgcagtgttcttgaaagtgtgggagtggaaaggcaggaagggagacaattcactcattcagccaatacctgtcaaatgcctgccgcatgccaagcagccacaaaatgctaaggattcggcgtccagcatagcaaatgctcaacttccgttttgagtgtttactgattttctttttttaattttattaggatatgatgtttcagcttctccgaggtctggactttcttcattcacaccgagtagtgcatcgcgatctaaaaccacagaacattctggtgaccagcagcggacaaataaaactcgctgacttcggccttgcccgcatctatagtttccagatggctctaacctcagtggtgagtgagagagtgctgtccttttattaaacttatttttcctattttgaatgacagtctgtccctcttccatgtctctaatgttagtactgcccatgactagttggtggatagaatgtctttgcccatttttatatggcagtgggtaggcagaaagcattctgcttacagctacagtcacatccagcctgggcttgttgtggacaggatccattgcagaaatagcctgttgcatcttagccactggacaggaatcagttacaagtttccaaatgctttctgccataaccactgttttcagagctgtatgtacaatgcctagggaacacacagctcaaggtcagggaagaaagagcacgagcaacgttgacctgtctgcagcatcatggttttgagaaacagagtgcctacac

SEQ ID NO: 126147 - DNA, 1023 bp, Homo sapiens
aaaggggtcctcctacctcattgaaagcagggagtaggaatgaaccacaaatctgaggtagaaacggctttcttcaatacttctgccatgatgtcaggcaggaaacttgaggcaccagttttagttggccctcttagagcaagagatgccaatttcaaaaggtagtcttcttactagctgggcgtggtggtgtgcacctgtaatcccagctactcgggaggctgaggcaggagaatcgcttgaacccaggaggcagaggttgcagtgagccgaggttgcaccactgcactccagcctgggcgacagagcaagactccgtctcaaaaataaataaataaataagataatcttcttatgcaattttaagtatatctaaaaattgagaaataaaagtatttctcaaaataatgtgtagattctgagaaatttgcctcattcggtatttataatttttcaaatgttagatcacaaaggaaaatcagtaaggtacacataaatgcgagccctcatgagtatgggctcaatcactaattatgggatctctggtcttacagatgggtagactgtaaatgatttttcatctactcttgttgctgatctctgattttaggggatcatcagtaattgaattctatttgagattaaatccacttctgaacatcaggttgtgacatttattaagttattaaatcatatgcttcagtattcacaggtgaagcatataatttaataacttaataaggtcacaatttgatgttcagaagtagatttaatcaccataaagtaggttgtttctttggttaaatatgaaaatatagagaaagtaaataaattaggcttgcttcatgtttaaaaagcattattatttcagaattgtttctttggcctaatttcaggatctgtcgtataatgtcaggcttcagttgaagcagttacctgaagattgtgtagactctagaggaataccagaggattggaaataggaatagcagagaaaataccaatttagtgaacaatgatgag

SEQ ID NO: 126148 - DNA, 1034 bp, Homo sapiens
tctaagcccaggtgaagtcaggtgtggtgctttactaacgtcattgatatgtaggaaatttgtttaaaggcactgaagttttattccttaaaatgttctattgaaaaatacttactcattaataggagatataaattaaagagatgcttaggaataggagaattccaactaaaaatttttaagccacacaaaaatctttcctttaaaaaagtgttcatcactcattcatgatttgacctttgaaagttgctatttgtttcatatacactaatgatttaacagttctctagggtcttaaattagtaaaccattaccagacttgcaagtgtaatgggtcagaattcctactcctgttttattggtaaggaaccaaaactatattaaatttaaatatatcatagtcataggtttttagtgctgacaccaatgtggctaaacctagtactctgaggctcatatattgaaagccatgagtactcagaatctaattttcttctaattgtcattctaggcctttagcaaatttaagctagcagttttgctgatttttatattaccagtgttcactgttgtcactggccatacttgttaattttttatttcttggccaaaaccaaagaaaatatttatcattctactgtagtatagtcataccacttttagattagaatgttaaaccaaatgtagcaaagattggggactgcaaggcataaaataatgtttaggaactgcaacattaaaagataagtttactattaagcaatcagatttagatcaatctggaaatagctatcctcaatttaagatgttctaggccgggcgcggtggctcacgcctgtaatcccagcactttgggagattgaggtgggtggatcacaaggtcaagagttcaagaccagcttggccagtatggtgaaacctcgtctctactaaaaatacaaaaaaaaaattagctgggcatggtggcacatgcctgtaatctcagctgcttgggaggccgaggcaggagaattgcttgaatccgggaggcagag

SEQ ID NO: 126149 - DNA, 1034 bp, Homo sapiens
tggaaaatgctgctgataaagttttgttgttatttgcattctgcttaactgaacttccccgtagatcttttagatttatacacatcatgtgcgggtcttcatgaaaacctttttgtctgtgtgaattaggtagcttaaacagactcctgccttatcattcgttgtttagaaatgagttatagaattcaccatcattctagatagaagttaatagctaaaaatagtttatcttctcaacagactaagaaatgtctttagtgatagctaaatgacgttctcagatactgactgatacatttagaatttgacatactgaatgatttattccttttgttttagattaatattgtattttttcccatctggctctcattaaagaatctggtgcttaacaatagtcccatttcttcctgagcagtttcaaggacattaaggccctccaaatgtaggtatgcctgatagttacctgttcttggccatcttctgtctgtgcacccctctttcctctggcattctattccacccctgaagctttagttctctcctttatgagtttgtcagaaaccctgtgttcagcatgcagagcagggcatagtcctttttcttatacagttttctaggcaaattggactgctcatcattctcttggtatgatctgtgattttccaccttggtggccttccttctcatgccatttcttttgctccttctcaccaggctatctacctaaatttttcaagtgccgtctcaaaagccatttgatcaactcttatagctagatgtaatctcacatgccttataacacttgttctgcatatctctacctctttatcttgttttctgcctttaattgggattttttaatgtacatatctcatgtattcagtcatcctcatgtcctgacagtgtcttacacaatgatttatacacataggtacaaagtaaataagacacattgtcaagctttctttagatgtaagtattttcaaaattatttttaaaatgactttcaaaggctttaaacatagactatc

SEQ ID NO: 126150 - DNA, 1021 bp, Homo sapiens
agggtatctcatttgtcacaaagtctccccatcactgacctctgcttcactgcagctccaaatggtgtgctgcattcagaggcagaataacagagtggttagaaaatcagattctggagccagacagtctgatttcaaagcccatctccactacttactgtctttgtactttaggcaaagtattaaacctctctaccactgttgctgtccattttttgtttttaaacagctttattgagatgtaatttacataccataaaatgcacctgtgtaagacttcaggtcagtatacttactgagttgcacagctatcaccatgatctaaatttaggaaattttcatcactccaagaagaaacccagtacacattatcagtccccattcctccacactctcccactgctcattgtcccaggcaaccacaaatccactttcgatttctatagatctacctgctctgaatatttcatataaatgaaataatggaatacatagtcttttgtgactggcttctttctcttagcataatccctttaaggtttatccatgtcatagcatgtatttgttcttcatttctttctattactaaatagtattccattgtatggatataccacaccttgtttatgcattcatcagttgatggacatttgggttatttacagttttgggctatcacgaatgatgccgcagtgaatatttgtttaccttcactgcgtcatcattcagtgaacatttgtgtctatttcttcgtctctaaaatgagtaccatctcatacagttgttaagattttttaattaactagtaaatgcaatattttagtgtttgagtcttcgtttaacagcagttacaaaatctggcttactcagaatgccacgctttcctaatgacatcttgaagtatcctcacttttactttattttactttgacttttccctaagttataatttagaaaaatttcatttattcaataaatatttattgaacacctatgtatcagacatggctgtgggtgccac

SEQ ID NO: 126151 - DNA, 1041 bp, Homo sapiens
tataaaactgcatgccaagacttcatggtagtttttttttggtcataacatcctttccaatttcaactatagcacatcatgattacactgagggagtttatgaagagtaggtttcatggatgaacattatcagtcttgaccatagtgacatcttgagctcactcattttggtgggaaaatcatgctttcagagtgaaaagttggaacagcatgacggaaaatggatttttattttaaaccattgagaagaaatgctgtatgactttatgatggctaggagataccttacatataattacctcacaagctgatgcttttaccaactaacccccaaagcagcatctctttgatcctgagtgacttgagccaagggaagtggcaacgtgatggtggtgaagggtgtggagtgggcagattacatgattcagtctccaactcatcccaagtctagccatgcccctcttagtatgcctactttaagggcataggctatgtggccaattttccttcatcgagatttcaagctctttgaatcaagagagaaggcaatatgtttatttagaggttaagaaattataggctttcagagttaataggttatctaatttttctactcattcgttcagtctttgaacctagaattatacaaacagtacatgaccagtatttgtcccccaagatcacattacagcagtggtcttgaaccaggggtgaatttgttccccaggggatttgacagtctttgaacacattttgtttatcacaactggggcggtagagtttatagatgttactagtgctgcgactactgccactaacatctaataggtagaggttattgatgttaagtatcctgcaatgcacaggatggctccccacaacaaacaaatttcaaaatgctgatagtcctgagattcagagctctgcatttcaaaaagacactagttaacaacaatttgtagaaggcaaaaaattataaaggtctgcagcataaattggaaaaaacacataagtccaaccatctagcattaacaagctcac

SEQ ID NO: 126152 - DNA, 1065 bp, Homo sapiens
aagcaagcagtatgattccctttctgtttccctctcaaattctctacaaccttgattttcacctccatcttcttttcacggttatttactttgtaattccagtaaacgaattctggcaggaatagactgctaccctaaagtgatttgtgatttaaaggacttcagggtccttaaaaattatcccattttacatagaaataaaatcccaaatcatgaattactatgaattgcatatattttcttggccactgttgagaaaggcaaaaaaagttgttagatcatgggtgtacagaccaaggctgggaatttagttgtaacttacttagaagaaaattgctccttgtcagaaggctgcagtcaactcacatatatgccctttgtttctgacatagaagagggtctgatcaccaaattagtatgacaattaaaaataaattctggtgattgtgaattggcatcaactttatatatgtttttagaaatgattgagcagtggttaatgtctgtacggtaaaccatgaacaaacttttgaaccacagctcagtaattcaatatatgatatccttgtgaaaggtactgtgctgtcatcttaaaaagtttgagtgtgggccaggcacagtggctcatgtgtgtaatcccagcaccttgggaggctgaggtgggaggattgcttgaggccaggaatttgagaccagcctgggcaacgtagtgagacctcatttctacaaaaaatatttcctaaaatttagccaggtatagtggcactcacctctggtcccggctactctggaggctgaggtgggaagatcaaggcttgagcctaggagtttgaggctgcagtgagccatgatcacaccacttgaccccaacctgggagacagagcaagaccctgtctcaaaaaaaaaaaaaattgaatgagaaaatttaaattaaaagtctgaagctacacatgggcctcagaaataacaaacactattacttattgattattggatattattgattacctaagagaggaggtcaaatgtgggttcacattccagttctgccacatgactatgtg

SEQ ID NO: 126153 - DNA, 1051 bp, Homo sapiens
aaacattcatttatcctaaaatacttttatttttagaaggttcaaagtataatgttaggaacattaactctcacacctttccagcagcagagcaagaaaaacaaaagaaggccaggcacagtggctcacacctgtaattctagcactttggaaggctaggatgggaagattgcttgagcctagaagttagagaccagactgggcaacatagggagaccctgtctctacaaataataaaaactttttctgaaaaaagacatctttgcatttcaagggtagacttttaaactttagtttaaaagtttagtttactcagaccagtacattttaaaactttttagaagaacccaagagactgtctgagtcgtttcaagttgggagttttagctgatatagtatacatttcaaccatgtagaatcactttaaaaagttattaaataatcttgggttaaaatgggatattttcttgttgaaccttgagaaaccaagagacaggtttggagattggggctagaagggactcccagtgctgatcatgaatgaaatacattcaaattatgtaagttcccttgacctgggagaacatagcttctttgaaatgacttttttttttttttttttttttttttttacatattaagactcaaaagaagagtggtaacattctgctaattcttacaaattattttaagcccatgaaacttaatcagtggctatttaacttctagctgattagatgagaactgatgccacttggttctcagctaaagttttgtgaagggaagaagtctgtttcacagacattactactcaagtattgactgactcaaagtgatggaactgatttcaaggagagctgtatgaatgtgactgactcggtggtaccaatccaatcctagaaaaactagacttttgagatgagtcaagagaaacatctttgtttaggaaagatggtataggtttggtttttttttttttcactttagttgataaaagtaagaggtgaatccatcattaggcaaatagaaaatggtctggagttgtatttat

SEQ ID NO: 126154 - DNA, 1022 bp, Homo sapiens
gcagttctttcttctctttaaaaatttactcatctttgttttaattgccttgttttgttatacttaacctaaccagttttatagaacaactgatatttctgataattcggttaccaggaatttcctgattgagtaggcaacataaccaaaaggctaatcagaatcaagtgctttttgaagattaaattttacctccctaacatagggattgatctatatgagatactgacacatagctaatataagtgaacatttgagctccatttattcaaaaaggatttaggaagggcatatgctttaaaaaccatggggctaggtgctgggaaagataccagggtaaatcatacctagctactctcctgaagcagttcttcccatgtttgaaggaataagatgatcaccataaccctgatacatgataggatcatgtgctgtaagaaagatacaagccagtgcttacctgtattgtttctagggattatatttattagtgtaacagtaaaagcaattcaaattcaagtattggctctggaaactaaaagtcattacatatcagtgaataaacttgtgatgtttaaatattataattagaatagtcactgctttaaaaacaaaacaaaaaacccaaagaaaaggctgtaaagcttaatgattattcaaggagagttttctaattttctctcttttttaaagatcttagtaatatattgcataaaaggtgagtaaaaatgtgattttctctggaaaacctaattgttaacagggtaaaagaaacatgacatatttgactctgtaaagccaggtcttcaattggattagttcatgagaatccttctgaataaaattgctatttgtgtggttgaataatacatttactagggcttttttcaataaaagcaggaaaagcaggagtttaattctccttttaaatatcagtatgttaaaagtatgtttgttctttctgtctctgagagttccttgaaaagtttctgatttttcaaggttgtttagtaaataaacat

SEQ ID NO: 126155 - DNA, 1074 bp, Homo sapiens
ttgacttttcctaagctatttagcaaactttcggtaatatagttcaggggaaaacccaagaaaatatcttggaaatgtctgagaagggaaagaagaatgcattaaaatgtactgcatttatattatgctatttctgttaaaattatagtttctcatgattattactcaataaagataacatgtacacaaacacataaatcaggttaaaaagtagggtaacttgtttcaaggttaaactagaagtgtattttaaaataattgtgtagtacattatagcaaaatctcatttctgagtttctggaaaatatattttataaactcaaatagccaatataaatcagaaatgaattagatttaggtgtacattatataattattatttgtaactaaattacacatttccttaacaagttaaaaattatagaccaaaatttaaaattttatgtttattttagtgaaaacaaaattgtacaggtatttgatatataaatgttcacacatgaaatacattccttgtgtgacattaagaagtctttcagtgtaagttacaccaccatatttggaaataagtccatgaaatgtaatttttaaatacctgtaagatgatttgcaactttagaatatctggtatgtagtgtgaaaatactggttggagtcattattcttgagttctatatattaattctcagaagactcctaaacaaagaagttggaatttggttcacagtttaaaaagtttgaacatattttcttatgataacctgttacccacagcagaagttatccataaacaaaaataatctggtatttactaattttatacaatcaattgtaaaactgccttgggtctgaagctttcaccaactgggacttaatgtgaaccataagcaggaagagtgaacaatgataaattaacataaaagatagcagtatcaggaaaagaagaggacagagagttaacactcagtactaacatatataattaaataaagtttcattgttttttacattgtccaaatgatctagtaacctaaatcatggaatttctgatctagcaatggttgttgtcaaatt

SEQ ID NO: 126156 - DNA, 1136 bp, Homo sapiens
acttattctacacttctaataaaaacagaagttgcagaatatgggagatacacaggtgtgcgtatcattcaccctctgattgccctgtactgtctaaaagaactggaaagaagctatcacttggataaatgtcaaattgcattgaatatattagaagagaatttattctatgattctggaataggaagagacaaatttcaacatgatgttcaaactcttctgcttacaagacagcgcaaggtgtatggagatgaaacagacactctgttttccccattaatggaagctttacagaataaagacattgaaaaggtcttgagtgcaggaagtagacgattcccacaaaatgcattcatttgtcaagccttagcaagacatttctacattaaagagaaggactttaacacagctctggactgggcacgtcaggccaaaatgaaagcacctaaaaattcctatatttcagatacactaggtcaagtctacaaaagtgaaatcaaatggtggttggatgggaacaaaaactgtaggagcattactgttaatgacctaacacatctcctagaagctgcggaaaaagcctcaagagctttcaaagaatcccaaaggcaaactgatagtaaaaactatgaaaccgagaactggtcaccacagaagtcccagagacgatatgacatgtataacacagcttgtttcttgggtgaaatagaagttggtctttacactatccagattcttcagctcactccctttttccacaaagaaaatgaattatccaaaaaacatatggtgcaatttttatcaggaaagtggaccattcctcctgatcccagaaatgaatgttatttggctcttagcaagttcacatcccacctaaaaaatttacaatcagatctgaaaaggtgctttgacttttttattgattatatggttcttctgaaaatgaggtatacccaaaaagaaattgcagaaatcatgttaagcaagaaagtcagtcgttgtttcaggaaatacacagaacttttctgtcatttggatccatgtctattacaaagtaaagagagtcaattactccaggaggagaattgcaggaaaaagctagaagctctgagagcagataggtttgctggactctt

SEQ ID NO: 126157 - DNA, 1036 bp, Homo sapiens
agcaatgaagtcttccgatttgcatcagcttgtatgaattcacgcaccaatggcaccatccattttggagtcaaggacaaaccccatggagaaattgttggtgtgaaaatcaccagtaaggctgccttcattgaccacttcaatgtaatgatcaaaaagtattttgaagaaagtgagatcaatgaagccaagaagtgtattcgggagccaaggtttgtggaagtccttctgcagaacaatacaccatctgacagatttgtcattgaagttgatactattccaaaacactctatatgtaatgataagtatttctacattcagatgcaaatttgtaaagataaaatatggaaacaaaaccaaaatctttcactgtttgtaagagaaggggctagctctagggatatcctggccaattccaagcaacgggatgtagatttcaaggcatttttacaaaatttaaagtcactggtagcatctagaaaagaggctgaagaagagtatggaatgaaggcaatgaagaaggagagtgaaggactaaagctggttaaacttctcataggaaaccgagactcactggataattcatactatgactggtacattcttgtaacaaataaatgccatccaaaccaaataaagcacttagattttttaaaagaaattaaatggtttgctgtgttggagtttgatcctgaatctatgatcaatggagtggtcaaagcttacaaagaaagtcgggtggcaaaccttcactttccaaatcaatatgaagacaagacaactaacatgtgggagaagatttctactcttaatctttaccaacagcccagctggattttctgcaacggcagatcagacctgaaaagcgagacatataaacctctagaaccacatttatggcagagagaaagagcttcagaagtcaggaaactaattttatttctcacagatgaaaatataatgacaagaggaaaatttttggtagtgtttctattactctcttcagtggaaagcccaggagatccactcattgaaa

SEQ ID NO: 126158 - DNA, 1056 bp, Homo sapiens
ggattacaagaaattatattgttgcatcacttattcaacaaaacatattgagtttctctgtattatgggtctttttctaggtaccagtgctataaaggtgaagaaagagaaggcatcaatagaaaagatattaatgagtagtagcttttataaacttgttcttccaccagtcataggtaccttaaccaccatgtcctgtccaaacctgctcccagattttgcccaagtggcatttgacttgtgtgcaaaggagagtctgagaaggacttagcagtagtagaagtagtcatagaagaggaagaagaaaaaggaaaaggagaaagaggagtagggagggaaagggaaggggagagggagaaggagaagagaatacaaagaaataagtaaagaaaggcaaaagaaggaggaaggagagaagaaaatgtatctgagaaataggaaggaaggaaatggacacaactcggtgactgaatgtgggaccagggaataggcaagaggaatgagtctgagatgacatttagctttctgtcttaggttggtagttagtagggccattcacttaaataggcaatacagacagaatagcaattttgggggaaagaagatggtttagttttgatatatcagacctgtatggtgcttctggcacttccaagcagagacatccagaggcagctgggtgtacggttttagagctttaaagatatagatttgggatgtaccagtgttacatgaagacatggaaatgaatgaaatcatacagaaaatcatacaggagaataaaaccattctgtagagagagaagagaaggtgtagaaggatgagaatttggtggacatcaatattttaggccgtaattcttaatctttgcgggttgatgacatttctgaaaatcagatgatttctagagaaagccaaatttcacagacttacagaattttgtaatttccaaggtgttgagactccccttgtgaacttccatagatttcagctgtttaaatggtggaagaggaaggggagcccatgaaagacagtgagaaggggaatcaaatagaa

SEQ ID NO: 126159 - DNA, 1058 bp, Homo sapiens
ggggtgaggaagtgaactctgtgaggtagatatttgggaaggagcatttccagtggaaggaaaggcaaatgcagaggtcctgaggcaggagcttgtttgagaaattgcaagtggcctgtgtgggtgaagtgagtgaggagaagagtagtgggagatgaggttaggatgaggttagatgactgaaggcaggaagctagatcatgtagtaccttataggtaatagcaaggtcatggctttcattctgagtgaaatggcaaatagaggaatgatataattggacataacacttcagacagaccatttggacccatgttttaagaacagattgaagagcggaaaagagcaaaaccaggggaggtgaatgatgaggctactgtggtaatccaggtgagagggtgggtgtaagccttccaccctagtggtggaagtgttgaaagaggtcagactgtgaatatgctgtaaatgtagaggtgacagaatttcctgacagattgggtttgggctgtgagggaaagagaagcatcaaggatgactcaaaatagtttggccctagcaattggaagaatgtaattgccatttcctcggatggataaaactgagggaggaacagattgagggaagggacatggtttttggacttgttaatttgaaagcctcttaaatattcaactggagagatacagcaggcagttggccagatgaatctgaatttatggggcgaatccagggtatagctgaaactctgggagttacaaacatgtagattgcatataaactggttaagatcaccagtggaatgagtgtagatatacaaagaatctaaggttggagcttttgagaatccagtgttaaaaactcagggggaagtggtggatctaggaaagcagaatgagaacatgcagcttgtgaggtaagaagtctttagcttcctgaatggcacctggaatatagcagatgctcaataaatatttgttgcatgaatgtgggatgaagagaacaaccaagaagactgccttgaagccaagtaaagaatttaaaagagtaaggagtgattagc

SEQ ID NO: 126160 - DNA, 2134 bp, Homo sapiens
attgaggtgttcttcccttattatctgtggtgagacagattttagaatattattaaatagtaaaatttatatatctgtgatatgtatgtatgatatgtttaggtagtcacttttttttcttttgttggacattaaaatttttatcaaccttgttgatgtgcaaggaattgagaataaaatctaaatattcaaactggctagttttcttctgtagttgttagtgttaatggtcggctagttcctaatttcctgtgaacttttctgatttctgttggtttgtatccttggtcagaatcgttccaggtagatgtgactgttaagacaaatgatcatttatttccatgcagatataattttaacagctacaattactataattgtgatttttttttcttaaaggaagaattcagggaacttcgagaacagccaagtgaccctcaagctgaacaagagcttattaatagtattgaacaagtatatttttctgtggattcatttgatattgttaaatatgagctggaggtaaacagaatttcattaaaacataactaaggcctgttttgttcagtgattggatttatgagatttgaatacttttttgaggcatttatgtatttttggtaccagaataggtctgtgattaccacattgtgattaaatcaactgtcagcattgtttggcgatgaaattattattttttgaatgtaactttaaatacaaccgttcagggaaacatttctgtatttttggttttcaattgttagtatttaatgtgttagtatgctgtttctatcctattttatagtatctatgtttagagaagctcagacttttaattacaaaatatgtatttacataattgtttagtgatgataaaaattcttatgccatagtgtttataatactgacattttaaatttataagaactttaacgaaagtcagaatagtgaaatttagtcttagatacaaccaaatgctgtatgcatatatactttatatgcattattcacagtcagtccccagctcagtttgaagtttcatcagtcagttgactgagattgtttccctgtatatggtatgcattttttggttagtttcccatactgtcctctgaaagctgatgtaatccagaatgtagtccaacaactgtcacacagtagtacttatggtttgtaatattccagaggagaaatctgttttgagttctatcataaacaaatagagatatatctgtggatggtagagttggggttaggttagttactgtctcacattctcctgtcacaggccgtggcagcagtgtctgtcggcctagggtccagagtccccagtggtagtggggtttctcagaaggcagagcagcagcagtgggggtaacaaggctgaatgaggggtggaaccagagggctgtgtactaaagatgtataggcttttgtggttggaacctaggagggaggttgggaggacaggtggcatggagggcagtgggatgtgacactgttttgtatgcacagtttgtagttcactagtcagaagggtccaggtaaatgaaaccaaattaaacaatttattttttcctcttctttcatgaatttttttctgtagaagcttccacctgttctcaatttgcaagaattagaggcgtatagagacaaattgaaacaacagcaagctgcagtaagtaaaaaaaaaacacatttctttctggcaaaactctagatgaaacacaacagagaggtataatgtttgcagatttatggttttaactaacaattaacatagaaacaaatcttgttatttaacatgactgattcaaatgatgcatttacattaaaaatttaatgcgtatggttttccttatgttaccttggtagatttacttctagaacttggaattttctctctggaatcctaaatgtgatcaaagaactttgaactttgttttagattagtaagtacctttaggctccttgtcatagacgtatgatttccctacccatagttttgtaactgagtattcctttttgttttttgagacagggtcttgctctgttgcccaggctagagtgcgattgcacgatcatggctcactgcagcctctccctcctggactcaaataatcctctcacctca

SEQ ID NO: 126161 - DNA, 3479 bp, Homo sapiens
tatcattgatattctaagaggaattaaagttttttgattctgtaacttttggttagaatatgaacagagatttttttttatcaggggctttaagaaaaaatgtttctattccaatgactcctgttgttgttaccttaaggaggaagattatccaggagctattcagttgtgccttgaatgtcaaaaagctgccagcacttttaaacattacagttgtataaggtaaggtcatgtaaatgttttaaagcagattctgttgtcagcttcttatgtagcagctgtgtaaaaatgttaataaacattgaaaattagtataaagtgttgtgttctagtttaacattcatatttatatatgggcagtacaataaaattataaataataggctttaaggtgtgaaagatcagatacttttcattcctgctttttcttgtcacctcattgaaactcatttttcatattttttccaatccaactgattctatttttatagagttgtagacaagaataaattatctgttcatatctccaatgcatctcttgggaattcttccttaactttgcccagcttataaatattgaggatattattgcagcttgttttggagatccagatggttcaagtgtttggctcatcatgataaaaagtcttttggaaaatttaagtatggtttcaatttatataataataatgtttgtaatagttaagtgattatgtattcaatgtgttatgtcttttgtttattattaaatatacaacagaaaaatagccactgcatattttgctattatctctaactttattaatagcattttggtttgcttaaaatgaaggatttgcattgcttgtgacagtcttggggaagctctaatccctaggtgtaatttccaacattcctctagagccatcacaaataaatgtacaatctaagtaaaatagtgtgcttgccaaacaaatctagtttcgaattaaattcatacccatcccagattgcatcccctttgtctctcctatatggaaattctgacattcagtgagcatgactcactgttgttgtagatgttgattgctagtacctgaaaactaaaagaattataatagagcaaaacattaatataagtttgaattaatttttaaaaaattatctcatattacaagtctttgctggttataggctaagggctagatattttcctcccagaaatgctgtttaagtctctatggtttttttttttctttaaaatgtgcagattgaagttacatgtttttttgtttgtttgtttgtttgtttgttttttattttaaagatggagtctcactctgtcgcccaggctggagtgcagtggcgtgatcttggctcactgcaacctctgcctcctgggttcaagcgattctcctgcctcattctccagaatagctgggattacaggtgcacgccaccatgcgcggctaatttttgtatttttagtagagatggggttttgccatgtcagccaggctggtctctaactccaccgcgcccagcttgaagttaacacattttttatttggttaggatataaattgagtagtaccagtgatactttcattttgtccattttgagagtgattaactgtcattagtagaaacttgacgatgtcatttacacttattaggttaaataaatagagaattagttttagtgtgttgaatgtatttagagatttccaacaagccattctgggtcctgaaaaagcaaatccatttgaaccaaagcatccatttagttcattttgtagtgataaatctgttatatagtaacagcttattgggtgaaaataattcaggcagtttacagagtgtttatgccaggtactttgctttgaaattgtcagtatggtgataaaccacatacagtgtaatcagtataatccttggtttcataaagaacataatctatcaagaaggacttatattaaagtaggcacccataaaattaggctgtaggccgggcgcggtggctcacgcttgtaatcccagcacattgggaggccgaggcgggcggatcacgaggtcaggagatcgagaccatcctggctaacacggtgaaaccccgtctctactaaaaatacaaaaaaattagccgggcctggtggcgggcgcctgtagtcccagctactcgggaggctgaggcaggagaatggcgtgaacctgggaggcagagcttgcagtgagccgagattgcgccactgcactcccacctgggccacagagcgagactccgtctcaaaaaaaaaaaaaaaaaaaaaagaaattaggctgtagagagaaggaagttgtgcatacagtggaagcattcggatctaactctccttccgggatcaagactaaggaggacctgaacgaggagcaggaagacttgaggtaggccaggatatgagagttgtgaataggaaactgtctacaccagaaatgaaatctttgttgcggagttaccaagcaaaatgaagactgaaaatatgtatctattggatttatagcaacaaagaagtcatagttgaccttttggggacagatttggtgggagttggttgaactatcaagtgtaaggtgaggaaattttgtgatgaggacagatgcagaattaagaagaggaaacctcaatattggaaaattggtaggagagagtgagaagctgaaaataaaatagcataataatatactaaggctttgcagggattatagcagagattgactttgaaaaggtcactgtctgttataataggaaagaatgagcgtggaatttggtggcaggaaattgagggagcaggtgatgtgttgaaacttttatataattaaaaatctattttagctatgctaaagtaaatgtcttacatgatgagtgttaactgtaaaaaatgtctttgaaagaaattcttatttgggcttttaaaaattgatatcaagtggcttctcagcactttttaaattaatggatatactgatatgtggaggaggtgtggctacagttatcgaatgaggttaaaaggttgaaatggaaaagatttaaattaatagttattttaggtaatacagtgtataagaagcatgctatgtttagatatgtgagtcatgcatgtgataataagaagaattggtcttattctctgcaaataggtaaaagtacatcacacatacattcagatatcccaagaaattctttgtaatggggttttactttaggtatcttaggaaaacttagataaagttgtgtttttaacttggtgatttagtgacagtgtcagggtgactcagagagcagggctatcagttggagctgtctggtggtgatgatagcccctccgctagcatttcttctccaccccataccagcacagtatcctttgccagccaccattcacctgcctaacaccattccctctttcacttcacctgttgtttcactcttttgtttatatgggagaacataataagtttgt

SEQ ID NO: 126162 - DNA, 1025 bp, Homo sapiens
tccacacttttaaaatgtatttaattgacttgggcttgtggaacttagccgaaggcaagatttaatctttgcttggacatgagtgaattagagtgaataagcattttacattctagtaatcttaggagcagtaattaacttccaactgaatttatatattctcaattttaaaaacatttatatctattctaattcttgttgataactagagaatcataaatgttttccttttagaaatgatttttgagagaatcaccccatgatatagaatatttctgaattctgatgtgatttttaaaaaatattttaagcaagtttatatgcacagtatacctacttgtctacttgttaattttttcttggcagattatgtgttcctcttttctttcctagtcacatcactcctttattggaaataaggtttttgtttttggtagagtgcaaactctctaaggagagttacttggaatagctgagatggaaaaacttaggactgactcttatgattctgaaaataggaaaaacaatttacatatttgcttctgcataaagaaatactgactctatatcttgtaagtctcagattatatgactaggtagtttaatacatgaaatgccaagtataatcggctctctgtatccatgtgttctgtgtctctggattcaaccagctgaaaatggaaaatatttggaaagaaaaaacagcaacaaaaataacaatacaacacaaaaatcacaatgcaatcataaaaataataaaaataaaaaataatacaatataactgtttacatacatttgcattgtattagacattataagtaatcaagatgatttaaagtataaggaggatgcggataggttatatgcaagtactgtgccattttatataaagaacttgagtatccgtggattttgatgtctatggagggtctcagaataatcccccacatagactgaggaatgattatcatataatgatgcacccagttggttgaaaaatgaaacagaagtggcacttcctctg

SEQ ID NO: 126163 - DNA, 2540 bp, Homo sapiens
gattaggtcagggatttctttctttctttttttggagacagagtctcactgtgtcacccaggctggagtgcagtggtacaatctcggttcactgcaacctctgcctccctgattcaagtgattctcctgcctcagcctcctgagtagctgggactacaggcacacgccactacacccggctattttttaaatatttttagtagagatggggtttcatcatgttagccaggctggtctcaaactcctgacctcagatgatccacctgcctcagcctcccaaagtgctgggattacaagcgtgagccactgcgcctgggcaaggtcagggatttattaacagagttaagtgaagttaagtgaagacagacatctagttagatccaaagtgatcttaggaattctgttatagcctggttatatatggtttgaaggatcacatagacacttcatggtacttaagagttgttggtttaactttagaatgttgaaaaatcagtttctctgaggtctgctgataaattctctgcttcctgtaagtagattgaaaaccactggaataggctctgatttaaacagactggaacgtcagtgtcttagggccatggagatacagtataaacttggaagtacatttacttaagctcattctaaaagttttataactttactgaaccatgtacaaattgggcaattgagtaactcgtcttcagcatataatagaatcatgaaacattagagctggaagcaaccctttctatctggcccacctttatgtaggaaactgatgcccagagatattaaaggacttgacttaaatcatatggttcattaataacagaccagggaaagatcattaagatattatcgctgtgccatcttgtctttttgtatagtcagatttgttcaaaatctttatttctatgcaacctttctaggactcattcttgtgagtgtatgtgtgtcctagattagttgtttaaagaacactattaattggttctttatggataatttattcctaatatttcctgtagtgatggtaaaaaccctttgcagaattgtttgattcgttccattcagcttgcagaccgcttttaaaggcttttagccttccatcttagaactggtaatttcttgaccataatgttgcatttatttatcaaagtgtttatgaatagatccttttaacatactttaattaattgatcaaaatggattgaattcatgtttctaaatgatggctaagagcttctttaaaagctgtacagttaatgtccactatttaatcacataacttttatatatgtatttttaattagtagtaaattgttgtcaaattgcagttgtacattttgaaagcatttttaatgaaagccaatttttgatttatagatttttatgtttgtagtcttccatatgctgtttaccttaccacatttgcattaaatcttaataaatgggatatagaattacttacctttaataacagccataaaaacatctaggtttattataatttcataaaccaacactaaagcccatttgttttgatagagaagctgaagaaatcgttgctttcacttgtgaatgaattcagatatatttctttttcctccagactcaaaatattccctaaaggaaaatgtttatcagttctgaattactcattattccacttgtccttgcctctctgcttctgttactctaggatcagccttgggtgaaattttgaactccatatgatagaggaactgtctttaactcttactcatctctcttttcttgctaaggctcctgcagaccagagttcagtgtggttcttctaaaacattctcttccctttcctgctgtctctgtagttttatttattgaggtagagaataggggctaatggaatgatggcaaaattttaccatttttctttcaattacaaatttgacttagaatatttattacctgctctgagttaggtagtaaatttagttctggggagtcactggtgagtaagccacagtgccttaaacacttgtgccttggagacacagccacaggtattccttactgtagtacaggaattcgtaaacagagtattatgaaggttgtgggggtagttacttagcagggaaggacttcccagagaatatggtattcgaattaagcctggaaagatagatggatgtttgtgagtgagaaaggaagaaaggatattcaagttattgtgagcactatgtacaagaactgagggtgtgaaagtctggagtttggttcaggtgctgtgcacagtacgtatgtctaaaatataggcattaagaagtctatgtgaagttatttttttcatgtcagattgttaaaggtcttacatgccatactaatttggggcttttctcgttagtttaatagggagccaccaaaagatttaaagcaggagattaatgtggttttatttttgctttacttaagagctgcgctcagatgtctttagggaccaggcaggtcatataaatgtgaggctgccagatgtaagaccataggaaatggta

SEQ ID NO: 126164 - DNA, 1360 bp, Homo sapiens
gaatgcaagatgacgctgagattttcagctttatttgagtaggtggtgatgctgtgaattgagacagagaacatgggagaaggaacagctctgagggagagaagatactgatttgttttgttttgcttttcttgtggttgggtgaggatttatttaattatttgaaagtgttaagatactgccatagctatccttttgggggaattattttggggacaatagttttcattcttcattcacttatttatccattcattatttttttggcaggagttgtcctagaattatttttttaaggaaatttcagtcctacctgcaagtattcccttaatctatgtctgatatttcaggcacaaatcctggttagagatcttaatttttctaataaggtatcagtcctacactgttaattgtcaaaggatatagttttgctcacttccagtttttactagagaatatactctccagtcctcaacttcagttcaaagtatgcttatgataaatactatttgcagaaaatgatctaattcctctagatgtttggacatttatcattgagagcatcaaaaactgtgtgcttgtattacattggttttacttttctgacagattgctatctatgtctatctatatctcactctggtattatctctgtagcttgccttgaaaggctctataagaagcaaatgcaaggaacccattattgtatgtattgtaaggatattgtcagggggttgtgcctttggagatcaagacactggcaaaattttctctcagaacttaatgcaaacaaaagtgattttttatatttttgttttgatttatttttcccctttgagctactggtatgttcttctgttatagacactggattaagtactatggccctccctatttgctttggctgctaggaatttgagagtcaagtttattatcagtagatagcaattttaaaaacctttgattttggtgtgctaaacgtctttcacttgtttgtactattttaagaacaatgaggttttattctttcttgttaaaatatgttctctgtgattgcatttattttgttagacatcacatcctttttagtagtgagataaaattcaaataatgttagttctattgattttttttttttactgacctcgtaagaattaaagggggaaaaatctagattcaatcacgtgtcctaagtgtatgagtataactcagtaagcttttataaagtaaacatagttatgtaattaccacctagaagtagaaacagagtatttctgacaccccacaaacttctcgcatgtctcatcccagtcattcttctaaggtaagcgctgttctggcttctgtcaccaaaattagt

SEQ ID NO: 126165 - DNA, 1154 bp, Homo sapiens
aaaggaagagatatgtaattatgagcatgaagcatgttttgcctgttacatatattcaaaattcatctctttccttgacaatctttgcaaaggagggtattcattttaataaataagaattatttgtatttggtttcttctagtcttttattgttttcctgataagagtatttataaaagttgagattggactttcaaattaccttttgagaaagtaatttttgaccacaaatgcaattatttgctattaaataattgtgagaatgacagtttatttgatagtcacagaaacaactgctttgagtggcttaagttaacaattccctgaatattttaatgaaggctttcttttgagagcccaggatttcttcacttttaatagatattattctgtatttatattaaaaactcttatttcaaagtaaaatcattgaaaaagaaatccataaagcatggtaatttagataaaagagcttaaaccttgaggaatatacttttaaattcaatgtagttttgttgagaattccttttcgttgattagagaaagattgttttattgttctccagtagtcccacaaattcagtttatataagattttagcagatgcttgaggaaacattaagtagtagtaagagtaagattcattacaaaactattattttgtttcctgtaaaacactaggcatgggttttaaggcatagaaattcacatgttaatatcttggtaaacttgattatagttgctaataaatttacaattgcaatttataactttatttaaatttgtttttgacttctaaatctggtatgatagtaaatgtatttaaatgttaactaaaagtgagaaattagtcttaatgttttcttctcattgccttgaaaacataattccttaaccatgtcttgcttcttcttttaattatataggaacagctggacgtagctctttccaaaatctgcaagaattttgacattaaccattataccaaggttcaacaagcttatcgacttcttggaaaaacacaggtttgttacaaaaggatgtttggatttttccttaatcaggaatttgttgtccttcatgattaagtctgaatattattaatctcatgtccttaaaaagttttatttaacgaagtacatttttattctga

SEQ ID NO: 126166 - DNA, 2390 bp, Homo sapiens
ctgcctttttttgtgtgatctcaggcagcgtgagggttaatagcatcttataacttgaaactttgaaagataattatatattctgattatacatactttgcttgttttctaatattgagctgtctatttgattaaggccatttaacagcaattagaataacctgccaactaaagaagaactttttatttcacaatttaacgggtgctagttacttaattccaagttgggattatttatatcatacatattacatgtcttatgtgtatatacatatttagcattaatgataaaatgccgtagatgagaatgagtgtttttctccccgattatatttgtttttaaatcatgaatgaatccagtgagttgcaaggaaagttttgctaaaagcatatgcatatttttgtctatggagactcatagcttttaaagcttcagagggactctaggagatttgctttaacccttggggtttagatacatgaattgctatgcaggagtcatgatcaagtaagtgacaaagttgggctccaagcccaaacatgtttcatctagttcagtgctctttccactatgcagtactacctctctggtttccaatggctggaaacttcttaagataatcatatttcatacagctaggccctcacagaagtaattagatattggagtaattaaatattagatactggctcagacacttccataggtccagagttacccccaaagatgttttcaactccctgggcctggtgctgttttgaccagcagcatattttcagaagccactcagataagcaggattctccccagcagcttctgatgatgtgagctcatagtactaacagcattcatctaaagatactgataaccaaccctttgttgttttttgaaatccatctatcactgtgtgtgtgttttggggggtggaggcactgggaattttggatctctgtgaggatgccaaaacatctgttccctttatgtttgttaggatgtgattagagtgctaaatcaaaacgtggaataagaacaaaataattcattacaaccatccctaagacttttcattttgatgctctaatataaaaagcattactttgaaatttttgtagggatttagtaatagagatttcttataagtattaaagtaaattatagaataaaaagcaaaagactagcagcttttcctcccgtatttactactttactttgcatttaaataactttcagaagatgacattcttttattgtgtgcttcaaacttataaaggctgcttatattaatttctggatttacactgttctttgaaaatggcctcaacttatattttataatcaagactgagatgttgctggttttgataagctagtttcatcatttttattttaaccaggtaggttggctgaggtggttaatagaagaaatggaaggtgccaagtgttactgtgaactgacagtgataagagatgggaaatcagatttgtggattttgtgaaagtgttaatcaaaattggattaaggaatgaattgtggcgttggaatgtgaagcatagtggaaatgctgtgagcttcttgcatggaacatccagtttcttcatcttctccaaatccttcctcctaggatatttgtttaccttttatgatcgccaaatttattagacatgtatgttgtctctgttatagagtttatggattttttttaaattaggatggttaaaatttccttttttttctgtgcatttcttgggatatttcccaaagattatatgcctattttatcttttcccctcactttacagtctttgctaaataaattgaagctaatagctttaagtggaagagtagcagtggaaaatagttttagaacacagggaaatatttggtaattaaatttcgatttcttatctattcttaaaaaaatttcaagatatgttatttagctcttggggatgtcttactatgtgaatattttgtaaattgattcaatcaatactttcattgctattttccatatgtgatgtgaacatagaactgggattataatatggtgctcctctgctatgatattcctagtattatgccaaatgagtctccccttcacctgaactgagtttcaatgttaggtatttagtaataaatgaatgacttcaaccagtgatgaaataggaagatacaagtatctctaacacgtttatgaaaggtgaagctgagaaccagagtggtttattatctaaggcatgcgactgtaagtttgtggaactagtgccagctggaatccagggattccaattcttaatttaggtctctttccattatgctctgcagatgtgaagaattgatgcttgggtggaacactcaggttcctcttattagcctgccttttatttt

SEQ ID NO: 126167 - DNA, 1109 bp, Homo sapiens
tgcatcttattgtagttttaacttacatttgtcctattacaagtaaaactacacatgcttttctgtgttgaagggccatttttgtatctctgtttatgaagtgtgttcatgtgcattttttctcatttttttgataggagttttagtctttttttccccaaacttttaagaattctatataaatgtggaatatcagctctttattgtgaatatatgttgtgaatattttacagagttgtcatttgtcttttgacctcacatatggtgttttttgctatacaaattgtacttatatttttatatagtaaaatcaaatgttacttttattacttgtaaattttgtgttgtaattagaaagtctttttctatatcaatgttagagagaaattgattcatgttttcttctagtatagttttatttttgacatttaaatctcttattcatttggagtttattcttacgtattctggaggaatatgtctaattttatgtttttccagctaactatacaattttcccaaaactatttgtaaagaaaacactatcttcatctaagtgatgtgcgatgccatctttatcatataccagatttgtatatgagaccagatctttttctgtacttttttattgctatctcagtaaatttataaattaaggaaaattgacatcttgatgatgttgagacatcctaaccaagaataagggatttctttccatttgttcaagtctatttttatgtctcttgggagtgtttcatggttttcttcttggttttcaatcatttcttattaaattcctaaaaattctctcttgttattataaatgagggtttctcattcagtgtctcttctaaatgtttatttgtatacaaatgccattggtttgggcatgtacattttacaacttgctactttgctgaattcttttattgtttgaattagttttattattggttctctaggaatttctgggcatatttttatgtcattagcggatataaatagtttcattttttcttgtcctattcttttgcctctgttttctgtaatctaattgcattagcttgtacttctgaatcattgttaaataccagcccatatgctgtgaa

SEQ ID NO: 126168 - DNA, 1058 bp, Homo sapiens
ttcacagcatatgggctgatattcttaatgtgtacgaaaaagccatgttgagatgggaattatttaaaaattttttttctccccattgaattttctctttagatatgtcagttgaagaaattttcttggttatttctaatttttgaatatatttgattaataacctattttattataactgttagagtaaacataataatttgaaagttgtctcttatcattttctttagcatgttacaccagacagctatattccatgccttgcagacctgtgcaaagcactatgggaagttatgctcagctattataggactatggaatggcatgaaaagcatgacaatgaggatactgcttcagcttctggtaggaaaatatttttattttattttaaaaattgaactataaatatcccacattactggagtaagaagaaaggaaaggggcaggaatgcctttgggatttcaaagattacagtgaccataggctaaatattgagcaaagaaagtgattcagctacttcaaatgttctattacctttagagagtaactgggccaaaggactttttaagtggcacatagtactagtttccagaagtgtgtgctgatggctttaggactgaatttataaatttttgttgttgttaatattattagttgcaaactagataagacattggtctgtctaagtttactgtgaaattaatgctagatggtcaatattaatctatttagccaattttcaagttacagtaataaagctaggttctaagaattaattatattgatactttccttcctgaaaatgaagcaagactagaatttcattttcaaaatgatgttttaaaatattcatctttgaatggaaaatataactttaaatgactgtggtacagtcagctaaataataaagaatacgtctttgaaaaattattgtatttattaatcattctatttaaattgcttcatttgtataattatatatcttaactgattatccttgaacagtagctgagattgaatattcagaatacttataaaaacagtaaatgattttatc

SEQ ID NO: 126169 - DNA, 1008 bp, Homo sapiens
ggaaatattgttggggagagtaaaggaagggagagaaaggcagagagaaggttgggcacacagccaggattccaggtcagactacttttacccaaaacttatacttttaccctgtactacccctgggaccatgagctctgcgatctgagaggcctggcttcaagttttcacttctatttaccaaaggtgagaacttgaagacactgcttatttttcccattcttcagtttgctcctaaaattggtcagttaaaaagcaaagcaaaaccaaaccaaacccttagagtagtaacgcatctaccctgcagggttgttgtaaagtttggacagcatgtaaggtacttatattggtggtggttaatatgatgaaatgaaatggatcaagagataatataataatagtgaaatacctggagactgttaagacatatttgcttttctagtacattatttaaggagaaaccaaagaaaacgtttggaatagaattaacacatattttagatatcagaatttaggtgacagttatgtatatattcatcatggtaaagcttgctttttgctttaggccaatagtttacattcgttggaatactgagtcaaagtgaaaactctatctgatccttattactcaaccctctttgcctaatctgtatattttatggatattcaagtgctcaagctgtcagctgatagtatctaggactataaaaagttacttgttcacctgaaattaatccttttatattcaggaataaaattgtagaaattagtaaattgaaaattacttttcatggaacttcataaaactgaagaggactctagactttatctgctgtatctctttagtgataatatttgatactgtttggtaacctaatactttaacgttctaaggtaaagctctaaagctatagttcaggtgcactgccttaggctgctggatccctaacagccataccatgggtgtaataataaggcttacgttttaggagtgctcagaggcaaact

SEQ ID NO: 126170 - DNA, 2533 bp, Homo sapiens
aaacacaaattggattaaatctaaaaatatatattgtcttttattttcagaagggagtaatatgataggtactgaagaaactaattttgatcgtggctacataaaaaagaaattagaacatggacttacacgaatatggcaggtttggtttttttaaaattatttttttcacagaagcaatagaaatgtcatgtcatagttttagaaattcagttttaagttttctatatatgtattctttgcagatttaatcatatgtttctgtttggaattaggctatcatttaatttctgtaatgtatttggactataagtggcaggaaaaaagttttttaatttgaaaatctccactggaaatattcatacatgtcttgagtacatcttttgttttagaggcctagcaaatttccactatcatagagaaatgtatgctttctcagtgagatgttctgtttattatttcatttatctgtgttttcttaatttttttttctgttaattttagaaaaggagtaactaagtagatagcatacttaggtcagattatagtttagaatgaataattctttttttctcagtcaatgatctttgtaccttgagggaatcttacatgcttattggctgaatatatctggttttagtccatttgggctcctataacaaaatattctagactgcatagtttataaacagagaagtttatttcttagaattctaaaggctggaagtcagagatcagggtgccagcattgttgggagggagggcctgcttcctggttcatagacattgtcttgctgtatcctcaaatagtggaagggatgaaggagctctctggggtcccttctataggggaactaatctaattaatgagggctctaccttcacgatttaatcatctcacaaaggccccaccttctaatatattatcaccttggaggttagaatttcagcttcggaattttgggtagacatgaacattcagaccatagcagtatcttattaagtttttctttacaatttagtaactcagttgttgtaatcagataatttgttacttcttagatcacagtgtaatttctttgaagataacttactctttttggacttctttgaaccttggaagactatagaccctttggccatgttatggtcttttaaaatgtatttttgatttttctaatgaggctgatctttattttgaccatctttttttttctttctttcttttgattgattgattgattgattgagacagggtctcactctgtcacccaggctggagtgtggtggcagagtcatggcccagtgcagcctcgacctcttgggctcaggtgatccttctgcctcagcctcctgagtagctgggaccacagatgtgcaccaccatgcctaattttcttaaattattattggtggatatggggtcttgctatgttgcccagactggtcttgaactcctgggcccaagtgatattcctgccttggcctcccaaagtgctgggattacaggcatcagccaccatgcccagcttgaccatcttttataggatatgttttgaaaaaaattgtttaggaaaatatattttgaaaacataaatttcttcatgaatcagttaatatttataatttagtgctcttctaatttttgataattttgtattcgatatgctatttgattttatgctttagtatttaaaatttatttttgtggttgtaagaggtttgacatatattttctcatttgtctatattaaactcataaccatattaaacatttattaaaattaaatatttaatttatcattaattgtggatttaggctgactgttttctgagtattatgcataaaaagaaaggaaaatcttatagttattgaatatacacccaggatcagatatgatttgtttctgacttagtctcccaataggccttaagtgtactttggtaaaattttacaatctatgatagaatttctggtaattcagtgtactttgaaatactgacttagcactttatgtagctactttccattcagtttggcaacctgatggcattcctggtataggaaatgggattgtctctattacatcccttaaggatgttggctattggcctaaatagatattcgttaacaaattaggaatatattcctgtctcattttaatctggaactatagagtaaatgcttctgataacttattttctatattttgggtttgcttgattttctttttctttgccttacaggatgttcagctaaaagtaaaaacctacttgcttggaactgatttgtctatattcaaatatgatgatttcatctttgttttggatataatcagcaggtagtatttaagatcttgtcttattctttagtttgagtcattcaaccatgataaatcatgagctagtgagttatcatctataacttctttatggaaatgaagataatttttgctgctaagtttgtgagtgtatttaaatatttctgccctttgggtgtttgtaaacctttatggatttgtgatctttagaa

SEQ ID NO: 126171 - DNA, 1131 bp, Homo sapiens
ggaaattcctcacagagttcacattaataaaattagaaaatacagaaatgaatgacttaaatcttcctcaaacactcaacattttaaataacttctcttagaaacatttgtgaaacttatttctcattgatgtggctgtgctatattattagaaggaaagctgggttgagtaatagtagacttgggttcttgtcgcattttttgctgcttaccaactgtctggtattggcaaatcctttaacctctctggcctgtgattttatgcattgtaaaatgaagtggccagattaaaaggtctccataagtgttgcctagacatcttgacccgtttttttgcagtattgtatattgtaaaaattggggcaggttaaacagcaaaaatttaattattacttagtattcttctttttccctagtatttaaacaaaagtttaaggtagtctagtttctatcctgtctgtagtcattttcgctctgacagttgccatcaggaaaattatagtggaagtcatttggtaaagttggtgcaaaccatcaatgtgttctaaggtatatttgtttctttacaaaacaagataaacttgaacagaaactttagaaatgatactagtgtccatacattgaattgactaaagtcattacattagccagtgatgaatctaaatctgcaaaatcccaatttaatatcccctttgccagtcattctacataaatactgaaaaactgtatgaaacatggtgaaatatagatcaagtatgttcttattttgctaatagaagtgtttaaatgtgcatacagtttggttcatggtcctctcctgccaaatatagctcttgagaatgaagaaattcttgaaccaaattattctgactttcaatctatttaagctattggtttgaatttatagggataataaaaaggtaaaaataggagcagttttgttttggtggaacatctacttatgaaatgtattaatgttagttgtggtagttgtatgaaagtttgcattccactctctttttctaggataaaactgtatgaacacatgagggaacacagcgtctattattgattgtttctacttctcaaaagtataagttttatttcccattttttaaaatattcaggtac

SEQ ID NO: 126172 - DNA, 1881 bp, Homo sapiens
taaattttttcttgatgttttagcatcaatatataatcagctaaggatattttaagtatgtgagttggagacaagcttttaatttagtcctctaataaaactgtcatttcctatgcattacttttgcaatatagtaaaaatacttagtttagtaaacatttgagagagtttttctctcaaggatgataagatattaactaataaaagtaaacatttctgtttactgtgttaatcagaatgggttctcaaagttgattatgatcatgacaataatcctataattatttgtattgtacattatttcctcaattcttgtgtgcggtgtacttttcttctcactttttggagtgttcattttctttttttaagaacacggctcgatgaactgagaatgttcttagagaatgagacttgggaactttgtcctgttaagtcaaatttcagcatcttgcaacttcatgtaagtgtttcttaagaacaaagaaatctgtcttttagtaatgtattttacccttttttttgaaaaaaaaaatccagaaatatatgaaaacatttataaaataaattaaggagcagtttcttatcttccttccttgaaagtcattagtagccagcctctttttaaaggaatgatccttttatggttgcgaaaaatcagtcttacaaaattcagtttacatactttaggaaatctcttttgcctaaaaagagttacagttaaaatgatattttttgtttgttttgaattcagaaaagggtgactgctgtatttaagttttgcagataatcaattagctatattttggcatagtttaatacaaatgcttatttatatttgtagaatatttttcatttcttaaagggactagtaggttcctaatttgtgctgcaattcttaaatttgcctgtaatgaaaaaatgcctcagaaataaaagaggcacttataaaaaatactcttaactaatttgtattagttaatcaattcctggaatacttacagaataagcagtctttgaaaaagtctttaattggtttgatttttcccttggttgaaacacattgtagataaatattcttgtgtgaaagattgtgttctggaaatatcaagtgtcaaaatgcagtgcatatagttagatccttgttcagaaagtatggtgtgtttagtttctgcctttggaaggagtggctttctagaaagcaattttcttattctggataaatgtaaagaatacataattacaagtttttttttgatagggattgtctttatgctcatattgtataatagcttcttatccagttttattatattgttttcctattatagaaatattaaaaaccctggaacatagcaattaataaatgctttaaagacagcaaaattaatgttaatgttaattagtattaacataagcattaacattaaattaacataggatttaagaattctcaaagatttaaggtaattccttaacatcatttagaattctaagtttaacataaattttagaatatctattaaataattttatttgaactcctttttaaccatcagactgtgtgtgtgtgctgtcacgttgtcaaacttagtataattgtaagacatgttttttaaaaaaggcatgttgaagcattcccatctaggtgaacattatctcctttaaagtagttaccttgaaaactattcacagcttagtgttcacctgacatgcattcatgtggatttgattttctaaaaattagtctcattgatgtatattcactccttatttagaattataaaaataatggcatgattcttaggcattataatatatatgattaaatgtatagttgaaatgcaaaaggaaaataaacacatatatcatttaatacaacaa

SEQ ID NO: 126173 - DNA, 2057 bp, Homo sapiens
gtcatttttgttcactatttgaaccttctatcaaggtgtcctattagtggttgagttttgttttatgataaactgacctcttcaaaactatgataattataagagaattttttcttaccttttgccagttaaatgggcctgattctggaatgttaaaatgacttgatttcatgactatcatacatttagtgactatagatatactttttgcttaatgatagatttcttaatgatagattcttaatgataagtatattcttatcgtttaaccctaagctacctatttaatactgtttaacttgaaatctcgactgaaataattctgttttcaaaagtgagcaattcacgtagttgtagctattttaattgaaaaaatttgttctattggtttttgcgtatgtatgatattaagtgtcagcatgatctactgtgaactgaatagaactattttgttggaattctttattagatgtgttttgggaatattttggccaaaaggaaaggtctatttgaattgaaatgtacaagtaagatagtgtctgccagtacatgtgtatatacctccatttttggtagggttactggagccccctaaactttttacccttaagaagtttgaattgaacaaattagtaactgaagccaataaattaatagatattatcagttctaacttgtgtctcttgaattgaccaatttttcttgtattttaccactaccattctagtttatgccaaagttatctctgtgccagattattaaatcaactcctttaccttggattcttgtctctaggcttgccccattccaaacaactcttagatctaaatttaggggttttttttttcatagttacaaatttaatcatgctgtttttctgcttagcttttagtgactcaccactgtgttcaagataaggttcatatccctcaggtttgattgctttcagagatatctggcctttacttgcctcctttcttgtcacttttccctctgttcacttcttctacatgcgaacgtggtgaactccttgtacttttctgagcgcactctgttctctcttatctctgaccctattttatgccggcccttttttctgtgctgaccatatagcttttacttttcttttgaaccttatgctgccccgtaaccccaaatactgccatcaatattctgtacttaattcacgttcttaggagggtattttttcataagtttctgaaatcaagaaacagtacatttgcacctagatgtattattatcctggaaaatcagttttttaaagagatgtagcttttttagtggttgataatgttttataatcgaagaaatgcattatggtactttatttttttgcttacttatttcccttatggattgtaaattttataagaagttaatttctatatctttacctaatgcatagtaagattttcattaaataattagttaataaaggctagggacctatctgactaacttattggtttattacttgacaactctagcaactctgttttgtttttccatatcaagtgtttctcgggaaactctaaaaagcaggaagaaatcagattacagtctaaataaagtgaatgcacctatcttaacaaatacaacattgaacgtcataagacttgttggtaagtagctacacctttaaaaaaaattataacagttaaattagtttgttaccgaatgacttttacttgtggtttttattgtcttgtatactccagtgctctatgcaatgagggatttaaggttatcatatgtcaatgcttctcattttaaatgttccaaatactataatactaatagtaatgccagtttttctttttcagttacctgtttattaagtctttgtatcttacaatttttctaaaatatttcagttaattgaaatgcgatgaaaaattctctaggtaggttagaggtatgtgtaagataagttagtaccagtttcacatttatacaatatttttgtacttagttgtttcataggtctttaccatcttctgtcaggcagagtgaatagtgactttctggcattttca

SEQ ID NO: 126174 - DNA, 1014 bp, Homo sapiens
ctatctatggagatggtatttacctattgcctagtttgattaaccttagctctgttgaaatagtctgtgttctttaagataattcttaaatttaattaatgaataggataaaatgtacagaatgctttttaggagtcacggtttctctagaaagagcaaaaaatattactgaattgagaagaacagaaaggtataccttttcatgatgctcagaaaaaaggatagattctaaaaagctattctgtggctaattattgccagggagctaagcttttcttcttcttccaagagaactgactgaacatagtgtcagaaataactctcgagaatttgtagaatcagaattgggagagtgctgagtggtcattggtgtaagttgccatgaagtcggttgtctttctgtaatgtctctcatacatggtagctgtctagcttctgtttcatgactcccagtcattggaaacacagtggtttgcaagactactcattctatcattagactgatctcattagtagaagtatcttccctaaggtaaaccaaaacctgtctctctgtgattctagcctttggtttgtccttttggtctaagagttatgcccttagaagcaagaagaataagttcgtgcatttttttcttctatttcttctattcttctatttcttctatcttctatttcttctattcttctatttcctctatcttccatttcttctaattcttctattcttccatgtgatcacttttcagatatgtggtggtagttatcgtgcttccttttctcataccgaccaccccacaatccatttttcaggctccatgggctcagttcctttatcttgtcctcactgatagaaattcagacctttcagaatcattgtcatcctccttagccttctagactcagcagttttcaatgtccgaacacattccttgagatgtagtcagcttttgctagattatgttgaagtaacaagcaactgttggtgcatcaagacgttcaaccacaaagttt

SEQ ID NO: 126175 - DNA, 1043 bp, Homo sapiens
ataagctctatattatgtgcttacctctgttattgaagctttttataaagccatgattattaattcttttaagaaatactgttgcaacaattgttatatgccaggcattgttaaagagctgggaattcatcagtgcacagaagagatatttcctgtcttggaacttgtatttttttggagcagagagacaaacaaatgtgtaacatagtgtcagatactcatgagtactaagatgaaactgaagcggtgataggatggggatcttgagcagagatgtgaataatgtgagtgaggcatgtactgatatctcaggtgagcgctgtttgggcagaagaaataaatggtatccttctctcttaacatttggagatccttttacccaacacatttttaaaaatatagtcatatcacttaccttggcacataacattgcttcagtaaatgttcatagagtaggtgaatataccccagtcgctgagtttcttgtttcttggcataacttggcttgtttttttggttttgatatttgtttaatccttgatcttcaatttcagagtcaaggctccttatttgatccaccctttttgtttctcttttttcttttcttttttgtttttagtctttgttttgtaaaatccattggtctcagccccacttgcagttttctgtgtttcgattttgattcttcttatttgatacttaagtataaccttgagcatcaaatcttattctccagatcttagtccacagctaaagtttttcttggttcttactgaaagtcccaagattgatgggccagattttaccactagggccattcaccctggcatttctgtgtcatccctgctagctactatcttgtgatcatcaaactccagttctagatttgacccttaagatgtggatttctgcctcagattttaccacatagtgtataatgaattattactcatactgataaacattggtttgttattttagaaaatatatttgtcatttactagaacttgcttgatctcaggattttttaagctggtatgtat

SEQ ID NO: 126176 - DNA, 8207 bp, Homo sapiens
atatttggagtgattggtaactcttgagctggcagtcttctggtactctgtcagctactccgagtagccagccttgtgcatctttacccatgatctcaagatattcccatcctcctggcaaaaaaaggtggccagtgtgcctgggagttgaaatgtgtttttgtttttttaactgtttgctaagagcttagtaaaaaatgagtcccttgctatgtattgagaagttgagtaagtgtatctttgaaactcttcctttgccaacctgtttgtttataacataggatatgtttatatgaagtccaagaatgtacataaactcatatccaaggcattcgttgcctggcatcagaatacctagaaaggtaaattagtaatgagaagatttctaatgagtatatcatcagatgaaagtaaaactgagaaatttgaagtccgatgagttttcccgaccacaaattagactgcatcactcctgttgactacatggctgtgtaactgaatcagtggttctctcctggatggtgctgaagagcctggcacaccctgcttcctgggtatccctttcctttgttcacattgaccatcttccttcttatcagcagtctgtccccagacatatacaatacagttggctctgttctagtttataacttcattctagtcctgccttcttgagattatataccagggtaaccttcattaaaatttgggtgtgagatggttaatcaaaaaataattttggattttatcagcatggttctcaaggggtaatcatatttctctcatttacaagttcttgagggccatctcactgttgtcactgtgaaacatctgtcaattcataaagagtccttgtgttgacagactttaggtcatgtacagatggtagcatgtagagttggatgatattatgtaggctcattctcatttaggattaaaaagaaggttccaatagttacaaacatgaaagcaggataaaaagaactgaacctaaatgtaattaacgtgtgccccaagagtattttaattttaattctaattttgtcaaaatcacgtggtttattactgttagatttgttattccaggttgtatatctattgtattttcaggaagtttcagctgatcctactgccacactcacagcagcagaagaaagaaaggagaaggtgccaagtccacacctcagtcacctagtggttttgacatctggggatacgctgtatgggttggcagaaagagtggtagccacggaatccttgtaagttgttcaaaacagttgcgttgccattaaatatttaagaaactttataaaagaagcattgtttaattagacttctagttagctgcatacatctaccacttctaaatatcacttatatgtttctgagaagtatattctaacacagattaccaattgattttttaaactgcatggttggtttttcagttatagaaatggaaagaaggaaatcttttaattttcagcctttaacaacatgatccatgctttaagtacaactttaaaaagcattatactatgcttcatattttcctattgatgacttatgatctcaggagaagctgtagttgcattgtcaatttagtgttaagtatagttgatccttgacatcaataagaatgcttcctggggagaagccaagatggccgaataggaacagctccagtctgcagctcccagcgtgaacgacacagaagacgggtgatttctgcatttccatctgaggtaccgggttcatctcactagggagtgccagacagtgggcgcaggtcagtgggtgcgcgcactgtgcatgagccgaagcagggcgaggcattgcctcactagggaagcacaaggggtcagggagttccctttcctagtcaaagaaagtggtgacagacggcacctgcaaatctgggtcactcccacccgaatactgtgcttttccgacgggcttaaaaaacggtgcatcaggagattatatcccgcacctggctcggagggtcccatgcccacgaagtctcgctgattgctagcacagcagtctgagatcaaactgcaaggcggcagtgacgctgggggaggggcacccgccattgcccaggcttgcttaggtaaacaaagcagcctggaagctcgaactaggtggagcccaccacagcccaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcaagtgggtccctgaccactgacccctgatccccgagcagccgaactgggaggcaccccccagcaggggcacactgacacctcacacgactgggtactccaacagacctgcagctgagggtcttgtctgttagaaggaaaactaacaaacagaaaggacatccacaccaaaaacccatctgtacatcaccatcatcaaagaccaaaagtagataaaaccacaaagatggggaaaaaaacagagcagaaaacctggaaactctaaaaagcacagcacctctcctcctccaaaggaacacagttcctcaccagcaacggaacaaagctggacggagaatgactttgacgagctgagagaagaaggcttcagatgatcaaattactccgagctacgggaggacattcaaaccaaaggcaaagaagtagaaaactttgaaaaaaatttagacgaatgtataagtagaataaccaatacagagaagtgcttaaaggagctgatggagctgaaaaccaaggctcgagaactacgtgaagaatgcagaagcctcaggagccgatgcgatcaactggaagaaagggtatcagcgatggaagatgaaatgaatgaaatgaagcgagaagggaagtttagagaaaagagaataaaaagaaatgaacaaagcctccaagaaatatgggactatgtgaaaagaccaaatctacgtctgattggtgtacctgaaagtgacggggagaatggaaccaagttggaagacactctgcaggatattatccaggagaacttccccaatctagcaaggcaggccaacgttcagattcaggaaatacagagaatgccacaaagatactcctcgagaagagcaacaccaagacacataattgtcagattcaccaaagttgaaatgaaggaaaaaatgttaagggcagccagagagaaaggtcgggttaccctcaaagggaagcccatcagactaacagcagatctctcggcagaaactctacaagccagaagagagtaggggccaatattcaacattcttaaaagaatttccaacccagaatttcatatccagccaaactaagcttcataagtgaaggagaaataaaatactttacagacaagcaaatgctgagagattttgtcaccaccaggcctgccctaaaagagctcctgaaggaagcgctaaacctggaaaggaacaaccggtaccagccgctgcaaaatcatgccaaaatgtaaagaccatccagactaggaagaaactgcatcaactaacgagcaaaataaccagctaacatcataatgacaggatcaaattcacacataaccatattaactttaaatgtaaatggactaaatgctccaattaaaagacacagactggcaaattggataaagagtcaagacccatcagtgtgctgtattcaggaaacccatctcacgggcagagacacacataggctcaaaataaaaggatggaggaagatctaccaagcaaatcgaaaacaaaaaaaggcaggggttgcaatcctagtctctgataaaacagactttaaaccaacaaagatcaaaagagacaaagaaggccattacttaatgataaagggatcaattcaacaagaaaagctaactatcctaaatatatatgcaccccaatacaggagcacccagatgcataaagcaagtcctgagtgacctacaaagagacttagactcccacacattaataatgggagactttaacaccccactgtcaacattagacagatcaacgagacagaaagttaacaaggatacccaggaattgaactcagctctgcatcaagcagacctaatagacatctacagaactctccaccacaaatcaacagaacatacattttttgcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacctgctcctgaataactactgggtacataacgaaatgaaggcagaaataaagatgttctttgaaaccaacaagaacaaagacacaacataccagaatctctgggacacattcaaagcagtgtgtagagggaaatttatagcactaaatgcccacaagagaaagcaggaaagatccaaaattgacaccctaacatcacaattaaaacaactagaaaagcaagagcaaacacattcaaaagctagcagaaggcaagaaataactaaaatcagaggagaactgaaggaaatagagacacaaaaaacccttcacaaaattaacgaatccaggagctggttttttgaaaggatcaacaaaattgatagactgctagcaagactaataaagaaaaaaagagagaagaatcaaatagatgcaataataaatgataaaggggatatcaccaccgatcccacagaaatacaaactaccttcagagaatactacaaacacctctacgcaaataaactagaaaatctagaagaaatggataaattcctcgacacatacactctcccaagactaaaccaggaagaagttgagtctctgaatagaccaataacaggagctgaaattgtggcaataatcaatagcttaccaacgaaaaagagtccaggaccagatggattcacagccaaattctaccagaggtacaaggaggaactggtaccattccttctgaaactattccaatcaatagaaaaagagggaatcctccctaactcattttgaggccagcatcatcctgataccaaagccgggcagagacacaaccaaaaaagagaattttagaccaatatccttgatgaacattgatgcaaaaatccttaataaaatactggcaaaccgaatccagcagcacatcaaaaagcttatccaccatgatcaagtgggcttcatccctgggatgcaaggctggttcaatatacacaaatcaataaatgtaatccagcatataaacagaagcaaagacgaaaaccacatgattatctcaatagatgcagaaaaggcctttgacaaaattcaacaacccttcatgcaaaaaactctcaataaattaggtattgatgggatgtatcgcaaaataataagagctatctatgacaaacccacagccaatatcatactgaatgggcaaaaactggaagcattccctttgaaaactggcacaagacagggatgccctctcttaccaatcctattcaacacagtgttggaagttctggccagggcaattagtcaggagaaggaaataaagggtattcaattaggaaaagaggaagtcaaattgtccctgtttgcagacgacatgattgtatatctacaaaaccccattgtctcagcccaaaatctccttaagctgataagcaacttcagcaaaatctcaggatataaaatcaatgtacaaaaatcacaagcattcttatacaccaacaacagacagagagccaaatcatgagtgaactcccattcacaattgcttcaaagagaataaaatacctaggaatccaacttacaagggatgtgaaggacctcttcaaggagaactacagaccactgctcaaagaaataaaagaggatacaaacaaatggaagaacattccatgctcatgggtaggaagaatcaatataatgaaaatggccatactgcccaaggtaatttacagattcaatgccatccccatcaagctaccaatgactttcttcacagaattggaaaaagctactttaaagttcatatggaaccaaaaaagagcctgcatcgccaagtccatcctgagccaaaagaacaaagctggaggcatcacactacctgacttcaaactatactacaaggctacagtaaccaaaacagcatggtactggtaccaaaacagagatatagatcaatggaacagaacagagcccacagaaataacaccacatatctacaactatctgatctttgacaaacctgagaaaaacaagcaatggggaaaggattccctatttaataaatggtgcttggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgagcaggcaacctacaaaatgggagaaaattttcgcaacctactcatctgacaaagggctaatatccagaatctacaatgaactcaaacaagtttgcaagaaaaaaacaaacaaccccatcaaaaagtgggcaaaggatataaatagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaacccttgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatggcaaagacttggaaccaacccaaatgtccaacaatgatagactcgattaagaaaatgtggcacatatacagcatggaatactatgcagccataaaaaatgatgagttcatgtcctttgtagggacatggatgaaattggaaatcatcattcgcagtaaactatcgcaagaacaaaaaaccaaacactgcatattctcactcataggtgggaattgaacaatgagaacacacggacacaggaagggaaacatcacactctggggactgttgtggggtggggggaggggggagggatagcactgggagatatacctaatgctagatgacgagttaatgggtgcagcgcaccagcatggcacatgtatacctatgtaagtaacctgcacattgtgcacatgtaccctaaaaaagtattataataataataattaaaaaaaagaaaaaaaaaagaatgcttcctgacctttataaatccctaaagttagtaatacaattaacgcatataacttctttggcatttctataaaatgtagtccaatataacataagagtttttgcattagtaagaaaaagcagaaaaagacagtgcctggatgcagtgcaactgcaggcagtagtccaggctccttcaccagcccactgactcccattcctgtacccagcctctggcacctgtcattcatctgtgatactcagccaagttacagtctgctgcctattaggaatgttggggttacttctgaaaagtgtcagatattgaatctgagatttcaagagtctgttgtgtataactgaatgagatctttaaaagaaatcctttaaaaaaatacccttgtgttcttttttcaacctgctactctgggctcacatcttacatttgaagcacatgactacacctcatcataagctgcttggctcctttgaagttgttcttctttcacctcaacttccattcagtcataaactca

SEQ ID NO: 126177 - DNA, 1891 bp, Homo sapiens
aggaatttacatgccagggcagagatagcagtaaacaggtaaattgagatataatatcagatgatgaataatgctgtgaaaaaaaaagcaaaatcatctgaagagagatagagaatgacaggatgtgagtggaagaggaagaccatgtattgtcatgctcagagaaggaccctgataaggtgagactggagatgaggcctgagggaagtaaggaaataaagtgtggaaagagcatctgagaaaatgaaagtaactttcaggaaaaatgtgttttcatttttgtaaatgaaaagaaaattgtcccttcttaacctccttactttaatctcatttacacaatcattcttacctgcttagaccaagtcaacaaataagagcctaggacagctgagaaccaatgaacagagccatagatttaaaatagagatggtaatggagttccttcagtcacccaactcccagcaatttatggtcccctttggaggcctaggttgaagactgtgaggctgtctccagactccgggactaattgtgccaacatcagtaaccaattgctaggagtttccatagagatcttagcggggaatgacaccaagggtgctctatatttgccactctggaattcagagaccattgaccttgaaagagaatcaaagaaataacttggtttctagagcacccaggagatttcaattgcaaattttcatttggaatgtaaaagatgaatgtaatttataaataatgataccccttcttttttttttaacaattctgtttttgaaaaaatggttctattttttatgacatgctgtcttagtcctttaggatactacaacaaagttccacagactaggtggcttataagcagagcagttatttctcaccgttctggaggctgagaagttcaagatcaagatcaaggctcaggcagatttggtgtctagtgaaggtttgatttctcatagatgtcaccttgctgtaccctaacatggtaaaaaaggcaaggcagctctctggggctcttttataagggtgttaattcccttggtgagagcttggccctcatgacctaatcacttttaaaaagccccacctcccaataccatcaccctgggattaggatttcaacatatgaatttagggaggatacaacattcagaccatagaacatactaaccatgatccttatagggtgcaagaaaaaaagatttctgtgctcaacagatacacatgctgtgaggaggctgcttgtttcagttatttgttattccagttataagaaagaactcgtgttactcagagtattaacctgagcccaatttttagcagcttaaggccttctttaagcataaaggttaattatctgtgataacttttgttctttctgttacttttctaagtctaagcatctaaatctaaacaatctgcttatattgccccaaaagaatcataagaaaaatgaaatgtttgtatgattcattttataacaagcatttttgagcatttaatttagcaataagtagaatgttattttgtacacaaagcattttatacatatagctttatcttttaaataaaatattgatgaaaaatattgaattatgactcttgaaatccaaagcagtttaaggaatgcataaataaatacagtaacaaatactactactctcctagatccatgaaatgaaacaacagacaaagagcaattatttgtatagttttgattttcaaaggtaaattttgtgaattgacaatccacttctttttaataattaaaagcaacgaattgttaaaaataaattagcaagaaaaattgtgatttaggaagtagcaaaagagcagaggataacacagttgtcattagcctgagtggtgatcagattagattttt

SEQ ID NO: 126178 - DNA, 3506 bp, Homo sapiens
ctcttggcagccagattaactggaataccagtttaactttcttacagacaattatgttgattgaatacagagatccgtggtctgtagaacaacaaagagacttgaactcattggatctctttgcaaatgagaaaactgaggcccgcataggtaaaatgacagagcacaaacacaacccagtctttctgactcaaggcttatgttctctatttcctataaccctctcatttctggggaatctgtccaaatataggttagagaaaacttcaaatacctgacagttttttgtttctaattatcctataatgtatttttttttattgttttgcatcttagatatgccaatgtcaagaaatgcagtaatgagggtcgtgccctgatgcaattggattttcaacagtttttaatgaaacttgaaaaactaacagatattagacccattcctgataaagaatttgtagaaacttatattaaagcttattacctaactgagaatgacatggaacggtggatcaaagagcacagggtgagagctggaaaatagttaattaagtttttattcctttttctttgtgctgttcttgttgggtgtgttatttaattcaaaatcatgagagtgaaatataaagaaacatttgcttttttaatacaaactacttaggtcaattctttgccttattcagattaagggcaccgtatctaagcagtgccctttgactcatcaaatctttttcagccctttgtgaactgttactgtaatgatctagaaatacagccaaagccaagacattagctatatttttcctgcaactgtgttataggaaaaggctgaagttgataaatactgagacagattgaatacagaaacaatgaaatgattcataagccataatcgattatgtaacttaaaccttctcatacaaaccttctcgtactcctcaacgatgaaatggtaacatcctacacactgacacgtattagtgatgagtgaagacattaatatttaaatggctaaacttaacttacatcttacattagattttacctttaatatagatttgattatttttcttttgtatgactatatagataacgaaaaatactattgttacgtaggatgccgaatttttgacacagttcaactcagtgagcttggtatgggaagcttttctgtatatggcatgtgttaaaattatcaccaaatcctcattgctttgataactctaggatttacattttcttaacctatgaatgtcatgggtaaaagctaagtcaagttttatttcatttgggtaagaaaataattatttgtatatacctgctcagactcatcctttctggccttaacactgtaaagagataaaatgcattagcctagaacattcacattggcgtgaatcttgtgtgaatgtccccactcttactcagtttcggatctttagaagcaaagtaggaatgtatgtgttatttttaatgagttcgaccagtaaagccagattgagaaaaacttcaccacgtttagccccactgacatttgataaccaaaatgttaaacctagatgcagatagactgcttaatgttgctagaatccatttagtaaagtaagctgtaaacacttctgggttggtactgaggaaagggttttgggaaagaatacaaagtagccaaggaggaaaggcacagctctattcgatgcaagaatgatgcccgttttttgaatttcctcttttaatatagtagactgatttttttttaacttagtactttgaaagagctttaactgattgatatttgtaattcagtgacatttccccagcagcagcagggactcttttctgtctttgaaggaaacttcccacaatgatgagtccagcgatcactgacgatggatcctcactgaatgctgagtggttaaatgagattacttaccaggcggggacaggtgctctcagagatcagatacacaagctgagcagtttgccaagtttttaaaatcaattctttctcctattttgaaattgtactatatttagtggttaccttcaataaagacacattttcttttcttattagataatagtacacagctgtctttccctatctgaactcttgctattcaacctccagtaccaagtcaatctgcagaaatttctgatgaatccctgtttattctcatcctagcaattcagtatctaaaattcaggaaccagatggatttggattgcgaaagatactcgtagtcttaattttatttgcagctccctgactttgtgatccttgttaccttattcatttgttgtatcttagaagagttgttcttctgttgttggagattttttttttaactaaagtgtttacaaaatgtagagggccagaaaaatacttcatcagtagcatttaaaaaatttgaaatgtcagtgtattttgatgactcaataacaaagactattacagaaacaagtgtaaagtgtgtgatcatcaaagcagtaagaagcatacgcatgtcagattgctttgccatattaaaacagattctagtgcttactgtttcaaatgtgtactatagtattcttattctctcctattacagctcagtaaacaatttgccttccatgtcccaactgtaatttccactgtttttcactggtttataatgctcagtaactatccactgcacctgaatatccgcctgttcttttgttgcactgatcagatacattccttttagggtactaaatttggatctttcttctttgagcaggaatattcaacgaagcagctgaccaatctggtgaatgtttgcctgggatcccatatcaataagaaagcaagacaaaaacttctagcagctatagatgatatagacagacctaaaagataatgaacacagctctctttcctcaatggcattgatcctcactcaacatatatgacctgaaagccagtttttttatgcacttctgacaactatctgctaagaaaactttgtgcatgtttttttgactggaaagtggaaaatattgaaatgtgtgtggtgttctcatgacttttatatgctgtggtctcttcaacttttggtctcatttgttgtaatctgaaatgatgttgccgccttgtcataacaatggttatgtgactacagttatacattttacagaagaatgtaccataagtatataattagaagaacagtggcttaatatatgtatgggaagtttatggaaaatgaagttggcacttttctaccctctgagcttggttcttaataagcataatgtgagggtgaatatgtagtatctcctaattatgagcactgcatgagaattaaaaaacacatgtaagtaaaatagttgaaaaatcagtatgttctctgtttttaaaatgtcaaagtttatgtcagggttaatttagttataacaaagtgatcataatggtgaaatttaataaatatactctagtatgatcagcctatgtgagactacattttgattttttgtgtggcatg

SEQ ID NO: 126179 - DNA, 1100 bp, Homo sapiens
aatggtagtataacttaaacaaggatggtggcagaaggcctcccttgagaggaagggaagaggcttgccatgcagatgtctgagtgagtgtagcaggctgagagaatgtcaagtgcaaaggccccagggtggaggctgctgtcagagaacagcaaggagggcagtgtggatggcatagtaagcagaagaaagtaaaagcagagaggatgtggcaggaggggacacatacggggaaggactttggatttcaccttcagatggaagcatttgaggggctgtgaaccaagtgatgacctgatttgtgacttagggtttaccaaaaccactctgtgtatttgagaaagagctagagagggacaaaaagcaaagcaaggaaacaagctaggaaactaatttggtaaaccatgcgaggctaggattgcagtagcattgcgggatatggtgaggggtggtcagacgctggacatatgttgaaggtagaaacaaaatgattggtatttgaggaaagagtgtgcttaaagactttctggaggaagtagaagtctttgggaagactgggtttgtgaacaagatcaagaaaacagttttggacagggaagtttgagatacttggagataaattattggatgtgtaggagagggtagcggcatgcaagtctggagttcagagaagaggtcagagctatagatgtcaatgtgggagtcatcagaatataacgtaaagccaagatttctttaggaggcagaaaacttacaggcataggaaagtaaaaaaatttaaaaaggcactactcccccatccccttgccattgtttccatgaaaggtgagacaggaccaggatactgtgctggagggacagttttctagagcaaatataagaacatcttgccacctagggacctaccaggacctttggacattgtaactcctttaactgggaagccatcactcttgtcggaagatacactctggtgcagcttgtcatctgggggactgagtgagttccagggtcatgttgtctcagagtgtcttcctccatcaggcactggctaagcattaagaatgctctagtggacaggacagatgacgtgtgccctc

SEQ ID NO: 126180 - DNA, 1101 bp, Homo sapiens
gaatattatgaatagcaaagataaatcatttttatttacaagctgcgctgagttaacccagctccataaggttataaagtaaaatgatattttataaaatctccaagaaaagttctaaaagtttaaactttaaaacaaattcactttattttatcctttgtgatctcattgcaggctatatgtcccatcatttcagagcagtagtttattacatgcattatgtatccatttccctggcttgaatatactcacataaacaaggcccaaatcttttacttctttttttttttgtccaaaatgtgtttattgagatggtttcccactcatcttgactcagagtgcttttagtgctgctttctcctgaaggaacatccttctgtaagccttgcttttcctcctataggctggcagaggacagtggagcagccaacacacaaaactaccgtttgtgcatggctaaagaccgtggtgattttatagcatcttgggcatttcacatccatgaagtaggaattggggctctgcaccaggcgtttcttcttgtgtttcctcttctcttctggagagggatgaaggagatcctttgtgagaggcatgttctcgtatgggtaggtcgtcactgccagaaaggatcttttacttctttacagtacaaagcataaaggtcagcacttattgttcactcagcataagtaaatgagtgaatagcttgtgcacaatggttagaatagttagagtagttttcctgtattactgtgagtttagcaaaaaccaaaaaccaaacaaaaaaccaacaacaaacaaaatatctgtaggcctacctttaatagacgtgtttaaagaaaacaaaacagattttcctctacatggtaatacttaaaactttagcttatagactaaataggccaaagatttcaacataagatggttaatgataactttgccagatatttgaattttatattctgaaaataatgccaatatgttaagaaacatatcttagctttctttgctagtttctgcttctaccaccaaataaattaagtttcatattttagtagtaaaagttttaggaaacttatgcttttgttttagttcttc

SEQ ID NO: 126181 - DNA, 1058 bp, Homo sapiens
agcaatggcacaacaaaaagtggggaaaaaaatctgtgtgataatgcacaaagtacttacatttattgttaattttttttatccacataattggaataacacctaaatagttttgagttgttgaattactctgtggagctgaaagaagtgtttattggacaatgaaagagctttttattcgctgagagtattactgtattttgcatggagaaatcaggctgattatccaaggttatcaacaggctcctgaattgattaaacacaaaactgtcattacaaatgtactatggtaacagttattcaattacttggatatgcatatgtagactcttagaatctaactgtgatattttatttgcctttatctctgataggattcacaatttgattccacaactggatttctaggtaaaactatgggcaaactgaagattttatccagagggagccaaacaaagctgctgtgctatatgatgctgttttctttatttgtcttttttatcatttattggattattaaactgaggtgatgcatgtaattgtgaatttggaatttgttccaacttaatggcttgcagtaccactttgataaaaatcagcatcaaaacattcctagtgttcaaatactgtggcattttccattgaaaattgctgaattttgcttattttataaatcacattagttaatacagtggtctttgaatactgtttcttaatgactcattttagcccctattttcaggggtagtgagagggtgtggctccactaatttccagtttgtttttctattgtttgccaactgtcagattaaatagcattataatattttgttgtaatcataaatgcaggtttatgtcccatgtaaggaaacttagtgggagagtaacagaatgcctggagagcctgactctgagctcttgaagtagtcagccagtttgtggtaaaatggtaattgaattttcctaactgcatcaactgtaatgatatactcccttctcctcctttatttagttaaaattgtaggctgatttctttttacctacaatcttcctaataa

SEQ ID NO: 126182 - DNA, 1035 bp, Homo sapiens
aaagttcacgcctgtaatcccagcactttggggggccgaggcggatggatcatgaggtcaggagatcgagaccatcctggctaacagggtgaaaccctgtctctgctaaaaaatacaaaaaaaaaaaaaattagccaggtgtgatggcgggcacctgtagtcccagctgctcgggaggctgaggcaggagaatggcctgaacctgggaggcggagcttgcagtgagccgagatcgcgccactgcactccagcttgggcgacagagcgagactccacctcaaaaaaaaaaaaaaagtatagttaactaacaccctgaactatgccgtttcctgttaatcgcccaacatatttatatatgtattcactaaggcccactccatctgttgtttgatagcctgatgactatgaagtactatattaggcagggaggtgtacattcttatcccttagagttccataaaagtagcacctagaaagaacagtggatctgatacatggtaattcttcaaatatatgttgaagaataaatgaatctccctcttgactctcagctagcattctgcataagttattgtgtctctttcctagagcttcagtttgccccctccctgctttggctctttcctgtccaactgtctatttaagagaaagagatgccagtaaagaaccctcgccgctatgagctcccgtccttctgtattaaccacttttcccttcctcttcacagccacgctttttcaatgggtagatgatgttactgcttttagaactttcattaaaatatatgtttctcttgagcagggaatgtatcctgaatattcttgtgtattagtacctatttttgtatcttctggacaatcaataagcaatccagaaatgtgtatcaaaatgaactgaactgaatattctttggttaacagagagtaatggaaagaattggtctgatctctgtttggttatttattttttaaattcatttggagtatgaatattagagacatatgtggtttgcaaggccctccaggggtctttttc

SEQ ID NO: 126183 - DNA, 1069 bp, Homo sapiens
tggtgtgaaggtaaatattaaattagaagcactgtttttaagcacttgattgaaattccccatgacctccaaaaaagtatattatactgaagactacccatattacaaaaagtatttttattttttttctttcctgtacttcaaatccctcaaggatggggactatgagagtctgtgaaaaaaggtcaattattaatatttattaaaattcaatatctattaaacaattgagataaaaataatattaatagtttcttgttccatttcctttcctccctctataattccagtgtatctctgcagccaaaataaaagtaaataaacatataatcagagattacgacactctgtattattttaaactgtaaattctcctttgccacacactaattagataggtacattcatgtcgctatacacttttcaacctctttcctgtgatttatctgtgcacactcaaaaaaattttaattaggtaattaaagtctcagaagtgtgttatctcttggctaggctcttctctgacagcgttttcaactataaaatgttctctttcctattaaggagataatgtgatattaaagtgaataccaacgtaattacaaattaatgagtaacgaatactagcgggaccagaaatgaacatgaatatggagaatctattctaactttccagctgccacacaaatggataaggtcaaactcattctcccaagagcccgatataacagctcagactactaatcactgtatcataaaatgttagagctgcaaggagctttggagaccccctcattttgcagaggtgggaaactgaggcttcgtgagagcaattgacttgcccaaagtcacacatctagaggttagaaagtcataggctagaaatgatccccccttgccacttcaatgcttattcccaaagaatagacttcacatagaatcctggaaattaagggtccttatgaggtctcttaaaccatatttcccctatatctaaatcagattatctttaaaaaaagttcttttacatgtgccatagtattaaatcccactactactactactacta

SEQ ID NO: 126184 - DNA, 3589 bp, Homo sapiens
gacctgctggcattcgaggccctcagggtcaccaaggccctgctgtaagtatgatttggggaaataataaagaagatcacggacctaaggaatgttttcttcagactaaaccaagacaactttgacaacccattaaagttagccccatttcaatatatcctctaaaatatctggaaattgtctatatgcaatgggcttgttaagtccatccctgcaagtgtgcctgggggctcgttatttatttatgtgaacttgattattttttactgatgagaacatgcttccgtgtgaagctcaactgaaaatctgctgccatggatgtctctcactgtaacaaaatataaagcctctcctatctcactttcacctttgcagggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggtaggtcaagatgtccagaccagactgacccttctcacaagttgagcttttcaaaattagtttccattgacatttagagtgaaaatgcatttgggtaaagattacattatgtgaaatcacacccaattaatggagcgtcatcttctcccaaccagcacccaacctcatttcccttaaaatgtatttttgcacttttcatagtaataagtaccctgatttgatttttcatggaggaggggagggaaggaactgtctaatcttaaaaatagccaccctcttcctcttaaatatggggtagacaatcaaaaatgttacttatgagagtcagtatctttcattagttattattagaatctgtgttctgctcaatgagaagtttcatgatctgaatgttattttcttaaaaggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccaggtgaggaatcccacaaacacctctccttctgctaaataatattttggtaggactgtttgttaattatctgcattttaatctctgacaaaaatgggcttattaaaaaaagacctgttcctttcctgggttccaattttgtcctaaattgcacattagaagatggattgattggacacatccatgtaattcaaagttattattcaaatttgacttaattggtaatcattgaaaaaactgactaatgtcatttagtgtgaaggagcactggccagctatatgccacactcatacatatgcattttcagaatgtgagcagcttttctgaatttttaatcaaaccttttcaccaactttactgaatgcctactggaattccataaattacaaaatgacagaaaaagaaaaatgtcagaatttctacctcctcattctcttattctaaagaagaagcatatgcaaaaaggattaattgaaacagataacttttttagatgaccttgcctcagtctagtaggtcttatgttcatctaggtaactgatacttcaaagacaagtgaattaagttttctttaaaagtacccttttcctaagcttggatctgagtctactcttcctgagatctttttttttcttttttttttttttcatgtttgactcttagtatctgagtccttctccacttaactggaatttcatcctattttctgtagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctgtaagtaatagtgaaatatgggaatagctttgggaagtgggatggagggggttctaacttagactgcccccaagggggggtctaaaggggggttaaaagaacagaagaatgagagaactaacttatttcataagtaaattcagtttttgtatgtattttatatttatttatttatacgtattaatttcgtacttaaattcagatgataaattcagagtattcttatcagatagtgccttctgaaatgctgaaatgtatactatgtccatgcattgttttttctttagcatgttttttaaatggtaatgtgtgcccagaacttaaaatttcttgagacttcagtggcctaaactataatttatagttatgtgtattttattttacttattagtatggcctacatttaacttttaatgctttttctacaatatgctataaatataagaaaaattaaaattcactaacagcaagactacatacccacccaggtcccgctcccaaagacacacatagagggacatacacacaacaatcctaaaaatgactttgtagagataggtcacttggaatgtgtgttgaaatgttgttggtttttttggtttgtttgtttgtttgttttttgttagactgatagggagcccctcccactaaagacacccttgatactgttatttcaaggatgaacttatttatctgggacagacatcttcagaatgacacatgccaaacagtggttcttattaaatcaaaggttcagatattatcagattcagaaatagtgatgctttgtgtatctattttcttctctttaaacagaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactga

SEQ ID NO: 126185 - DNA, 1042 bp, Homo sapiens
aactagaaggggatgtagaagtatctattatacacagtttagcaaattaacaaaactaatgaaatcacctcctagagtcacccacatccatttttcactcctttaaatcagagtaaacccaatcattagtaaggtaaacacagtcattaacatgaacaacagatatatccactataagaaaaaaagtgtatatattcaaaatatgtagggtgaccaaattttagtattctatttcccttaaaaattatctaggtgtccaagttatctattaaataacttgatctaagaatagactcaggttttaaagttaaataaggatcttagttatgttgacaaactacaacttaccgtattctaatttaagaatttagaccatttgtattcacatagcttaatgtggggacttagaacagagactcccccacgttaatttgacttacttattgtttaagaaattcttgcccagaaatataaagctataaaccaatatataactttactacttgcttcaggaaattcctgaaaagcaacttgtctatatagtttgttcatctggccaagcagttcttctatcgggataatagattgcttatctggccaaatgggcagcttattaaaaaaattacttacgggccgggcatggtggctaatgcctgcaatcccagcactttgggaggctgaggtgggcggatcacttgaggtcaggagttcgataccagcctggccaacgtggcaaaagcctgcctctactacaaatacaaaaataaggctgggcatgttggctcacacctgatccagcactttaggaggccgaggtgggtggatcatctgaggtcaggagtttgagaccagcctggccaacatggtgaaaccctgtctctactaaaaacaaaaaacaacaaaacaaagcaaacaaacaaaaaaactcgccaggcgtggtggcaggtgcctgtaatcccagctgctcaggaggctgaggcaggagaattgcttgaactcaggaggcagaggttgcagtgagctaaaatctcaccattgcact

SEQ ID NO: 126186 - DNA, 1047 bp, Homo sapiens
aggacaatggctggtggttctgggcgccccgagccgcccgcgctggggtcgggggcgccaaccctggacctggccaaaagtgctgctgaggtccggctcctgagcggtctgggttcggggagacgctccagatcaggggctcgcgtgcaggaagtcggacaggcggtccttgggggcagcccggggcgcatgaagcccaaggccgccctgcaaggggcaccgctgccagcagtggggtcgcaggtcctgcctcttaagggtccggctccttagcctttgtttaattttgcctctgccctgtaacacccagtctgggctgttggacagcggcaagggccgcccccattttcctttgccaaaagggcgacagctggcaaaagatgcctgtggccaaatggaagaggtgccacccagcttttgtgatgcagaaacgtttaaaggcttcggagtgcacactttttacaaagttaaggcaccagagcagatttttggaaggaagttgtgggttgacaggcgtaaaggtgggcagttgaaagcaagttgtaagcactttgaaagcaggccttggccatgggttttgaaattggtgtaaaggggaaaaggaaatatgacctgatttgagaatgaattatctttcagtaatcaagggatatttacttctccttgctgattgattgttttttttcctttgtaaaaatgtcactgggagagaggctgacaggcagagggaaattaataatgataggatcttttatttttggctcttaatactatcaaagccattatctggccagctcttggtgactgtgagattaatcagtcaagatgtaatgtgtaatggacaggtgcaaattagcgctgtgcccgtttaaatttacacctactttggcaaaatatccataaacgggttgttggagtctgcgctgtattctcatcccaggagatctttcaattttggtcagttttgctgctttatttcttccaactcttgagaattaaaaatattgtactctagagccatactgggtgaacagcttttagtatact

SEQ ID NO: 126187 - DNA, 1024 bp, Homo sapiens
tttaactatattttttccaaatgttatcaatttctaacattatgaatctcaaaatgtccattattagtttgattataggtgtcatttctgtgacaaatggccaatatctgtagccttaaggatagttccaatctggataaattttaattttttaaattgataaagttaacttcaaatgccttaattttgttgaaatcaaattcttttttttttcactaagcatattaaatgccagtgctaaatgatattggatgttctggagaaaaataagttgaaagcttcagaaattagagcaagaaagcagcagctctgggtctcttagccttttctttctttgactgttagaaagatcctgatctttatgatacctcttgtaatgagacactccttgcttgtctaacgataaatcttaatggtgattttcagcacaggctaaagtataacttgctgtatcttaggcaaacaaaatattctatggactatactgtaaacttcatgatctcgtattttaatggttggtagtaggaaacagttttagcaggataattcggtctaaatttaggtgcagtgtgccagagatattctcttcaaaggaaaacataagttggggtttatatgggccatcagatgtttcctttagttgttacattttatttttcagtttgtttttgtttgtttgcttttaagtatttttctatcacagaaaaatcatgcataaaattctgagattgtagattgacaaaccagaatgcttatacttaagataagagaataaagaggaagacagccattcatccagataatcttggtgttggagatagctgaagtagatagtcctgtctcttagtttctttgtgtgtgtgtgtgtttcttgcttgatttatctgaacgcctggcaacatttatctcacattagttgtgttaaaatagctatcaaaattatactagacaattgaaaataacaaccgaagttttgttttgttttgttaggtttgtttgttttgttaggtttatatttagtgat

SEQ ID NO: 126188 - DNA, 1453 bp, Homo sapiens
ttgttcttttcacgtgcttcgttttacagggagttgacaagagatgaggaagcaggtactacattatgaatgatatcctcagccatactgggggagtggatttattttatctattttttaactacttctaaatacttcagggtgtattttctgaaaataagtacgttgaattgaattgagggtagtggagaaccattgaaagttttaagcagaatgatgtgatacagtggaggagtggaaggaaattaggctaacttgtaaagaaactggcagtttagatgtaattctgtaagtgaatggaagtcattaagtctgagctattgaatggatttgggtagtcttggtatggattgaggtaatatttgaagttatttgaatggaagaaattgaataggcagagaatttagagattaaagaggagagagggcttatgaggaatggaattaccaaggagattctgagaagtggcagtaaaaggagtaggaagaaaaccaagggaggaaggactgtaaaatcacatacaggggaggtaaggattttaaaagatgggtagtcaccagtgtccctttcaaaacttgctaaggtggaatgaagctacagcatttggcaatccagagttcactaatgggctctcaggacagttttaatggatagtgaagcccaaattcaaaacttaagttgaggcataaatgagagataaagaaattggcatagtgagggcagaatactctttcaagtaatctgttggttacaggtgtaagacagggttcaaggaaaactttttgaggataaggatgatttaacacttttaggttgagggaaggaaagagagtggaggaggaggacaagattgatactatgagagttggaggacataattcatggatcatagctccagaagtgaaaagggaggaaatgtagacagaggaaggcattagccattgagaagaatagggacatattttctttactctcttgtcagaggaagatagctgggggagtatagacaagttgtaagaatgaaggaaggaaggcaagagcagacttgtcggatgaattttattttctctatgaagtttgagaattaaactttatgctgagaaggagggcaggagagactgtatatggaatgtaaggtttgggataaccaatgtaagttttgggaatgagaaagccacctagggatgaggaaaaaatatttaaaattttgtatccactgaaaattcttcaacagtgtaaaatgaagcatgctcaactggaaatggtcatatatctaaaagaaaatggatttattttgttatttttctctatatttgtagtattttacagtaagcatgtattacctttatagtgaaaaagtgtcatttttttacattggtcaattttttgttattaaatttcatgcttgtttttaattgtttcttgtgtgtatgattgcaatatcaggtatttg

SEQ ID NO: 126189 - DNA, 1171 bp, Homo sapiens
agtgttttgatataactaaatttgtggtaataagactgtctgcacctgtattcattgtggaacttcctctttcattggaaactttcttactcaagaatgacggcagtattgttttcttatatgtgcaatgaagtggaatgataaacagtatgcctttaatttatatgtgttcttgttctgatgttgtttcctgaaatgatttttcttcctaactgtggttttcgggtatgcaagcctaaatctttgtacactttgtctcacagaatagttctgaggctccatgacagggttttgtcattgttgatgttattgttgcttcgttttataaaaaagccaaaattttttttccaatccaaacgttcacctgtttcctttcctcaagctataccagtgtaataccagttaccctgtggatccatttaatatgttatccccactaattaattttcgtatattatttccaatatttggaaagctctttatagccatttggtatttcctattacccacctcctattttaaatatttatcagtctaaacttgtgcagtgtagtaaacatgcaagttgttacgattgagctgtattaccataagtagaattttaagtaaactggtgaatttgggcaataaatgtttttgctttttgtttgatttttttttacaagctaactgttagaggtatacatttatttatctgttgtacagatttgattatgattttaatgtttgaaagattgcacttgtttgcttttactatatgtggggtaaaatatattttctgttcacagtatatgaaaatatggagtaatttaaacagtaaataaacattctgtggatgcttatttttgtattggcaaagtatcaattaaactatatgtgttctttttcaaaaatgctggatccattcatgattggttcaaatatctaattatttcctcaacttaaatttgctttttaaattgcttaatatgtaggggtaggttaccaaatgatagttggataaggaatcatttagttatcagagcttcagagggtcatctgctttccaccaaggaagtttaagcattatggttcattagtgattttgcttgaagattttaaaaatgtacttattatttatttagcactggatttatgtgctactgatatacctccattaatagaggaatat

SEQ ID NO: 126190 - DNA, 1050 bp, Homo sapiens
attctttttgtttattgtgggaggaattttcagactgtacctcttgggaaatacaaaatattatagctttggtccaagaaggagaagactaatttagaattttttcttttgttttctgttttttaaaaaaaccaaatacagagaaataatgcaatgtaattattttacattgtattaagaagatggaaactttctccttgccataatttgctttgctcaaaatctaaaagtatccatgccctgactaactcctgcccatattcattcttacacattgcaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaatgactggtgaaatttacttcagtaaactatttgcttcctatttagtagaaatcttttaatcgctagaaacaggtttatgtgttcattctcattccacaagactttagtgcttcctatgaatatataaaatgcctgtgcctccgtgttccagttgagcaacccatttaaataatactttaactcttgtggcctgtaaatcctgttgttttatataccacttgggagtgttttcgaataaacctagttttatggattgtgaaactgatgacacccaattcatgcagggcagcccacgctgcgtacttacttgacttcataatcagatatttggtgggtttttttttctacagctacacctactggaatgggaggacatttggatctagaagcaagacaggagctgttacacaaaaagagaatagttactgctaatgtgacatcagttagctccaaaaccccagagtaccttgcagtaact

SEQ ID NO: 126191 - DNA, 1012 bp, Homo sapiens
tccattgatctgtctgtctgttcctatgcccgtaccagatgacttgcttactgtagctctgagtaagttttcaaattgggaattgtgagttttccaaatttgtttttccttatccaaatttgtgtgtgtgtgtgtgtgtgtatggctattctgggtgctatgaacttccttaggaattttaggatcagttagtcaacttctgcaaagaaggcagctagaattttgatggttttacttcattttacattgtcatttttttcctagcattgtcattatgaaaaggaacagtatttacttgtagtattttcctggttttctcttttcttttgaaaggccaatgagattcctatcttctcaagctgctccaagattatttaaatactgttgtcactatttcctgttgtgaaatctttttagccagttaagtagagatctttccccataattcccccaaaccaacaaaatattttgtttgcctctttgtgtttaccaaacaatagttttacccttatattaatgtcttagataaaagattgcaaggccttctaatgagagaccaagcatataggggtttgtgtagtagaaaaactaacagaactgataggtaaaatagtaatgtctacccaaagctccatacctccagggatgtaatttaaaagttttattacaagaaaattaagtgaaatgtattacttagttatttattattgtagtagtggggttatttcctaatttaccttaaggataatgttttaatgtaaatatctactaaatatagtaattactaaatatagtaatcagaatatgatgcatgtttatattgaatgaaaataaatgggatgaaataaagtttttagaaattaacatagaatggagagagtatctggtataccaaagcactcagtaaatattggttgaataaaggaatgaatgaaaggaagcccctacatgaatcattgtttttagagccgaggcccctacctcagggatgagtctagttaatctctcaatt

SEQ ID NO: 126192 - DNA, 1032 bp, Homo sapiens
agcagatgcattttacatttccaccagcaaaataggagagttccaacttttccatatcttcaccagcactagctattatctgcctttttgattatagccatcctagtgaaagtgaagtggtatctcattgtggttttgatttctattttgctgatggccggtgatgttgagcatctcttcatatgcatattagatatctgtatatcatatttggaaataggtctattcatatcctttgccatttttaattgaattattcattttttgattaagttgtaagagtttttatatgttctatatacaagtcctttattaaatatatgatttgcagttattttctcctattccatggattgtcttcacttttcttaatggtgttctttgaagcacagaacttttttattttgatagagttcaatttattttttttctgttactgctggagcttttagtgtcatattttaagaatcattgcctaatccaaggtcatatttacacctgttttcttctcagagtttaatagttttagctcttaaagtctttgatttttttgtgcgtatactatttttaagagaatttttaggtttatagaaaaattaagcataaggtgcagagattgcttttgcatcgcctcccccattatcaacatcccccaccagagtggtatatttgttacaaatgatgaacctacactgacaactcactatcacccaaagtccctaccttacattaggtgttactcttggcggtttatattctgtgggtttggacaaatgtataatgacatgtttccatcattatagtatcatacagagtagtttcactgctttaaaagtcatctatgtcccacctgttcatccctccttccccccaacttctggcaatcattgatgtttttactgtctccatagtggtttttcttccagaatgtcatataattggaatcatgtagtctgtagcctttccatatttgcttatttcacttagtaatatgctttgaagtttcttccatatcgtttcatggctcgatag

SEQ ID NO: 126193 - DNA, 1039 bp, Homo sapiens
atcctgcctgggtaaagttattatcaagacaaactttgatctttaatttttaatctgtaggttgaggcagatttgcttttcctacctcaatcctataaaagtatagtctgtggaataaatcacattttgcatagcatattcccctttcaacttcttcgcccataatcctggaaacacttttatacaggtgatatctagaattagctagaatacctggattagtaagaattaaatttaaggatagctttaaaggagaactatgtacacatggatgcagtctgtgggtaggtaaaaggcagatggggaaaaacagtgagctgtaaagtccaacttaaaaatttcagaattaaattttatcttctgttttatagcaatggattttgaaatcagtcaagcatacatagaagtcctttgaggaaaatggttgctttatctcttgtctatgtacctagttggctttctatatgaaaacataattctagagcttaaatttttacttcatagttacagttacaacatggttctctttcctataaagtaattaaagcagaaccgtggaatgagatgaatgggggtatcttccctgaaggcattctccaaatatggggtttttaaaacagttttcttaaggtaatgtgttccacaattgttaaaacaatgaccaaataatgttggaggaaacagcacaaaaacaaggcattggtagagtttttcattgttgtgctttattctggtctcactttttctcgttagtagtgcaggtcccacccgtcgaggtacttttagaacctgaactaaactaaattgaaccaagcaactccataaaccaaactgtgacctaaagcactgctttccaactatgtctagcctgaaaattgccaatagaacattactaaaaatatagataggttcctggcctttgttccccctagagactgattctttgagcctagggctgggcctgagcatgtgactctatattaagaacagaatttttgtcctacaagtacttgtttgagaattcaatcactaactgact

SEQ ID NO: 126194 - DNA, 1012 bp, Homo sapiens
aataatcatttctctggagaagaactttaaatctgtatgtgaagccccattacattatcttcttcttctcagatagtttcacctagatgtccaactagtaccctaagtttaacatatcctgaatcaaattaatcatctttctcttgaaactgacttttctgaggttcctaaagtattgctattctatgtcattctagataaaaaattcaaaggcgtctttgattctccttttatccctgcacctagcagtttgaaaaagtattgtcagtattatctccattatctccatgtcagtattatctccattacaaggtgtcttgtaattggcaccactttttgtttccttgtgcttcaccctgactgctatctgacactcttgcagtagcccctacttagtattccttaacccctatgctagtcattgctgccagtgtgaggaaaattcaactgtgaatttaaaaggtactttaaacttaacaacattcctagccagagataattgcttccccattagtgttcttatagcacgtatgctttctaccatttgtgtgtataattagtatgatttattatatatgtgtgtgtgtatatatgtgtatgtatgtatatgtatatgtacatgaattgccaatccccatagattgtaagctccttcaggggcaggaactatgccttggttgtcttgtatccccacatactccttgtattgacatacaacaaatatttgctgactagaattaaacagttagctgggctggaaggaatctgatcccagttaattgtaggtgatctgtgacagtcattttaaaaaatcatgacattaatttcatttttttgtacatttgttttattctgaaaagcttttttattaagctgtgctgatggcataaatggaacagttaactggaagaccagacaggccaacaattttattatcagcagaaaaatggctgctgggatgaaagatggtgagtttaggttgtaaatctaaatccctttgggggagccaatt

SEQ ID NO: 126195 - DNA, 1043 bp, Homo sapiens
agtggatccatgatattggacacacaattaaaaataaatagttatttccctattattaaagtttctccctcaatatgtgggacttggtttaagcacatcattcgtggcatcgtgtcttgcctttagtgatattgcctggggagtagagccataaaacattgtccttttattgggatttattggacttcagtcttctgtggtcaaagtaggacttcatctggatcaatacaaacttttaaaaaatgaatgtgttcaaaagcagtgctggccttgaaatacagcaatatctgtgtgttgtgtttaaactattctaccctgcctctctgtttaaacaattgagacaccaattcaatttgctttttgaatcctgtaaaagccaactagactgcccttatgcaggacctggaaagtatgagcaatgatgcattgattcactagccaaggacatgtagtggtgttaaatcttatgctgggttagtaggattctaaaagcaagagtgtaagaaaaaattccatagacctaaaattatcctagtaaatcctttaaatagcccataaggtataatatgtgtaattttgtatataaaactctgaacaataattcttatgcacaacatagtctgagaaccactgagctagaataaaggaaggaacaaaagagaagctgcctgggcactcaccccattctttctttatggtaactacccagttcatggagaaatggagagttctatagagtgtctgcttgcctgcaggatttacttcattatgctttaagattaagcccctataatcttcagacacattaatagatgatttggttttgtaaggattgaattagacagtatatgtgaaagtaccttgctcaggagctggtgatgggaagcagttaaatctaaatgttgcttgtcatatccacaaatacattgttctttggaacattgtagagaagaatttggccacctgtttcttgtccttctagttgggatattccactatccagcaaggtcttgcatgtttttacaaattggttgtacctgtaa

SEQ ID NO: 126196 - DNA, 1961 bp, Homo sapiens
ccataatctacccaaatcctttccttaaaacttacccttccatattctgtaaacacctaaatgcatattctaacacttatttcctacctccagtgtaaaaaaatgactctaggggaattgatgatatgggtctgtgttcgttagaaattcttgggctggaggggagatcgcttagtccatagcttcacagaaatatcaatatgatggctgttttctttctatccctctcaacctccccagcagagacagacagacagacagatgtgaggagcatacatagactaacgcacactccattcaggctttttctaaacttcggaatccagttctccagtctgttatctccctgatttccagaaatattaagcctaaagtagcagtacgagaaacaaaaaaaaaaaataataaagaagaaaaagccaatgtttctaggtatcaataagtcttttcaagtgaatatgtttctgattcaagttttcaggttgataggatcagatagagtctcaatgctcttaaatgctatttcacatggattgcttccaagccaaattctctcttcataattcccagtgttttaaattctgtaaccgtattaaagacagtattaagtaaaaaacaaatctccagtttccacagactgactctggaacaaccatttccattgatgttgtatcccttctagtctttgttctgtgtacataaatatttgtatataattataattttaatatgtatagatttcttacactttgttttgaaagataagttaatcctgctttctgcaaagcatttgtcaaggatgcaggatgctcttgtgtatgaggtggtgtgcagattaattagcagtattgctgtgtgagcgggaggcagactgaaccagcaccggcgaggtgtatacgttcttgggtttgcgtcagggtatcgtccctggttaaggatcataagcctttgccctgagttttgtcttcctcagcatttgtacgaatgactttgatgaagatctaagaggcttgctttaaaatccatggattaattgaaaagggatagctgttagaaataggtaacaatttagagttaacatggtttttaagtgggctgcaatgctgtgctgaaagcaaaaaaatattttatagtagtaaatgcatcataattcattggtatggaagtatggagatgactttgtatggtggcagttctttaggaaaatgaaggttattatgaaccagtggcatgatatggttgcaaaagaaaaaaaaattagttaggttctggtagtagtatagtgtccatatgtcacaaaaattaatagtaccctgctctaatcaaccacatctgtagtattgtgtccatttctggctgtcacatttaaagagagattttgacaaattagacaacttccagagcagtccatggggatgttgaagggtctggcaatcctgtcatgggaggtatcctcacagggtctggaagtgtttaacttgagaagactaaacagtcaacatgaactctctgatgtttgcttcggaaagtagaactagcatcggtgggttaaaggtacagatagatttcaacatgaggccttcctaacattgcagctcaacaaaacaatcaactttatttattctgttctttaaatatcagaaatattcacctttcttgcaatgaatatttaacttgaagaccttgataacattttagtgtagacctgaaagataattgtgatgagaacattttatttttctgataaactgtctaaatagccctatgtgttgcaagttcatttcttacaacttgaaaatagctgcaacagggtaatttaacacacaccctcctatctctcccattctgtttcaaacatgaaaacctgagaagaagatgaaagattccttttccccctgcaaagtgtcttaacttgcttaatttgcttcctagaattactctttcctggaatttcttgctct

SEQ ID NO: 126197 - DNA, 1095 bp, Homo sapiens
gctttgaaggctcccagctaccgacttttggtggcgattacgaggtttacacagagaccttgcttcccttgcaacgttacattttcctaaatcttgtagggtgaatgaatgcgtttagtcacggcaaccgcacgtttaatcctttccagcgggttgccgagattcggccacaaatatttgcgtgcatttgtactatgaacatatatattttatgtcagggaaaattgcagtggctgataagacgctaaaattctgatgaggaaggatgctaaataaaaccttaacgcggattcccatctaagcgcctcagtgtcaggtgcttgggaaactgacaatctgttgatgatcttagtaaaacaagtttaagttaaaagggaaaaccaaattgtctacagctgagttaggtttctgaaacacagatgaaacgctttcatatttgaagagcaaaattgagcacattttagtaacattgctacggattattttatacttggaatatcaataagaatttgacttattgtcataacaacgttgcagacaccgcactttaaaagagagcctttctaggaataaacaaaactgtagcccatttactgagattttactttttattagaaaatgcccactatccggaatatgaatgaatgaaatgcagctttttaacaaagacatttccctaggaagttgggtaaacacaattatactttttagaagtgccttttaatttaatctttaggatgttcaccctcttctgcaagatagaataattccaggatttcttatgcttggtagagtactgttctggtgaccgctgtcaaattcttaccagttttgtttgtttgtttaaattcgaaagttacttcacctagttaactgagacattatttttctaaaaattgagatttaaaaccagtatagatgaaaagcaggaaaaattaaagttcaaaaatccatcttaagactttaaaagtttgaacaagtttgaaccaatttgattttttcatttcaaaatgctaaccaggactttttttaaaaaacgtaattagtattttaccataataaaagtaatttcaggtcattgtacaaaattcagga

SEQ ID NO: 126198 - DNA, 1035 bp, Homo sapiens
ggaatgaacgtgatctttaaaaaaaaaacgtcctcaccgcatactcaccacgcgaggactcctctgcgaagacaggaaggatggggtcccacacctgagccaggcgcggtctccactgggtgctccgcagcccggagtggctccggacgacagcccgctcagcggacctttcgccaggctcggtggaccttctccgctgttctcctcagggcgcagtcaggtttcttcgacacacaccaaccgaagttgaagcgcgtgtaccaggagcgcagactgtgagccttatataggttgcaccgaggaggggggcgccaaatcccagcgtgctccgcgggctagggggtggaggggggtgcggggatgggggatgggggtgggggcggtggccacgctgcagtggcccgccgctagagggagtacgggattaccgagggggtgcgggatgctgatgctgaactggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacaggttagtggcctgcgcgcgacgtggaggtcccggggccaacaggccgccgcctccccctcccccgctcgggttccgggcgcctgagcgcgccctttgggcaccagcctctctttctgtcccggaccccaccgtacccctccttcagtacaccctgtaccccatttccccggcccagcttctctctccccaggcttgacccctggcctttttttcctctccgcgcccccgcgggcccctccctgctctgcgggcgcagaaattccatctccaattcctgttcccaacatccccctccccgcccagccccagggtagtcctctcccgatccctgtagcaaagagctgggggtcgttgcctgtttttctggggggcccgtttccccgcgattgggctctg

SEQ ID NO: 126199 - DNA, 1088 bp, Homo sapiens
gcggagcacgctgggatttggcgcccccctcctcggtgcaacctatataaggctcacagtctgcgctcctggtacacgcgcttcaacttcggttggtgtgtgtcgaagaaacctgactgcgccctgaggagaacagcggagaaggtccaccgagcctggcgaaaggtccgctgagcgggctgtcgtccggagccactccgggctgcggagcacccagtggagaccgcgcctggctcaggtgtgggaccccatccttcctgtcttcgcagaggagtcctcgcgtggtgagtatgcggtgaggacgttttttttttaaagatcacgttcattccccgtgcttatcgggagctgcgggagatggagtagcaccccagaatgtctccacgcaaaacttgtcacgccttcactggctgtaccccaaaacaaatggggaaaccaagccttaaaggcttgggtttccaggaccaagtccagatacgggctgtagacagagatgagctgcggacagtgatgagctgcagacggtcaggagctatagatcgatttgcaatttgctcttcaaatgcgctaccaagtgccatgctttacaaacagataagcgcttcaaatgcgctacaaactggcgcttcagatgcgctacaagcacgcttcacgcgggcgacaaactgatgggagctacaactggcgcttcattgcgctataaactgatgggcgctttatgtgccacaaactgacggatgggcgcttcagtggcgctacaatccagaacgaggagcagcgatataggagctgcagacagaaaactgaattgcgctttacatgcgctgcaaaatctgagctgcagaagagtagcactacaaaaaacgctacaaaaacgatgcgattagccagcccgacaacagcgcttcattgcgctgcgaggcacatgaactgcagaggtacatgagctgcggaacaattcacacctaagatgcactacaaagtggtaagagctgcagaggtacaggagctgcagaccgtttgcgctacaaataaagcagccgtagtgggacatgagctgcggagtacaattcctctgttttcttgga

SEQ ID NO: 126200 - DNA, 1094 bp, Homo sapiens
tatttttcacctaacttctctaattaccaactgtgtatctttttggccttattctatgtaatttatttggcgtccatttttgcaggtaaatcacatagtgagtatccagagaggaccaacttatgtatttaaacttttgtttatttaaaagttttataaactttctttaaaagttttaaactttttaaatcaaagttttttaaacttttttaaacttttacatattatgttttaaactttttatatatttaaattttccaaatatgggacttgagattattaataaaatttaaaataattaaatcattctaaatgcatttaactgtattttcaggaagtacacaggcagacactgtgtcaggatttttatgtgtgtgattgtcattacactcataattagaatgcttaaacacacaccctacccccacctccccacacacatccactcaccccctaggagtgcagccctgtcccaccttaacattacaaaccttcatttggggctatgctgacaaatcttcattaaaaactatggattacaaactggtaaactgcaagacaaataaggccttgaatttgtttgaccaacacagtatttttaaaaaagtaaatgtctttaggtgggaaatgcatgcccatgttgctatagttgcagcccctccctcttttaatcccactctttttacacagatagtcacctttctattttctaattaataactttgttcatatcagctaaccattgttgaatactcactacataatttacctgcactatttaattaagtcctcataattagtttgaggtatactattattgggcttctttgaatgtcccattttatagcttttcctaggaggcatcaattattatttcttgaatgactgcataatgacaaaggaaactgacatacacatattgctgcttagtgccatttctgtcccatagagaattttctttggggatttaaattatggtcagaaaagtaatttaggcagtcctgtggtttttgtggtggtggttgtttgatttgataaccagttaccttctcggtggcagtggaatagggttgtgacagttggccagagtaccc

SEQ ID NO: 126201 - DNA, 2468 bp, Homo sapiens
tgtataagttggatttatacatacatttatctttatttacagaaataagcgggttttgaaaacaaaaaaaagaaggagtggaagagggggccaggatccaggcctccatccccacagaagtgaagctacagctgggaggtctcctcccaccccaaccgtcaccctgggtcccgactgcccacctcctcctcctccccctccccccaacaacaacaacaacaacaactccaagcacaccggccataagagtgcgtgtgtccccaacatgaccgaacgaagaagggacgagctctctgaagagatcaacaacttaagagagaaggtcatgaagcagtcggaggagaacaacaacctgcagagccaggtgcagaagctcacagaggagaacaccacccttcgagagcaagtggaacccacccctgaggatgaggatgatgacatcgagctccgcggtgctgcagcagctgctgccccaccccctccaatagaggaagagtgcccagaagacctcccagagaagttcgatggcaacccagacatgctggctcctttcatggcccagtgccagatcttcatggaaaagagcaccagggatttctcagttgatcgtgtccgtgtctgcttcgtgacaagcatgatgaccggccgtgctgcccgttgggcctcagcaaagctggagcgctcccactacctgatgcacaactacccagctttcatgatggaaatgaagcatgtctttgaagaccctcagaggcgagaggttgccaaacgcaagatcagacgcctgcgccaaggcatggggtctgtcatcgactactccaatgctttccagatgattgcccaggacctggattggaacgagcctgcgctgattgaccagtaccacgagggcctcagcgaccacattcaggaggagctctcccacctcgaggtcgccaagtcgctgtctgctctgattgggcagtgcattcacattgagagaaggctggccagggctgctgcagctcgcaagccacgctcgccaccccgggcgctggtgttgcctcacattgcaagccaccaccaggtagatccaaccgagccggtgggaggtgcccgcatgcgcctgacgcaggaagaaaaagaaagacgcagaaagctgaacctgtgcctctactgtggaacaggaggtcactacgctgacaattgtcctgccaaggcctcaaagtcttcgccggcgggaaactccccggccccgctgtagagggaccttcagcgaccgggccagaaataataaggtccccacaagatgatgcctcatctccacacttgcaagtgatgctccagattcatcttccgggcagacacaccctgttcgtccgagccatgatcgattctggtgcttctggcaacttcattgatcacgaatatgttgctcaaaatggaattcctctaagaatcaaggactggccaatacttgtggaagcaattgatgggcgccccatagcatcgggcccagttgtccacgaaactcacgacctgatagttgacctgggagatcaccgagaggtgctgtcatttgatgtgactcagtctccattcttccctgtcgtcctaggggttcgctggctgagcacacatgatcccaatatcacatggagcactcgatctatcgtctttgattctgaatactgccgctaccactgccggatgtattctccaataccaccatcgctcccaccaccagcaccacaaccgccactctattatccagtagatggatacagagtttaccaaccagtgaggtattactatgtccagaatgtgtacactccagtagatgagcacgtctacccagatcaccgcctggttgaccctcacatagaaatgatacctggagcacacagtattcccagtggacatgtgtattcactgtccgaacctgaaatggcagctcttcgagattttgtggcaagaaatgtaaaagatgggctaattactccaacgattgcacctaatggagcccaagttctccaggtgaagagggggtggaaactgcaagtttcttatgattgccgagctccaaacaattttactatccagaatcagtatcctcgcctatctattccaaatttagaagaccaagcacacctggcaacgtacactgaattcgtacctcaaatacctggataccaaacataccccacatatgccgcgtacccgacctacccagtaggattcgcctggtacccagtgggacgagacggacaaggaagatcactatatgtacctgtgatgatcacttggaatccacactggtaccgccagcctccggtaccacagtacccgccgccacagccgccgcctccaccaccaccaccgccgccgcctccatcttacagtaccctgtaaatacctgtcatgtccttcaggatctctgccctcaaaatttattcctgttcagcttctcaatcagtgactgtgtgcta

SEQ ID NO: 126202 - DNA, 4335 bp, Homo sapiens
ccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaaacctccatcaccatctaaattataggctgccaaatttgctgtttaacatttacagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatctgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgtttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaactgtgtcctgatcatttcagcatctaccagcatcaagggaatggggtggggtagggtggggaaggctgagagagtagggagagtgggagaggctagagtagggtggggctgtggggagggtgggattgttggaagggtagggaggtaggagggtgggtagggtaggggtggaattgagtttgggatagtggggtggtggtataaagaacattattgattacaacctagtatgaattatatagccagaatactccaggaaatcagttattccagctgcaaaagtttaacatataaaataaagatacacaattaatagcaactctggttgctattatcacaaactttaacatcagttttactttaaatacttgagattcattaatataaaattatgaagtattaggacatagaagaagagtttcaa

SEQ ID NO: 126203 - DNA, 1065 bp, Homo sapiens
gggtgggttgtggtggaggagcaataggttgaagatcggaggcattatcagtgggatctattgtttcctggcacattgggaggaaaaacaaagggatttattttcattaccctgtaattttttttcttttctatttttttaaatgtggccagggagctcgtctctctccgtgtcacagtgggatccgcctggcagccgccgggagctgcagccaatgtgttaggacttcaggtgcttcttggcacaaagctagactgcgacctcctaccatagcgcttggcgtcacctgctctcccggtcctgccccagggccgagggattgcgtcccgaaccgggcttgggaatcggctgcctctcaagttggtgttatttatgtttgtcttttgtgagggcaggttttgaatcccccggcggccccatctcccccgcccccgcctccttgggttggaattggcgggggagggaatggggggtgtgtgtaggggagaggggagggtgtttgtggctttaaaaagaatggtcagggtaaaaggagattgtcgatgctttacaaaaaaagaaaaaaacaggcaccacactccaaagcctttcttgtttgtctgcatgggccatgcatgcgtgctgggccaggagccgagtttggagacggtttaagtgaaagtgtgtgcctcctcagctgattgtgcgtgagggtgatgtggctcggtctaatatcaaaacaaaacaaaaataaaatgaaaaatctttagaactgcctgcattgtctgctcctcagcatatcttgaagtatttgattgctggcttattgatataaaatcctgctgtgggcttaaagagaccagcaagcatgcattgcgttgcgtgttgaactgtagtaagttagaggcaagaaagaataaacaaatcagggctgtgaaaaggggtgtcacagtatatttgctttctgattgtcacattcttacgcatttattcccttggtagtctgcatcccactccataattaataataaccactgttaggaaacttccaaatacttgttataactgaacttagtgaaacttatt

SEQ ID NO: 126204 - DNA, 1120 bp, Homo sapiens
tttcaaatatacttatgtgtagcttgtatttgtgagtgtgtgtatgtgtttgtgtgtgtgtgagattttgataggtatctccaaattgtgtttggaacttttttttttttttttttaccaaagaccaatcagaatgataactttttgacttttaacttcccatttcaatgagtaatctcttctgtttgccacgtggctaagccatttggaaaaaaaaatgtatgttatttgactagacataaattcaaataagtaaatgaattcagaaattcattcttttctattgcagatgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaacccaagtcagatggggaacaaaaaacaaaagaaggtgagggctcccagcagagcagggggaggaaatatggctccaatgtcaacagaattaaaaacctatttatgcagatgggtatggaacccaacgagaatgctgcagtcattgccaaaacaagggggaaaggtggacattcatctcctcagagaagaatgaagcccaaagaatttctggaaaaaacagatggctcagttgttaagttggagtcttctgtttctgaacgaattagtagatttgacactatgtacgatggcccttcatattccaagttcactgagactcgaaagatgtttgagagaagtgtgcatgaatcaggacagaacaaccgctattccccaaagaaagagaaagctggagggagtgaacctcaggatgaatggggaggttccaagtccaacagaggcagtactgattccttggacagccttagctcccgaactgaggctgtctccccaactgtgagtcaactg

SEQ ID NO: 126205 - DNA, 1019 bp, Homo sapiens
cctggtgaagagatccagcagagcaaggaacccgaggactccacatctaatcaacagactcccgacagcattgacaaagatggtcctgaagaaccttgtgctgaaagtaaggcaatgccaaagtccgaaatcccttcaccacaaagccaactgttagaagatgctgaagctaatttggttggaagggaggcagcaaagcaacagaggaaagaacttgcaggtggtgatttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggtaagtgtgttttctccattttgttttctaaatttgtttttagtactagggcctaattgtatgtagaatagacttgacaactagtaggagtttttgtaagggattcaagattgttgatacctttaaaatcacctgttgtcaggtgattttaaaagttcagagtttgagagatatcaattacatttcttaaatgtgctttataatggcatacatcaatagtgagtaatattaaagctgaagaagttcgggaattgtgagatacgttccaatgaactggagtatgagtattgtgagtactgaaaaccaggagtgttagtttgaaatgtaattactttagttttacctaaaattattcataaataatattttctgaatgtacacactttaaggtatgaagtataatgtacaatgggagagttttggtaatctgggaataatattcgatttactttcttaaaaaaatctgagttattaagtgtaagtggattgtgaggaatttt

SEQ ID NO: 126206 - DNA, 2186 bp, Homo sapiens
ctggaaggttatggtggcagaatgtgtagttttagaccacattctaggggcttctagcttacacagtgtgtatatatgatagacttggaatttgatatattcctgtaaattttctcctcaaaatctaaaatcactgtctgttattttcattttgggaccttccatataaggctctaaaatataaatttacatagaaatatttaaagagaaatctgacattgttctgattatgaaatactattctgaaataaagtaataatctatgaaattatttacagatgttagcaggcagactttcattttattagtgtaaggcagaagttctgggtcagaatgggtcatgttaagttaaactgtagtttaaaataaactacagatgtcaattcagtttgaaagtaagtttctttgcagtgctttaccaccttcctttgtgattatctcctcctgccttcctattcctccccaacccccactgccctactctagatggtctttaaaggtgcctttcccccaagcctatccagtgagctcctaaactttgccattcgcatcccccttgaacatcatctttctaccctttaggaagaaagcaataagattaaatcgtttcacattgagaaaggcaggaataactgaaatgaactcttcaaggagttgttaaacccagtgactaactttttaatacaagggatagcagcttatgaaaatttatcaagtagaccactacccagtcaaccaagtgggacaccagcctgtatttgggtcctgtgctgcacaaaacataactgtgcactagttggtttaatggattttaaaggatttatcattgaaatgtgtctgtttatatgtgaacaaaccagctttttgggaatgatattttgaagttcaactaatttgtgctatgattgcttataacaataagtattttgcctcttaattttcatataatgacaattttatctagcaaataatgaaacattacctacatttaatgcatttcatcaagaataagatttctaaaacaaattagatcaagcataagacttgtgaaacaaagataatgtattgcatttgattgggcagttaacaggacttcttggagtggattaagtttgcaaacagaagattcattcttagccctttgtaatgaataacacaattactctttcttgctgcttccattgttaaatatgcaagtggattcacttggaaaatttgagagctgctttctactggtcatggtggtggccatagtgtttaggttattctccaattaagattttttttgctgcagagggtggtaataccttattagatccaattaaagtatttattgaaggcttatcatgtgtgttctctcatgctgttagctgaagaagacacaaaaatctgtaaggttacccctttcctctgtgagtttgtagagtcaattcttaaacacattgtatttaaaatccataaaaaacagtataaaaaactatgccaaaatttttaatgtcctgtgagtcctttagtggcacttggttgtactaaatgcatatagtgaaagggatttgatagattatttggaaaggaatacatgcaaccattttctatctgtgtttctttattcttttcataaaactttatttatggaatgggaagttgcaattcctaacctcagtcttttcctttgaagcttaaacatacttcctcttaaagaagcaacagggaatgtattctttaaataaatgatttttagaacttttacattcttttcctggctgtcactttattctgtactaggttaaaaattcctagcacctttagttttttgttatagatcttatttatcatctttgtatgtgtaatattgtcctcagtgactacttcagttctttttatagatgttttacatagatatttccataagatgtcttaaatctggacttagaaaaacatcagaataatagttgatctttcctgtgtagcatataccttgtacttgtacatataccttgatttttaaaaatggtcagactgtattgccagccatcagttagtatgactttcctatctttcacagacagttatttcttattagatagattgttatgtttcatagggtcatgaaatattagaatgggattaataatagcaaattaaaatccaactttgagatatggcatgggagaatgttatggacc

SEQ ID NO: 126207 - DNA, 1056 bp, Homo sapiens
tgtattctctccctttttgggggctccgagtcatagttagggcattcatggatatatgaagtttttttgttcaggatggttttcagggaatagttctgttgagatccaactttttgtctttgcggaggcttcctttataacagttttgtcagtgcttcttaaactttaatatgcatatgaatcacttgggagatcttgttagcatcaagattctgattcagtaggtattctatgggaaattaccttgatacaatggttgagctacaagtacaccagcaggcaagctatctcagaggttatggaatagaagactcagaaaacaaattaaaatgcttgaatcacatgatttaccaaaccagttaaacacaaatccagaagcaagaggaaagctatggagtaagttaacacacttcaggttcaaaccaggttggaaggaccacgctacctgtcctggataaacaatgttcctatgtcccatctttctttcacataacccttccccattaatgatgtggttatgaggaccagagctgatgtttgagccaagactccatagactaatgatttcctgggtcgatgatacacacttgttctgttgaagagatgtgacaaatacacttaggtacagccgtagctttgctagtttgcctgctgatgagccatgggaccatccttggtgtcttcagtagatgactgatatggaagtaatgtagctatcagtccaggcataatggtgacttggtatttccactgctttttgtctataagtaaatctcattcattttatcataatttctatttattttattgttgtcatgtcttactcccagcttacctatttattacgcatctgctgactgccttcatttcaccagcttgcattctcattatcaatacttggcccagcctgagtgttgcctctgtctcataagttgttagtttatttaccatctatgattatcacttcttaagtgtttcatccatcccattagttttgtttacctctataatagaatttcatattctgaaataatacaggaaaaccacgttaacagt

SEQ ID NO: 126208 - DNA, 1021 bp, Homo sapiens
gaaatatacttgaaggtaatctagcgtcatttcccagtcacttcaggaagcccttcagtagcatactcctgacagatgatgtttcagcttctgcttgaataattctaccgatggagagtttattactttggaaggtaaaaggaaagttagaaggaggggcatgctggtgtgtgtagggaggtggtgcactcactcttctttttatttaattttaatttgcaattttttattaagataaaattcaggtaacaaagttcaccactttgaagtgcacaattcagtggtttttagtatattcacagtgttgtgcagccatcacttttatctgattctagaactttttcatcatcctagaaagagaccctgtgtctgtgaattgtcattcccaattccccttccttcttcatcctctggaaagcagtaattgacttgctttttctgtagacttacttctggacatttcttacaaatgcttttaaaaaagaatataggagacttgaagaagaatataggagtatggcttggaatatattaaatttaagatatcaaaaggatagcacactacaggaaagtctagagagcaatggcataaagaattttcttctggttggtgatatggtctaaaagttaagtggcatgatgtgggagcaacaaatgctatctgccattttatgtgtttcatagagaggaagaacacatgaagctgaggagacagtaggattcaagaagaatgaaatgtataactgaggaagaataggtttatgtggctgagaggatggctgaacaactcccttgcgtgggacaccgcacttctcttaatgtaatctaaaattgctacacatgaagcatgagtgtttgattcagcatagggtttctttatttccttttagagacagggtcttgccctgttgctcaggctggagttcagtggcacgatcaaagctcactgcagccttgaactcctgcgcacaagggatcttcctgccccagcctcccaagtagctgggactacaggtgtgtg

SEQ ID NO: 126209 - DNA, 1148 bp, Homo sapiens
gccaccatgtcctgccaacatagggtttctttaaaggtacaagtggcattgatgctgagtttcatctttacattggtctttttatagcgtgaaggaatcctgttccttttctaataatctgatgcttatttctatcctacttctcttatattgtcactttccttattcttttactttgattggaattgttcacggacagcttcactactttaaaattttttctcatccttcaatatttcgatatagatttcctgtgcctacatgctattatctgtactgtaaccatctataagatgagtgatttgaagcagatatttatttagtttactatgtattgtctgttggagcatattactatatagtctatattactattaaatatcattaactagtaataataatggtaacatcgagaggtacttgatattctgtcaggttggacaagtgtgcctcttgaagccttgaatttcttacctgtaattgaggctgtcttacttgtaatttatcactaagattgtttctcggctttaccatcctgtaattctctgtgtcttaaacatatttgtactataccataatcataaatatttgtgctatgatttcaaagagaaaattctggacatcttttgttgaaatatcaaaatgaaaaatttatgttaaattgttcttgagaacaataattctatagattatagtagaaaccttaaaatgagtaaaatattaagtccatgggagcacaattttatagagtggatttttagagcaacttgacttttgaaagtatgggtttaactatatgttaaaacaccctgctgaggaaactaagaataaagaaagaaatgttttgtaatatagttgctgacatattaattgcttcactcacttttgctctggaaatagcttcatagcacagttcaacatgattgaaatattgataattttttttttttttacagttcccggttttcagcctaacttactctttctcatgcacatatccttacaaagaagacagcgaaatacagtatgaagatatcaggaaattttatattttaggaggaaagttttgttctttgcttacttaatctatttcattggtatttttaaaaagtatttgtggagttaaaactgttcaccaagtatttatg

SEQ ID NO: 126210 - DNA, 1055 bp, Homo sapiens
ccagcctgggcaacagagcaagaccctgtttcaaaaaagaaaaagaagggctgggcccgaaatctatgattttcatatctgtattatatacagtttcttgcttagcgtctagaattacctattatttaggatagattcctaaaaaaatataattttattaatttataatattatttataattttattaaattatatttaaattaattaaaaataaaattattttaaagccctttatatataattcagaaagggtgaattatattgttattgccggaattgttattcagaaagggtgtattagtttataatcagcactgcattggaatagttttctcacaatccctgcgccagtacttagttttatttatatgctttgtagttttcagtttggtaggtgaaaataactgttataatttctacttgatatattgttgagattgaagattttttatgtgcttataggcttttttgatatgacttctgagtggtttttattactttctaaatcagtgtttgttagtaaagactacatcaatgtgttatttaaatgagttggtaaaagttaaagcaactcacatatccagtaatagggatatggttaaattcattacgataaatgcatatagtataataggataaagctgtattactcatgttttctaagattacttaaagatgtaaatacttcatagtaaaaagtctggttaaatgctgaatatgcatttctgtcatatttttactttaaaaatatgtgtatttgcagctaggacaaagattaaaaacacatacatcaaaatgtcaactctggtaatttctggattgagagaacagtgataatgttaaatgaatgtatacttttctgaatttacttaattttctacaataagcatgtattacttctttaattacattaaaagatagtggtgggacacaattggaatgatcagcaataacaacataaggaagttaacaaaaacactttttaaaatgctgccccaaattctaataattagtcttttaatgtacttttatttggaggacaacatgtcacaga

SEQ ID NO: 126211 - DNA, 1408 bp, Homo sapiens
taaccttgtaagtattatggggaaggagaccctccaattcattttaaattgtgattatatagcatttgcataggcctgagatgttttccttaagttcgactattgtgtatatgatattctaatgtgttacttaaaatatgctttcaaacactgggtataatgaatttgaagtgaaacatattttaatgagtagtcttactaaaaataataaacatgtacttaaaggaaacttaaccattttcccatgtggcataatgtctttctgatgtcttagattattgagcctcaacaggcttgctctctgtgaaggtgagacagtggagatgtcaagttcattatcttgcttatatataatcctttgaaaaaactcatgtacacacccagttaaaaataggattttgagttctaggcctccacagaatccatttgaatatgtttcctgtcctaaaacaccagccaatatgtggtttcctgttgttcctcttaaaaaacatattagttgaaaagagattcatttgatgtatggttagactatatggtagtatgttatatttttagttagagtcaaagggtcagttcctctcatctattgggtaattttccacctttgaaaagctttggtagataatgttgtagtatataaatgatgacaaacatatttttgttgggtggcagagttttctgaaattggaagtttaaattattgctttttgtttaatgagatgagcagattactctgatcttacagttttaagcagttctgggattttataagttctggtgaagtcctaattaaattgccttacaatataatctggtgtttggattatcactttttgttaagtattcttaaaccttactacaatatggttgataaattctgttaatattttattgtatactgggtttctagtagtgatatatagatgattgtatataattataagaactatttaaagaaaaagaggcaacattaacagacaaaccatgtaaaattttgactcttttctataaaatggttacactggaaaaagaaaattggagttcaagaaaaaaataatttcactggttgtgattttgcatatttatgtaaatttgtgaatgatttgaggcagtgatatctttttttagttaatcatgtacccaatcaagtttgagacgaggcttatgtttttccatagagactatgacacttgtggaatttttatcttgctggctccttctctgtataacgagttctgtgagtagtagcattagtgaactggagctccctcaggagattgtcccatttgcagatgtggcaatcagaagagttttagtttgagttactgggttttgactcttattacctaatacaattctttatttatttagttttgagatggagtctaactctgactgcattatt

SEQ ID NO: 126212 - DNA, 1049 bp, Homo sapiens
gtactgagagttgcattgcaatagaggtgtgcacaggatgctgtgagtgcggagaggggacacttgggttctggaggcaagttccaggaaactcctgggagaagccaaactctatctgagtttcgaaggtttaataagtgttggtagaaaaagggacaagtgtgcaacctaacagcgaggcacagaaaagagaaaaaaatgctgtcttttgcagatctcagagtatgatttatttataggcaaaatattgttggtacatggtaaggcatgtaccacaaagtttaatattgttggtacatgttaaggcaagggcagattaagaagcttcctttgtgctagacttagtttgcacacttttctgaaaacatactagttggagggggttttgagcatggaaaggcatttttagatttgtatattagaaaaccactctaatagagagtggagatagatagaaaggctaggtgtggggtgggaatgcagcagtcacagtgaacacggatgagactgatgaatgtttgtcagaatggaggctgaaacaggcaaagggtaaactgggcaagctggattaggcagaagatgataagaggtgctattttgtgtgaaattaacttttaagtgcaaaaatcatatgtgactattttttatttatccatgtatttttcctactctccccacaaaggatcttgcctagtgcttggttgataacagatgctcagcaaatgagagctaatgtaggaattaactagacataaacagggaattgattgtctttgatccaatagttgcaaaatacgagggatgaactcataggggccttagagccaaggctgtggatctgagtgttagatccaggtatatatgtcattgggatactgtgaggagaggaaacatgagaataaggggtaagacagcaggagagtgttgggaggcagcatgatgggggagccccacattttggagaaatagagtttgagaaatagcgcttcagagaaagtttggagaaaaagattagaaagattttaagaagcataaaggttgctaaacat

SEQ ID NO: 126213 - DNA, 1051 bp, Homo sapiens
aggtagtctggcctgagcctgtgtttactgatgtaagagtcaggttttagaataggcccttcatgataagctatcttcttgctctatttttatcccatttggaaaatccctttaatgcttttaattgaatttgaagcagactgccattgaataacgtgatcaaagtaaagacgtatgttctcaatttgggacaaataaaactctaacatttttagtttttttgttaatgttattttatttactagtctttgaaaacttttgtgaaatagttcatatttaacagatgaggaaccagaggcagagtcttaaatccacaaaatgagggtaaagtaagaggtgacccaggaattatttgaatgtagaattttgtttgggcaatattttggcctttttactgtataaaatgcatatgagcagaggagagcactagatcaggggtcagttaatgtgtcttccctgtatcagactcacactgacagttcagaaagtaattgagtcacaacagcacacctgtaacaatttagacatcaaacacttgctttgaacattttgtcctttgtttcatctcctttaatgtgacctttcaagatctctaacatgtggtatgaatttgagagcttctcaacctttattgttgagatctatcctgagttttatcacccaagtattatccctcatgtttatagaacattttttttttttgtcaaaaagatctggcctttgaattcagatcagattcagtgtagttaagaaaatatgtcaaaacaaatatagtcagaaattcacagtacctttgtgttctgtttaggctattagctgagcctttatttaccatttttggtgcttttgttatcgatgttatgttttaaaaatatatacatgtttctggaactacatatatgtctgtgtgtgtatacgtatatgtacacatatatacgtctatatacatatatatgtgtatatatttgatgttaaaagcttttatcaaatgtgtgtgtgtgtgtatgtatatacacacatacatgtatatgtacgtatacatacacacaca

SEQ ID NO: 126214 - DNA, 1033 bp, Homo sapiens
aagagaatattatgtaatgaagtgtgagaataattagtgcagtggtttgaactttaagacatacgaattttatgttcatgaataatgtacattgtgttttcatacattgtctatggagagtcattttcactgcctgaaattggtcaccttcaattccttctcatctctccgccaaagtatgaaaagaagattgcagggctaagctactacttaaatattattccttttcataacccttcatatagcaccagtgaaccaaggactttgtacagtctagagccaaatgatgacaacatgtggcctatgccaaagataggttttagtagatattagggagcattgtgaaaaaaatggttctgtggttgaatatgtttgggaaacttcataccatgcccccttcttagaaaatcataaagctattaacgtatgcagggcccctgaaagaccacattgttacattttttaaaaagttctcttcttgccttgttttaaatgtgatattatttaacattctgtggcttctggaacacagttggataaaaattattgttgtacagttttaaaaacagaattattcttttgaattgcgtttcataagttcagttcttattgcctttcccacctcaatgattatcccagaaatctgaaaattttataataatgaatgtaggcttatgataaagtggtttcaattaacaaaagtattgctgtgataaagtagtttcacctttgagtaaaacttgttgattgcactaagtggaccatttttgccatttcattctggaaaccagagattgcggattttaaattttcttttaatctcctgaatcagcctggattataacatgctgtattttctgtctcatgataaccatattgctgtaaaatatgagaaaattataaacattgttttgtttaaataattgatagtagtaaagtaaatattttaggctatgtttacatttgtaaaagaagatttgagcagtaatttcatcccttagagaaagcccatttgggtaatcaagtctaaatt

SEQ ID NO: 126215 - DNA, 1043 bp, Homo sapiens
cctctcctaagctccctgcaaatccttctagcatgtaatgaaccatattttattgaaagtatgaggctgttcccttcactggaagttcctaggggacacagattgtcatttattcattgttatatcctcagcactgagcacacggtagttaaaaataaatttgaactgaacttgaaacttgaaaatcaatatccaatgttttaattttaaagtcttggcctgtcttttacagacttcttcaatgttgcaataatttttttccctagtataattggatcataacatagatctcctgatggccacagctatcaacatataggtaactcagttctttgcaacttacatttcagaagcttgtcatgacccaattacacaggcgtagtttcttacagaataaatgttttccaagtctcttgagataattctcctaattagaaatcaggggtgagaacctttatgtaatcagcattgtggtagattgaaaagaatacaggttttggagttgatgtttgaaagcatcttctctgtggtattctatagccatttacttaggctgagtttactggtttatgggagatccagttttttcctctgtaaaatgaagatagtattctatattaagatagggcactggaaaggctaatggaggtcttgaatgtgaaatgtttaatgtgggacttggtacaggtacgtacttgtgaaatattagttcccttcccaggtaccatcagagttttcaatcttgaggggagctgggctgacaacatattcactatagttttctatatcagtggggtactctggtagagtagaacaggggtcctcagaccctgggccgtggtctggtaccagtctgtggcctgttagatactgggctgcatagcaggaggtgagtggtgggtgagtgagcattactgcctgagctccttctcttgtcagatgagtggctgcatttgattcttaaaggtgcatgaaccctattgtgaactctgcatgtggagggatctaggttgcaggttccttatgagacctgaaactatcac

SEQ ID NO: 126216 - DNA, 1069 bp, Homo sapiens
ccaggaattcattactgtgtgatgaaatgaatctcagtggaggcactgagaaggatgatggatttggaacaagaagatctgggtttgagactcagctctggtgcttactagttgtatgactttgtgtaaatgtcttcccagcctcatttcttcatctaggaaaagggataataatactttttcacagtgttgttttgggaattaaattaatatgtcaagacactttctaaacttaaaagcattattatttacattggcagatacctatattgttgatagatattattatggcagcacttacagcagtgctggtagaaagtgagtctacaataactacttgctgaataaatgaaacagagtaacactgaactggaggaatttgcttcttagcagaagcattcagattacccctttttattttctttcttctgtatgtttcaattcaagaaaataaatattaatccaatatagatttttcatagaggcaaggttttgataataataatgagttgctgagtattccagtggactttatatagtgctttagtcagcaaaacagactaagcatacaaattattcatatcattgaacagtttatgtaacaaatattttttgaacatacactatgtacttagcacttagtgacttaggtgaacattgactgggaggataccatgtgtcccatcccagaagattgtataatgttatgacagggacaagattatatatatatatatatgtatatatatgtatacatacatgtatatatgtgtacacacacacacacacacacacacacacacacgtcccaggagattgtatagtgttatgacccaaacttatagacacctaaacacactatctcttcattccttaccttgacctgtgctaatcactgattgcatgctctacaagtaggaggttttatgtcattcacttctatgaccagcacttggtaggcccctaggacataataactgctcagttaatatttgttgagtcatgaatagatgaaagttctgatttagcagtatttctatggaaaagaatttgaaccataataatcatg

SEQ ID NO: 126217 - DNA, 1050 bp, Homo sapiens
ttttaatttttttttaagtacagctcattggaacttagcctatttcatccagatgtgtaacatcctccttaatactatttttcttcttattcccagttactctgagaattctttccctttcttcactagatctgtgagccaaagatgatgctaatcatagctcataaacatgagtttggtattaatattatatgtttgtataataaaagaaaaggaaaacatttagccttaaagtaaaataagttggctctgttagcctctagagttcttaaaaataattataagtctcttcagaatccctctaaatgtcttcatctcctttattgtctttatctgcttaaaactgcttctcttgaaagaccagaatgcaagatcaaaaaatcaaatattatatataatattgatttctggtagattcatagaatttcaaagctggaaacaatcttattttattttttagaataggaaaaatcttttgtaaattagaacacttaaaaaataagttaggacactggaagtcttagggaattaattctgccaaaatacaccttgcccagctcccatctttctgtaagctataaggagttgttcataatgaagaaacagacccctttaggcaacaacaaaatcagagaagagctgaagatttggggaatacattatgcacagttactgtgtgtcttcattttgcagaaagaaaagtatactctacttggtttgatattgtctgtgaaagactaatattttttaaaattcagaagtcgcaggacagacagtaatatagaagagatgaaaataaaatgggagtagagaggggaagaagttaaaagaaaaagcagtggcatttagaagctgttgcagagatcaaacaggacaaacaaggcttagagttagtaacaaatggacaaagcagagatcagttttgccttcaaggggtgctgtgatgagagtatgtgtaagtggtaagacaattgcctaaacctcagtaagatatggaattgtatctttacatgcatctttatccctagtaattacaagattggaattgta

SEQ ID NO: 126218 - DNA, 1175 bp, Homo sapiens
atatatgtcttacaaatgatcttttatgatttgatgatgaaagttggagtcctatttttgaaatagacaagagaatgaaaaaaaaatcattgaatttttagagaaacaatgtagttaatggaaagagcaattggctatgtttttgcatctttgtgaccttaagccaaagtttcttttttggtccttagtttccttacctgaaaagtggaataatttctggcacatatggtttggtacatcacatgaaatatatatatgaagggcccggttttgtgtctaatatatagtgctgactcagaattttataattcttaatgaggttaggaaaaaaaagaaaagaaatttaatgattaaatatctaaatatcatttctcccacttctctcttctcagtcagaatatatttctccaattcttagtcacttggcctgtcactcagaagccataatagcactaaagtcaattttgctaggctctagagaatttaacctgagcttcaaattagttctccttttgtattctgcagcaggaaacaaccacttcctagacttgggtgggagaataaatattatgaacttgtctaggaataagtcaaccctatcaatgaaaagatcatgattttaactgagtaatttaggacagaggttggcaaactatggcccctaggccaaatctagacctctgtttgcttttgtaaataaaggtttattgaatacagccatactcatgcctgtaagtattgtctatggctgctttcctactgtaaaggcagagcaagtagttgtctgccttcccagcactttgggaggctgaggcgggtggatcacctgaagtcaggagttcgaggcaagcctggccaacataatgaaaacctgtctcaactaaaaatacaaaaaattagctgggcatggtggcgggcacctgtaatcccagctactcaggaggctgaggcaggggaatcacttgaacctgggaggcagaggttgcagtgagccaagatcgcaccactgcactccagcctgggtgacagagcaagactgtctctcaataaataaataaataaataaataaataaataaataaataaataaataaataaaagtttgccaactgctgatttagaaaattgtgatcatttctttaggtgaatattcctgacaaactggtttaaaatca

SEQ ID NO: 126219 - DNA, 1045 bp, Homo sapiens
gagctttctaaatctctcctaaaagattgttggcacatcagttagaatgtaaacaaaggctttctgaaatttcttcctgtaaacaaatgctttatattttcacatggagatttcctagcttgtgccatttaagctctgtagaaatgtttatcagtgaatgaatgagttcaggttcttaggcaataaaatgggggaaaaagtaaggtaatatttactgaaataagtcaactttgattaggtctgttactcagagattttgctttgccttcccaggcaaattttatagctgtctaaaaggagaggtcttgaggaagtcaagcttatgattgcctcttaagtcatctactgacatgctttgaactatcaaggttcaaggcagtgtggtagaccttgggagatgggatggagatattatttattatgtttcagatacaaaactaggtctttgttcataatgatatttaaaacaaataaccctcatttctatgcatggaaaatagtgatagcttatgaaagagtttagaaatggatttcttgcagtggagagtgatgttgagaaaatcagtgaaggacaaattgtgacctacattttagcaaaagtaggttatttgttttaaaaatatagtcagttttctaattactgagtttgttattccctttgtttgtaaagtacttacctcatgctatctgtgtgagtgtcctaccaaacttccaagtccatttcttttttaaaattgatatataatagttgtatacattttgggggtatatgtgatattttgatacatgtatacaatccctagtgatcaaatcagggtaactgagatatccatcacgttatactttcatctttccttgtgttgggaacattccaattcttctcttctagctattttgaaatatacaataaattattgtttactatagttttccaagcttatgtctgatgacacttcctcattgaatttttcctgccttccctgcccttctactctaacacatatcccctttgatcacctgttctttcagacacctcctatgatat

SEQ ID NO: 126220 - DNA, 1037 bp, Homo sapiens
atttttacttaagggggaagagggcacctcgtttcttataaaactgtagagttaaactgactaaaagcagagtgatgacctagtgatcagaaccgtttctttgacagatttgttcatttgtggaaatcccaaacccttttcagagcagtttttgtaatcactttttgtggtgtttgttggattctcagaatctttttctcaaaatagtagatgcctggatttgctattccaggtacttctgaaaagaagattttgagagatactgtagaattttaattgcattggaggtaatgcttttcagatgtatatggaaagttagattccaaggattaaaaaaaaatgaaattcttaaacaaattttggattccaagtccagattcaccagctagttccaatgggtttgaggggatgacgtataatgtctgtgtttgataagactaaaagctttttgaaagtgtgtgatagccaagaggtaaacttttgctcctaaggatctattgattaccttgatttcatctccttacatgagatacgtaccttttagctttcatgggccatgaatataccctgtatatgtttatatgcctgtatatatgatatattcatatatatgtaaataaaaatcaagtatgatagtaaaaggatttgtgttaggtctctcagctcttagaagtttgaataatctcatataagttgcttaacctctggtgcttttctttccttttaaaaatgagggtgattataccttcttaagtgaagtttatgaggcttgttttcatgacatatacaaaagacagggattcttaaggtcaaatgaatacagctagggttaggttatctggataattaaagctgaaagcttggagaaaaaagatttcattgggatggagggacatatattagggagagtatttaaataatttaacttgattcattgtggatgtccgggtcattgaaaaattaccagtctttcattttgttttgtatcaaattgacatgaaaactgtagtcacttcatatttatgcccagttcacaa

SEQ ID NO: 126221 - DNA, 1034 bp, Homo sapiens
acacattggtatttccagcattttatattttagtgtcttcagtttccataggtaccattacttaaataagagtgatttttttttcattctctaaaatggggaatagataaaaatgtgtgaagcaactggtttcttctgtctgatttgggcttctagatgccatgcctggagagtttgtagaagaacatagtattaggacttgccttttttgaagtgtaatttagaagtcaatataactaggaatcttagttggacaatctctactttgttatggaggcactgtgtagagtgagttgcatctagcagtcaggtgaaaatcccatagtcagaatcatggtttagggatataacacagtggccaattttaccttacttttttcaggtcatgtgtctaggtggtctcacttcagttaattttacaggaaattcattaatactcatttgcatattttatttctttttctttagtcagaaaacacttaaaataatttatatattctttccataggatttagcctgtgtatattgactgtcagacttcaggcatacattatttggggatgatggaatacaaagacccacatgattgattatgtaattcaaatttactttctgcgttctgaagataccacttcactgtaccaacaatattttgacttgatcttagttactgtattttaaatgcttgcacaaaatgcaaggtaagggcaagatgtctgtttactgtttgaactgttgtcatcctaagttaaatatgtggatttttggctcattttttgtataactgcattgatctgatgtgtcctacctcagagaactgtgtttatatctttgcatcactttcttatgaattttgcattctattatttgtatccttttattattgttattagtaaatactaaaagcccaatggtcagacattctatctttttaatttttttctttgaggatttggcacagtacttgaatatggttgttacttttaagtgaaagttgttactttatagaaaagtcggcttgcaggccatggagc

SEQ ID NO: 126222 - DNA, 1048 bp, Homo sapiens
attaagcacacctgggataagccagaattttcaaaaagaaattcttaaataccaagggagaatggtaagaaaatactttttaaaactgacaaatgtattacagagctttgcccatttctatccagttttgattagtctaagcagagcaggtttgtgggattttgcctgtgtgtgagcttggctgggcttacatggaggtgactcaagggctagcacttgcttttgggagttgaaatgtcagttttctcaaaactctcatatgccttttggtttctacactcacagatttccaccattctcccacacatgcagggaggaggaataggagcaatgaaaggtgaatttcatgaggactattgttgtattaagaagtgtaatactcaaatgtcttgctggtctgacattggaggtatgaagcagggaatgggatacttaggtcaggtcaaggagggcataaaatagggtcctcagaattggatgcaagtgttgtggcccccatataaaacaaaaatgggatttacccaaaatagaaggctactctgacttactttagagactatgaagcctctattgggctagttagcagctcagacagtggtgggaatttatctaagtatgctgagccttttaatgacagtgctatgacaggacacacagctctggaaggcttcctaatggggcaggaacctcacctgggggagggtggggtggtgatggaggaaacaagttagagagcgcctaggggaggtgaatcatagggtgtgatgttgagatagtttgctcctttccactgagtgcttctctactaaggttgtcttctggctagtaaaggaggcattccaaaatggttcatgcttcaaaatgacatgttttctttccccagtaaaacagttcttttttttttttttttgaatggtcactttttttttgaacttttctgcttttcttattttttcagaagcagctattctcaaactttttggtgtcaagacccttttacctaaaaattatgaaggatcccaaaaacactttgtctaggtgaattata

SEQ ID NO: 126223 - DNA, 1512 bp, Homo sapiens
atcctccaactataggtagttattaaataccgagtaactaagtaacttgataaatctaagtaaatgattctttccataggcaaaatgaaatactaatcttgcaacattttgtgctttttcatttacatccaaactaagtcaagagttgtccttccattatcatatgctggatttagtttggatataaatgaaaattttattcctacattcaagtggttgtccattaactatttctattaactttctagtagttgttcattaactattctccaaactttgaaatcagcaaaatatgtaaccatatccatctttggtattttaagcttaattatcataaaagctcttagggaaatttaagcattaatacagaaaatgtatcttttctttgaaaataaccaaatccattttaaaaaggaattgtttatacagtctgggattttacccaagttacaatttttaatgaatgaaaataaatatataatcaatgtaacaagagagcgaatacaatctcaaagcttaatttaacattgctgatgacttaatgaaactgtatttacctcagagccctgatttgataaggctgttcattattttttagggcacacctattatttattcccataataactctaacaaataacaacataataactctaacaaataaaagtaagcaaaaaagaaaaaagaaggtgagagtaagaaaatgtacccattcacttggtgaatattttttctgtacctgccttgtgctaggcagtggcctaggcactggggataaagaggtgaatgagatagacaagggctctactatcctggaacctataagttctaatatgagaaaaataaatgaagaagaaacatcaagtaatgataagttacactctggaaataaaaagagtgatatgatagagcctgagaagccaatttaaactgcagaacaggggaggtctccaaggaagtgatatttaggcaagtggtttggaggtgagaaactatccatacacaaactccttccggcaaatcattcacaaaatttaactagttttattaagttctaggcaagtgctggatctactgagaccaacaaccacattttaggctttttttgcacacaaaatacaaagtatgtcttgtcctcaaagggcacttataatccacatttgaaactgattaatgattaataaagaataagggtctaacactagtaccttaccactaagccactttctaatctaaaaatgagtagattagaaagctgcttatgaaatttctacccagaaatcatgacagcaggcctctcaaatatatagttgctttctcataactagttagtcaaaggtagaaaaacaattaaaattgctttagttagtatggcttactgcctactattcctgtcgttcctacaaaaagaagtgtgaagaaaggggtcgtacagtaaagtgggctaagtaggatatctcaggcaccaatttttaactcctccaaagctaggcattgtatatctccatgaaa

SEQ ID NO: 126224 - DNA, 1050 bp, Homo sapiens
aggagttctatttataagcgtatagtattcaatcaaaaaactcatgttgaaaattcagataaatagctagcaaaatcacacattaaaaaatacattgaaatgatgtatgtgtaatctaaaaaaaattaatatacgtgaaatgcagtgaattccaccttaattttgggcttgatcttgggagtctgagtgactacagtgtcattgacttgagcatgaaaggactaagtatattcctgctggagtcaagctcgcatattaacacagctccctttgaatttctgtatctgtgggttttggtgtaggcagaagacttgccacagaataacaggataattcacagtagaactttcctttcctggatttgcttcctgttcatacatgctttatcagtaaaatgacttacttttaaatacatgaagtcacagaattgaaaattcaaaatagaaattgcttaaatacagcaaaaaaatctagttattcaagatacttggggaatcaggcatttgggtttatgaaaccacatagccataaaatataaacaaacaattctcaaaatattaaaatatatttaatatggaaacttctttgaataagtagtttttgtgtaaatgtgacattttaggaatttgaaatgaattttgggtttaccagttatgccacacttaacttggattggtgaagcatggaaatgaaaaccctttcttaatgagactttctaaattttaatatgatggataactcaattttaaagtatagtttctattttttatagcagctttattgagatataattcacataccataaaatttttagtatacttgcagaattggtcagccacaatcaattttagaaatttccatcaccccatccctggctcacattagccacaggcagctgctaatcatatgtttttttctggattggcttgttctgtacattttatgtaaatagaatcatataatatgtggtcttctgtgtcttctacctttcacctaacaatgttttcatccatgttgtagtgtataccaatatttagttcctttttgtag

SEQ ID NO: 126225 - DNA, 1296 bp, Homo sapiens
catgccccaccctgctttgtctcactgtctgtgggctgtacccactctctaaccagtcccaatgagatgagctgcgtacctcggttagaaatgtagaaatcacccatcttctgtgttgaccttgttgggaactgcagactggagctgttcctatttgaccatcttgccagccacctttttttttttttttttttttgagatagagtctctctctgttgcccaggctggagtgcagtggtgcgatttcagcatattgcaacctccgcctcctgggttcaagcgattcttctgcctcagtctcctcagtagctgggactacttaattttacattgttaagagtaaacagggttctgtattctgtatataaagaactgacataaggaagcatccttgagtagtggaaatgggttttctaaccatggctttagtatttaaatcttctgtacctctaatttcttacatagtaagtggaagttcaacaactggaagatctctgtggtctttagcgtcctcaccctctctctatgctttctcattcagcaaacatttgtcaagtgtctactctgtggcagaatttgtgtaagaacttggggatagtctgtcttcagatgagctcagagtctagtaggagagaggggaaagggacaaaagagaaaaaaaagcaatacttgtaagtcaaccgttagaagccagtgtggtgagtgcctcaagagtgataatcacttagtggtggaccactgaggagcctcccactgggggtcagggtgcagtgggggaggtctaggaagatttcttggtagaaatcacatttaagtaatcctcaggtagtcagccaagtgtattaatgggcaaatggcattttatgacaaaagctacttggtaatcatttcatgcttgaaattttggataaatgaattgctaaagatgaccaagcaagaaaagactgcaacgctttttttctttattacccatggccagatttcctagttattttctcattgcaaaagaatgtgaaacaaactgattaagtgtaaaataactcttaactcttatttagactatcgtagtcatcttcaaaactctttgagatcatcttgagaattcacagttttctattctttttgttgctagcaggtgaaattatgtacctttggaaccctctgtatgggtcagtctgtggtactcacagtagtctttatataggagtgtttgcatgtgattgcaggtcagcggagaagcaaacaaagcaataaccaaaaaaggtgtgctgaaagttgctgtttcaactcatagac

SEQ ID NO: 126226 - DNA, 1083 bp, Homo sapiens
cgtagagacagggtctcattatgttgcctaggctggtctcagactactgagctcaagcaatccttccacttcagcctccctaagtgctaggattgcaggcatgagccactatgcctgacctcagaaattttaatttgaggaaatgtagacaccatttaggaaattgattgtggttttaggatcctgcactctggcaacaatagtaggctttgagagatgaaggatgtgatattggatgaactgcatgagttaaggatgaatctgagatagaggttctgaaacttgagtgtgtattaggatcgcctaaggagcttggtaaggttctgattttggcaggttgggtaagaggacagaaattgcatttttaaaggcagtctcggcatttctgatgtaaatggtaaacaagttcctagccagagacaccaggataatcatagatagagaaatggaaattaggagaatagttttataagatgaaatggtaagtttagttttggataagttgagtgttatctttatatattgcaatgagtttgatgacaggacatccaaatggaacgagctgtccaataaaaatagatctttgtgttggattgtagtgtgagagtggatgatgtatcagaggaaggtgttggaaaaagaacaagagcatgtccttttcttctgattaattcatctaagaaacactggggcagtgatgggtctctttagttacgtcaggtcaacacagtttcattcttgtttctcttctaaaaaaacattgacgcttcttgttttattttcttaactcctgggaaacgtacataaatgtctttgccacagtcaagctggtcttgactggataacagcattttcaatcactaaagtcagctatttgagttgttcagtagaggcacattaaaataactcataaataagtcaagacaagttatagagaagagaaagttatagagaagagaaaacagaaatggtgttttaatttgaggaaatatagacaccatacaggaaattgattgtagttttaagatcctgggctctggtaagcagtaatagaatttgagaggaaagtttatagtatctgat

SEQ ID NO: 126227 - DNA, 1024 bp, Homo sapiens
aatgaactcttctcttaatttggaaaaaaaatactgtgttgcagtctttagaagaatcttagtatataacatactctggtctcaaaatcaaataagcagtgacattgtgctataacctaaaaattgatatgaatcactgtgataaaggaagtttactctagtttattcatagatgaagaaaagtagcctggtagcttgaagctgttcttttagctttgctgcagatttataaaatgttcaacatttccatttacctctggacaggctgtagtttttttttgtttttttttttttttttttttttttttaaggattaagatccttgaagctagaggtctttgaaactgcatctgagtggaagaggtctagtgtaaagtgactcattcttaaacatattcagaaatgctgtgggccaaattgaatcccttgaaatataacctgtatacacagtttccagaacatgagctagttgtgtttcagaagtttatgtgtaagacagctgtttggaactcagaacacattttttttttccttattgaagcagtacaaaaattactggctatgttcccaggccagttcacaaatatttttcacccaaatgtactttaagtattaactgtacaatttccatttattgagttgatatttttgtttctgtgggaaaatatatcccaaatcagtttgaaagaaataggttatctttgcttagctggattggggtcttctcagaagatgtcactggtcattcataaaaaccagtaatttattaattgtacatttttaaccccttcctctcaattataaaggtacaatttcaggttattcattcccctagtgattactattttagaaagtagccccggtttctctgtcttcctctttctttactttctcttttctctctaaatgttgggtcattattaagtttatgtctctatatcagggattgtgtgttcaggtttggttacaaaatggttagtgctcctgtattttttttagccagcattgattaacagagttaatc

SEQ ID NO: 126228 - DNA, 1268 bp, Homo sapiens
gcctcccgagtagctaggattacaggcatgtgccaccaggcccagctaatttttgtatttttggtaaagatggggttttgccatgttggccaggctggtctcgaactgctgacctcaagtgattcctccgccttggccccacaaagtgctgggattataggcatgagctaccatgtccagccaacatcaacatttgtagtgatagaatttgagttgtttagatcaagtttatggtgctttctgggcaaattctgaagggagagacagttggtttactattagagtttacttgtttgagcaaactcttttattttgttaatcagatttgtcatatatttgtagtgccagattacatttttagtttttctgcaataaattgtattaaattcagtttattaatagccaggtatatcctgtatatctccattagtgagtctttataggagagtgtagctgttaatcagtgctgtctctgtgaattttcttggagatctctcaatgggatttgtggtttgagtgtatcacccttaggtttttacaaaagataataagcactaatgttaaatgctacttagcaaatggatgcaaagctttgacagtaattttaggttatttctagatagtgtggacttaaaaaaagttttttagaaagctgttttcagttgacttagagttacttgtaatctgttattatcaaggtcaccccatggaagatctctgaatacccaatgaggcaagtgtcattattacctcttaattttctccaggggaaacaccaaattctgtggtggcttaggtgaaggagtaaggctctttactcagcttttgtttttaattgtaactgtgcagatgtctcctatgtcctatggccagttatttaaaatagtgaaagccaaatgctagtttggtggtgtgcaggcataactcaattatctgacaagagaaaaagaatggttgagtatatgttactttggttgacaatgttaaaggtatttttttttggttttggggtacctttttagtatttacctgtaaggattgaaatattaagtcagaaaattcataatacttgtgaattggtataattgtctagactaatgcttcttttaccattggcgtaattgtctagattgatgcttgttcttaaaatttggccacaactctacactctaagctggggtgtccaatcttttggcttccctgggtcacactggaagaagaatcgccttgggccacacatgaaatatactaacaatagctgatgagct

SEQ ID NO: 126229 - DNA, 1033 bp, Homo sapiens
agtggtcagcaaactgactttctattgggggtagtcagttgaacctccatgggacagaattttcttgcatgtctccagactagaataatttacattgctctcagttatctacagcagttaatcaacaatttgagttgcagtatagctcgaagtcaatgaaaagctagaattagaaaacgtggaaggttttgtaccacaaagtccatattttttcatcttgagtgcactgtcatcttttttctcattcccaatttccttacagtggctttttaccaaactcctcaggtgattctgatgcagtctgaagtttgagaaccatcggcttaatgtaacagacaaaatatttagtatatttgtaatacttatttactaaatcatgttttcttatacaacttatttcttatacagattatttcatacgtagccagttcattatttgaaaaatcaaggtcagattgcccctgttagctgatattttaacctcttgattgcctataaaggaattaaatatgcatttatataataaagtagttgtgaagtttttgaacataattagaaaaaagactctttgttgatcgagtataaaatgtgcttcatgaagcgtttgattagttaaaatatgaaaaattttagttgaagagcttttaatagggcttatctttagtcagtcattttatacataataaaatgcctctcacaattctgaaaggacctagcgaatttaagaagctgggtgatgtaatataaagagccctggatttaggaggtcagtcttagtttattccctttttgtagctagtaagttatttaatttgtaattcacaatggtggtgagggcataaagataaatgcatcacagctcttgtgatgacataagtgcttgctttctggatttcagttttctcatgtgcaaaataaggattatagagccaaatgagacccaaggttgtcttaagcactaacattatgtgatactttgaatattgcacagtggaaaacattaaacaagtgtgtgctaaatcggagttgttca

SEQ ID NO: 126230 - DNA, 1742 bp, Homo sapiens
ctggtctcaaactcctgacctcaggcgatccacctgcctcggcctcccaaagtgttgggattacaggcgtgagccaccacacctggccagatactctgtatgtttttggtctctaaaagttccattttcttttatatatcttccattttttaaatcatattcatattttgttgtaaatatttgagcctatttatattaattattttaacatttccatggtctactaagtttattatttcttagatttttgggtctgttctagtctctttttttcacccatttatgaatcacattttaaaattcatatctgaaattttttattggatgttggatattatgactattatactattgtctagattttattatcttcttttaaattttttgaaatttgttttgagtgctgtcaaagctactgtggtttagcttcattttttgaggcttttatcaaaacttcgttatagtgggtctggtgacacccctgtggaggcagggtagctctcctactaagatgtaacactctgctcagtgtttagggtgtttgagtctctctattcatgtctgtcagaactcaagcatcttgcagcccagtgagaccactgggaattatttagcttgcagctccccagtaataggtcacccagtctcatagaattttctcctctgtgtatatgtgtaacttagtagttagctattggcgtaaggggcctctgtgaagatttctggagtttttctctgccaagctctgagctcactagtactcagccctacaaactctggcctcttcagtctccctagagtcttatttttaactcctcaaccgagtgagactgctgtgatctacttgggattcctagcctgcactgttatggaaagggtcttatggaaaagggatttactcagtttttttccttcactcatggatcataattctgggctgcctgttgtctcaatgtttgaaaaaaaattttttttcctcagttttctagtagcttacagtaagaaggtatggacaattttacttattccatcatggcagaagtggaacagtttctgtttttaatagaagaatttattttaattgtgactttgaataaatataacctgaggttgtttatttttcttgtttagtgagtagctcttcacagaattagagccctccctccttttttaaaaaatgaaattctacacaggaccccaatatagaaaatagttaaaacttcatctgctctcatttaaattaggtttatagctctgttggtctctacctaacaccaaagcaatctggtactcccaaaaataaaatttgaaaacctgtgaactatttacccctctcattttacaggaggaaactaacttctagaagggtcaaatgttttgtcttaaagtaatgaatcttaaactgtctggcttatatgagtttttctagcatttgaaataagacctcttatatcctaactcagtgtctgatttttcttagtcagcttgattttttttaaaaggtctctttgattttgagctgtttcagcatgagattcttgagaactccatttcctattaatctttgtatggcgcattgagtccacatgggctctgttgtaacttctagctgtttaaacaatcttggaatagtttatattaaatccagtccaacatttggtttattctgttttctcacacttcagtatataagatttctgcttatccgttttacaaaaactgtatgaagatggctacatact

SEQ ID NO: 126231 - DNA, 2926 bp, Homo sapiens
caaatcttattttatgtagtaattgatgctttttcatgtactcttactatagcctacataatttgagttctttttcctttatttttttcctttttccaggtgaaaatttcctacctattggaaatataatttgtagtttttgactgatttatcttatattgataaaagatagggcatttaggaagaatttttatgcatattattttgttttctccctcaacttctttgtaaggtaggtgaacagatgaggtaaatgatgcagataggctaatcgtctctctccaagtcacacagttaagttgcagggttaggattccagggtcattgttccttttgctgattctacactatctctgaatattctctttcaaaaaaggatacataatctatttgctttagttaacgcagaattgacttgcaattttggttaaagagaatgaaaaggaaatcactgtatttagtgggaaaatgtcatttcaaaggttgattctgatctttaaaaattgtaattgtaattatcttgtgtagagccctgtgtcttaacatcctcatttaataatttgtttgtcatataagcagatggtgagaaaacagtgattcccagatctgtcattactgctgtggtaatttgatgttttatagttaagaattttgactggtagaaggctgatctagaattcacatgtctctggggacctgtattgtttggatttggaggtatacttgtatttgaattcagggaaggctgttataaataaggacttggcttgcatgataagtaacatttctttatatagctattcagttgagctattgaaagtaaaacatacaaacaaacaaacaacaatagcaaaaaacgctttgtgttgttgttgacagaaaagttgaagcttttcaatggtgttttcctctctcatgtcgcataaccatgatggtgataagcgtacaattatatataaaggcaaaaaagttcaaagtccagaggtattaaatctttatggtaaatgagagcctgtaagtcatgtaatacactaagaagtatgttctgaaaatcttaagagatccaattgccatgtgactctcacaatgttatcctttatgaggagaataaaaggatgcttagtgtgacttttgcaacatcaagcccagttgaaacacaaattttattttgatttgtgagtccaatccaaccagttatttttcattttccatttaccatcattttgattagtattttttgttaatcagttcagagttactatttgcagccctctgaaagctggagcctacattagaagttttctaaatgtattgaagacaaagccatttattaaaatctgatattaaactgtcactttccagaggcatatttgaaaaacagaaaaacaaacaaacaaaaaaaacacaagggaaaccatagagctcttcctgagatgctttaattcaggagtttctactcaaaaagttaatcactgacaaaattctttgaaatgttttagtgttcgtgtgagtgtcacaagccatgctttttagaaaccagaattttgtaataagtgctctctctgcagcaattaaaaagtggcgtcatctatggtaaacactaagttggtctattgagagggaaatagctagcccttcaaaatacctttgtgggagtgaaaattacctttcgtactgaaacttactaacccccagtgattaagaggccatttcatgttcaaaaacatgttattaaaaataatgagtgtgatattttaagtacatgactattactacaaaaattgtaatattatagattaggatttattcatacactgaaggtctcatatgttgatatgaactatatttcatttaagaaggccttgggaggaggagtcaggatcatgaacaatctgagagtttatccaagacctgtaagttataagaaggaagagttgagaggtagctgaggtgggtgtctccaggtaggacacgtgaagatgggaataagttcaggggacctgagaaaggtgcttggtgcctaaagtcagaggaaagtcaaattagggattccttttagggaggtgaggagagcaacttagacgtgatgttgcatttgtgagcttggaacccagagttaaaagaaaatatacagaattgaaaaatattacctggcctaaaattggaagtagaatgatttcgcaggaaagaaaagtgaaagaggaactatcatctcctaggcaaaaacagaacagtgtagagtcaggaagaaatcatgatttgtcttcaagctgagattagttaattggatggcacagtataggtgtctaacttacccgtacatagtttactctcttcaggtgtccttaaactgtgatgtaagtgttcatctgaatttactctgtatttacattctatccatgatgtctgtaatagctatgactataaaagggagggccagcctcattactccttggatggctacactgcagtaggacccagaggatgtgagtatgggaatctgatcctgagtcctgctggttggagagttgccagtgtcatcataacttgtaaaaaaagtcccataagacacttgtaaaggataagtcttaaagtatgtaagaataaatcagaaaattgccttttttaaaaaaaagctttttaaaaagctttttagctggtgattgtgtctttcttttctttaggattctttaataagtaattttagtaaagtgtcattcttagttgctaaagaaaacagtcgtctcctgttttcagtcatcagattcaagcctattaggaaaaacttgaataattattcttacacgtctccattaatatgaagaatcatgcataaaatgtagtccatgcttatctctaaaataaacaaggaaataaaatttccgggttctgttagttgttagaaaacatggtaactcaacttgtt

SEQ ID NO: 126232 - DNA, 1064 bp, Homo sapiens
gaaaaaataaaatttactacattctaattataaagagtactttgccatatcccttacccttctcaattctgatatggtctcctggaggtgagacagggtttatttgctaatagcctgttgagcaattcagttgtcttaccattgtctcctttccctgcctgatcttttttcattgaatggccataataattttttttttttttgagagacggagtttcgcgcttgttgcccaggctggagtgcaatgctgcgatcttggctcatcgcaacctccacctcccaggttcaagcaggtctcctgcctcagcctcctaagtagctaggactacaggagcacgccactacactaggataattttgtatttttagtagagacgaggttttaccatgttggtcaggctggtcttgaactcccgacctcaggtgatccgcccatctcagcctcccaaagtgctgggattacaggcgtgagccatcgtgcccggccataataaatttttgaatggccatcctaaattttaggtgcctcattggagtacagagttttgccatagattgtaaattattctagggagatatttttgatgctattgacatttaacccagataattctttgtcatgggagactgtcctgtgcattgtaggatgtttagcagcgttcccagcctcaccccaatagatgccagtggtacctcctcgcccaatttgtgacaaataaaaatgtcttaagatgacgttgcttgaatgtcctctggagggcaaaatctgcggttgagaaccactgctctagggcaagaaggtcttttgtgtttgtattctctcatttcccatacatatgtctcctcaattgtgttattatgtataagaacccagtaatttttacttaattgaaatagtaactttattttaaggcctgattatcttgtattgaaatggtaatttttatgttatagcctgtatgtatcaacaaatatgtaaaaacctggagaggaaatattgtataatccatgtatagtataaataagagttagctttaggtatctgttggatcgattttaaatac

SEQ ID NO: 126233 - DNA, 1052 bp, Homo sapiens
agatatgtagcatggattttattgtttctgtttgaaatttggggaaactgagtcccagaatttcctggttttaggtcttatttcacttgtcatgctggtggatgtcaaagatgcagtttatcaccattcctgtgtagctagccaaaggtatccatccgtgcttctcttggttgcataaaattatggtgagagttagtagatggtgcaggttcatggacgatttctcaaaatgcattttatgaaaacatgtcacagagagagaaaacttgatacttgtgtttttactaagacataatctttttttttttaaattgaatgagaaactgagatctagaggagcaagctcactattcaggaagatttactcatcaaactaagggtaggaatagtaaaactaattgaatcatttcccccaaatctacccttatctaaagcttatttcttcagctttagctggtcaatttctagaccaatgcccccacttccctgtaaccttctctggcaaaagcaatatatcttattatattctaccccacaatggtgagtctgactctagaacaacaaaatggggaaaatctgaatctagaagttccatttttcaggagaatctttattttgggctatatagcctgtgttgtctggaaaattgtcactgagttcttttagtacaattaagacagtctgctatattacaaaatatatacaaaagtgtgtaaaactgtcttatattgtgtataattacgagtaattataaaataaacacctgtgtaaaccacctcctacattaagaagtagaatattgtcttcacctcagaagtctctaattcttagaggtaaccactgttcctgatttaacagtaatcattctgttacctttaaaataatattatttaatgcattcctaaatagtagtagtataccttactctttaatttttaattttttaatttttttattttgagacagagtcttgctctgtcgcctgggctggagtgtagtggcatgctgttggctcactgcaaactctgcctcctggattcacgccattctct

SEQ ID NO: 126234 - DNA, 1499 bp, Homo sapiens
tttaaaaattgttgaattttgatctctctctccatgacaaatgtattatttggagacttcacttagaaaagaaaaagaggaatttatgacttcatcagaagcctcattagggaatatgtttggctttcatgttgagttgtctttttttccttttctttttttctgctgttgtttgttcccaagaaattcacagtctttgaactcacataatttgggggatttcaaatactgtatcattcaaccacagctgttttagatatgccacaaattgtagttctatgaacttgattttttcccctgaacatggagaaaaagcaaataataaagaaaagaaaagggggaaaatttaaattgtctccgtagtaattaaataactcatacagccaaagtgctatattttagtagtaactaccttgtttttaatgtgacatcaaaagctgatggtttgtttctcatttagtgcagatgtgaaatagtctacatctctagaacggtttaaaagaaattatggtcatggtagagagatttaatttgggtctactccatgaacttgaggcattttccccacaaagaactagcagatgaatttaggtacattaaagaaatgattatagacagcttatacaacgtctaaaacttgggaaaccatccctctgtttaattttttaaattcctctcagatctcatttgttaataaccctattcttactcatttttattccttgcacttacccagctttctgcttgggataattttcagtgtgatagaatccacttgactccttcttcctatgccctttcagtatagtattgaagaggaattcattatattgaatgaatgttcttaaatttgtttcacttacttcctctctaataatccattttcttctcagtttgaactttaggtatgggtaatagatcaggaattggggagacctttgttctaaataattggaatgaccatatttgtcaattagagagatatgtagaccaatggttataaaccagagtactagaaattcttgtagaacatcagggaacatgtattctgaagtttgtaactggagagtctgattcagtaagtcagaagtggccctgtgaatgagtactgtaaataatcatcttaaataatactgtaaggattggtcttttgttcctttgtagattgacctcccaaaagttctacctttagttagattgtttagttgaatttataagtaaaaaataatggcttaggctaaattaaaattgttaactggactatttacagatcccttactaggtattagatgttataactgggtaagatagagaatgcaaggaatttcaatatgtttttcctggaaaaaacaaaacaaaacaaaattacacacaagaagatgtacatctgggccgaagatgcttttagagtggcagcttctttgttgtaatttgaaccaagtaaatgagactaaaggggagaatgtaaactgagaagagaagagggctgtggaatcctc

SEQ ID NO: 126235 - DNA, 2035 bp, Homo sapiens
ggaggttgttacacaggcccagtttcttgtacctaagggaccagccagacaagtaaatcacttttgcctggggtgatgtgagtaagtgggaggacctggaggcatacactaatggatatctcttcccttgaaaaataaagctgggaaaaggtgattgcttgtcttttagtcagtatttactgctgagactggaaaacattaatgcagtgataatttgctactctcaaatagcaggtttattgtaggtacagttttggaatttcaaagctgaacgtgatcttggagatcatttacttaactcccctcgtttttacagatgaggaagatgtgggcctaaaaaggtcaacttacttaagataacacaagtggaagagcagatcttctgagtcaccatgccaacgtctatttataagtaggaatgctaatgcattgctttttcaatagaaaattaagtgaaatttctcatttctattttcttatatagaaaaccaaaatatgagaatcttaaacacaataaagcaaattagtactccagctactttacaatgactactaccacttttacacatttcttttcaaatgctttttaatgcatacaatttatatgtgaggtgtaactgcagcatccaaattggaatacaagagggctccatctctttcatgtgaaaggactcattttgctgcttgtcttttttatagagaaccattctgaaagaatacaaggtagatatatcaagaatactctgtatctggaatttttttctaacataagctttgaatagctgtgtgaatgtgtacttctttccttgaatctaaaataagattagaccagatatggcaaatacgtttcttttgtccttcccttaaattgatctcatagttaactgctttggagattctgggaagatggctgcacttgcctcacattcttcacctggataatccaccacagggagcggagtcccatgccttgtggttcttttcatccctacttaggtaattgctcagctcccattgggttataacattctgcaactgtatattttagaagctcgtttttttttttctgaattaaactaacttataatattactgagttttacataaagttttattctttagactaatcaatatgctagaaccatctatagatgtaactcagggaactagttcttctgttgtcatatgacagattattccacacaaacacacatactaaaaaagccattgtgaactaagctcaggaaatttcaactgaagcatggtattattattattatgtttctcagcatgagcagtagttttccagaccctcagccaaatgtctgaaagaagataaagtacagtggactttcctataacatagtctgagaattaaaatcaaagtgtcccagtaactaagctgtcttaaatgggaagtgagatcttagattccctttgttattaaggatcaagtctttggtggtttttagtatttaaggtcaacactcactaatcctttttttgaggggtgaatgacagcttaactgcaaagcatagtttcagtttactgcctggcaaatacaagcttattaaaaaaaaacgcctgattttattttgcatttgaaatttatagaatacaaggtctttttgtatcatagtctcatcattgtaaacatcagttatcactaagtaaatgaacactggaagtgctattaacatatattttaagttaatatatagacaaatttgcttttatagtgtatggaaagacttatgcccattgatcattcatggttttgtaatgagcgtttttaagataacatttaccaaagctctatattttaataatccagaaaactataaagaaaataaaaaatcagccaggcacgatggctcaagcctgtaatctcagcactttggaggccaaggtaggcagatcacctgaggtctggagtttctgaccagcctggtcaacatagtgaaacaccatctctactaaaaatgcacaaattagccaggtgtggtggtgtgcacatataatcccagctacttg

SEQ ID NO: 126236 - DNA, 1007 bp, Homo sapiens
accttcttgcacataaaagcctgagctcagaaaggcccagtgagttggccaagcccacagcgtgtggcagcacaagttctcattgaccgctgccttacatgtgggccccatgcagtttcccctcaatattctttcctactgcagtcctagctaggttggctttttcttttctaagctaggagtttaagtatggaaataatgatattatccttatgaaatgctttaacttgtcaaaagtgtctctgtaacttgtaggtgttgtaaatctgcggtcttatttctacttacttgtaaggaagtcatattcctgactaccttgtcaaataccaaaaagttcagttttgcagccagagaatatcctgtttgaaagactttgtgatgactcattttatgggtcaacgttggtaggccacagtacccagatatgtgggtaaacattattctagagtctatgaagtatcttttagatgagatgaacatttaaagcagtgggctaaagcagattaccttccttaacgtggattggcctcatcaaattcattgaagaccttcatagaagaagactgacttccatcagagaagaggggattctgccagcagactgtctttggacttgaactgcaacattagttctttcctgggtctctggcctgcaggcctaccctgcagattttggatttgctagtccctactgtcatatgagacaattccttaaaatcaattttaatataaatatatatagtatgtataaaaaaaacacatataaagatattaattctatttttctggaaaaccttgacaaacgtaggcttccttgtgttgccgtttgaactagcatgctctctacctcccattatatagagtatgtttggttttttttcacttcttttttttttttttttttgagacagtctcgctctgttgcccaggctggagtctggagtgcagtggtgcgatcttggctcactgcaagctccgcctcctgggttcatgccattctcccgcct

SEQ ID NO: 126237 - DNA, 1054 bp, Homo sapiens
gttttaggtttgttttatttaatttcagaatactctcaaatgaactttataaactagcccgaatagggaagaacattctgatatcagagtgtttgggatcctgaaaaaaaaaatgttgggaaggagttatttatttgaaacagttatttcatacttactttatatatagacacacgcatacatatttatttacttactagtattagtgaaattgagtgatgttccagaatgaatactgtttaaaccattgttttgcagtcataaaccgggacctattagcagaagtagagaagtggtaaatattaatgaataatttccagtcatatctgccagtgatttccgggacgcatgagacccaggcccagctaactgttattttgtgtgtaaagcttgcttctataggcattttccattgcagtacactcaactatcaatgttttccaaaaaactatagatatgtgtatgtgtgtgtatatatattttggtctagggtcttatatttgaaatatatattccttctcttctgcagtcaaatatgtgaatttctgtttattcttcaagactcaggtcaaatatctttgccttcacaacttctttaccttctcaggaaaataaaaacaaaatagttggtatatgctgcttttatatcagttaccacattattttgtaggtgcttattttgatttctgtgtccttcctaaactgtaagctactagaaactattccttctccagtgcctagcacaatgtcaaacatgagtttagaactgtaaaatattgttgaatgaataaatgtgaataagtgattactaaaaatataagaggaagtgaaggatcaaaagagctgtctaagagaaagttgtaagtatgacaatgtaagaagaatattaggccaggcatagtagcttaagctggtaatcccagcactttgggaggccaagatgggaggattgcttgagcctgggaattcaagaccagcatgggcaatatagtgagacctcgcctctaaaaaaaaattttttttaattagctgagtgtgatggcatgtgcctgta

SEQ ID NO: 126238 - DNA, 1141 bp, Homo sapiens
aggacagtgttagaatggaggtcaggttcagtgatcttatgattgagacagcattataatactgacaccctgctacttcagggctagtataggtcataccatgaaacaggttcagtgtaggtatttgcttaggtagcttcaagatggtttaccttagttttattgggaaacagcagagcgttccagctaatatgattcattctgattctataaaaggcgataaatattgctattcacataatgtgttctgaggctactttgtctcttaaatgattaaaagtggtactatcgcttacacattttaaaaattagtaagttacttttatactgactcaattttccttttcttaacatctcaattgattttaaagacaaaacagttgtttagaagaaattcatcacatgaatgtttaaacttacatagttttggatacctggcaggtttttttttttttctgtattatcatcttgttggcctcttactacaggttttcaacacatactccaatgaagactatgacaggagaaatgacgaagttgaccctgtggctgcttcagctgagtatgaacttgaaaaacgtgtagaaaagctggaacttttcccagtggagctagagaaaggttcgtgagtgctacagtgttaatatcattatgttgctatgttaataatacagaattatttttccaaaatgtagccttttttctaaggattggataaaattttaattctaacagaggatcttatttattaagtttcaaaaatagttgatatggattctgagtagatggtggattgaaagttttactcccaactgaaacccatctatcttagctggctgcgatggtggttaggatcagggaggtataagtgaggcctaatgctttgttggtattcctggaaagggctgctacagctgagagcccagaaagagctggtatatgagagcttggggcagatggtcgctttcttttgttttggtggataattggaaaattatggagatttttaataaaggcggtagaatccaaggaaatttaaatagtagggctacatcctctccccctctgaggggagaaggttgaaagagagcagggagaagagggagcagaaaggcttccttctgatttctctcccaggaat

SEQ ID NO: 126239 - DNA, 1136 bp, Homo sapiens
ttctcacttataagtgagagctaaacagtgggtacacatcaacatacagagcagagtaatagacactggggactccaaaagtttacgagggtgggagggggatggggcttgacaaataaccacttgcgcacaatgcgaactattcaggtaaaggttacactaaaagcccagactcaccactatgtaatatatccatatagcacacctgcacatgtactcccctgaatttatacagatttaaaaaaagacgttcttgagcaacttagcaacaagaacaaatttcttgattttgaaatgaaaaatttcaccggaagaattgaaaaggatagttattgttgagacttaagttggcgatctagaagatgacgtttgagagatattccaaaaagaattctcaaatgacagagcaaaaatccaagaaaaatcatgaaagagtcccaatatataagttgtaggcaacagaagagaaaaacgacaatggagaaggacagactaataataatcatagaagaaaaatttcttgtccttaaaaagaagatctgaggcttatattaggaagaacttatccatttatgagtgagagggctaaataaccccaaactgatcccacacttaggcatagcctgggaaaaaatcctaatattcaaagataaagtgaaagagcttaaaaaattccaggccaaaaaatacccaaccaaacaaacaagcaaatatacttgcaaaggcaaaataattagactagcatcagactgtaacactagaagcagggagatgtagaaataattttacatgccactgagggtaaaaaggatggtgatccaagaatcccatatccatcccagaaagcatttacctatcctggtgaaagaaagacatctgctgctatctaaggatttaaagaacacattgcctacatactttatctgagtaattcactgtccaatttagcagggagggagtgaaacaaagagcagcttgttcaaaacagcaagggcaaggaaaaaagaggtgaaaactatgaagtattaaacatacaattgcttaaatgaaaaagtatgaagaatactagtcatattacaccaaacatgactgatggattactcctgttaaaagacactttcatttggagttaaagt

SEQ ID NO: 126240 - DNA, 1032 bp, Homo sapiens
aaaattattctgtgtatctctaggcagtctagaactcatattctagaattctagatcagcagtgaacaaagtgaggatgtctactcttaccccttctttttaatatatgttggaagttttagccagggcattaaggcagtaaatacatagacaaataaatagacagataggaaaggaagaagtaaaatatgtatttcttcatagtagatgtgatattatatatcaaatgattctaggaaatctgcaaaggtactaggattaataaatgactttagcaaggtcgcagaatacaaggccagtattcaaagatcaattatatgtctatactttaaaaacaaataaccagaaacagaaatttaaaagccagtatcacttacaataccaaaaaaaaaaaaaaaatgaaatacttagaggtaaatttaacaaacattttttaagacctatatactgaaaaccatagtatattattgagagaaagtaaaaatctgaatgaatatagagatacaccatgttcagggatcagataagtcaattttgctaagatgtcagttctccacaaattaatttagaattcaaagcaattctaaattaaacccaatgggctttattttagaaattgacaagctgattttaaaatttatatggaattgcagaggaaaaacaattgatacagagttagaaaactcacaccacctaaatatttattatatagtaatcagagaagtgtgttattagcatatgatgttgaaacaattcattatccatttagaaatacaaaaggaaactccacccttaccacacatcatacatggaaatcaatttacaagatatcatagacctaatataaaagcaaaacataaacactttaaggagaaaaataggagaaaatcttagcaatcttaaatcaggcagaggctttttagataggaagcaaaagccatcagtttttttttttttttcttgagacagggtcttgctttgtcacccagtctggagggcattggtgcaatcatggctcactgcagccttgac

SEQ ID NO: 126241 - DNA, 2051 bp, Homo sapiens
actccgggcctcaggtgatccacccacctttgcctcccaaagtgttgggattataggcttgagccactgagcccagccctcaaaatgtttttgaagtaatttttgttatagttacacaaatgcttctttagttcaatggtacaggaaattatgagcttgcttctattttgtatggcatcaaaaatgtgtaaagtactgcagaatgggttacgtatattacatcttctcttaaaatgataatttttatggtcctttacttttttcccccttcttttcctttatgagctgtgtccctaaaaatcactttaattgcacatctaagctttcttctcacccaagaaaaccattttgaagtacgtaggtgatattactttcttgaggcttgatggaccctgctgagatcaaacctgtttacttttcttaaaactcctttttgttggagagtcttaaatattagtctttgttaacctttccacagatttgttattgggcgggaaaaaccaggacaagtgagcgaggttgcccagttgataagccagacactggaacaggagaggcgccagagagagctgctggaacagcactatgcccagtatgatgccgacgatgacgaggtcagtagtgcttgcaaagattctttttcccacattttctaattcatgaaactctctctactgtataacagtatgacaggttttatgcagtttcttgaggaaggtgtgtccacattgaactaaaattctaccttagaaaagaaatactactcgcatctgatatacgcttaagaatcaagtcatggtatcctgtttacagtatgaagactgtggacacaaataagtcttatcttttgcactattataaaggaagtcatagaaacagaaaaggataaaaacacaaaaatgtgaataatgtcatctttattggtggaattgggtgattttctctctctgctttatattttttcaatcttttccaaatgttctacaatagtatgtaatgcttttccaaaaaatcagtaaacacacccatacacaaacaaatatacatagaaaagtactaaagattgctgagtgtttccagtgtctttttcccccaggaagaaaaagttctttggatctgcttactatgatttgtgctaacataatgcagaacaaagctttccactagcacatgttccatagagcagatacatattggaataattttacatcctgctttctgtaaaagatcaagtaaatgaatagaagctaacccccaagtgaaaacagctctccagaacccttgtgtgctgtaatataatacagatgctggtctatttctaatgtctttgaaatgtacattgatataatgggacaacatgctttattataaacacgtttaaacattcatgtgtttcatattggtgtgtcaaaagatccatcaacaatttaattgtagtattttatactccataaactagtacatattcaggtaaaacaaatattcttcattccagctaatataaccacagtgaaacttcatgtattcaaccccttcttatctgaatatataatttttcagaattttgctttctagccaggatatagatattaataaacagacattcaaatattttcacatatttttaatctgagatgttttaatcccaatgtatattaagatctcatgaatatgtggtataatgaggatatattctccacttatagcagaaaattagaggtggtatatccgttaacttttgatcaaagaataatatattagaaatcctttaaatgaatgaattagactcttagaacttgatttaatttattttcttacttggtgagtccatttgaaatggcaagtatattttcattacactgagatattttgtatgaaaaatgttctcttgaattttcaaactaaaaaagggatttcctcaaatattttgaacttgtatcttacctggttttcaattctttacattagtattttgtattttatcagagacactgatttgcttttgctgcaagcttattctgagattgtagaatcattttctgcaggtttga

SEQ ID NO: 126242 - DNA, 1065 bp, Homo sapiens
ttgtcacctgagcagatattttcaggggcaaggaaattaagtaaatattcagtggcaagcactttgcaaggtgtctttcttacatgatctcatttaatctttaatgcagccagaagagattttctttttttccctagaaatgcagcaactgaggtttttttctagtggtacatccagtagctggcagagttgaaattggaataaagtcttgctggctccaaagcctggactctttgcaacacactgtgctgtttttgagtagcatgtaagaacactcctgcagacacagaataactgggtaacaaaagatgttaagagaattactgtttgcggtgatggagtttaggttctatgattctttgttctgtatttctaataatagggaaatcaagtctttggataattattttctctatgcaacagtccataagaatcatctttatagagtttaaagagaagaataattgagtactcaaattttttttaattagtttagctttaagttaaactgtttttctttctgcaagttgtagaagtaaaaacgaggtgcttgctatgttactccaagtaactcactttatggaaaaaagtcaaggagacttctcctttgtatctgtctctcatcctctgtgacttgggttttttccctttcttgtatgttacacactgcctcaacaaaacatgcccagataaaaccaactgttaattttcagtgcataggagagatgaaagctgtacaaatagtgaaaatccactccaatgttaaaacttcaaattgtcacttgattcaaattcttttttctaatgctgaaaaaattattaaatggattgatttgagtgctttttccctattttctatttactctctgtctttctttgtgaatgaagaataaaatgtccaagaggcataaaggaaatgagaagaacaaatattggatagctaatggataaatgctccttgaataattgagttaatttcatatataattgaacaatttattgattagtatatctttgttaatcagtcacttggtttttttacttttatgatttatagaatcatct

SEQ ID NO: 126243 - DNA, 1037 bp, Homo sapiens
gtaaacaagagaatgcaattattatggttggccttttaataatgtgaatataataatgtaaatagactttatactgtatctataatactgagaaaccaagagtgtgggcattttttaccaacatgccgcaatattgtcttagtacttaacagtgtgtattacagtaagcactgggactcagtgtttttcaatcctttatcaggctgctctctgcggtgggggttaagccttctttaatattttttgtcaaccattttagaacactgtggctgaattgcaaggaatgtctggcaactgcaataacaataacaactattttcttaaggtttgttttttggtttaaagtaatgcttacctgtactttcctgcttcatatgtaaaattaaatattctttgtgtcttattaactatctgtatgttctgaagaacttctctagagtgatgtgttttgtgcattgaataatagtttgaaaataatcattcaaaaaacaattctgaaacatagcatatattttaggtataggttctgcaatttagactcatttcttaatatttagccatggatatttttaacccctaacactttaaatatcttgtgattcaaattaaagggaaaaagcaaatgtccaacagcaggtctgtatgatgtttacacagtaataatgcacatagtgatttatactgtctgtaaatccagtacttttttagaaaataatcttttgatacaaaattcttgatttctcaaaacactaaatatatctttaaattatagtagtatttagttgcatgatttatatggtagacatatcaaaatatctaaaatatcaaaatatctaaaatgatactatactttaaataataaaataattctcgttatgtttagttgctgttaatatagatagcagtgcttaaaaatggaggttgagtgtatgtaaaaggcaggctgatttatggcaattagaggaaactgaagaataaaggaaatatatttaacagcctgttcacagactccaatttggtctaatctctaaaatcat

SEQ ID NO: 126244 - DNA, 1034 bp, Homo sapiens
cttcatcataaagctggaaccccatggactacacctttctgtaaggtgaaaataaatctatcaccccagggactgcatggaaaattgccagtgtcaaaccttgggtgctgagtggaaaagccaaaaaaattttttctaacaaattatgatcacaagtagccttaatttatgttacttttcagaagaaaaaaaaaagcatatctttccttgggcgttcatctttactcaaagaaaaaaagttaaagtttcgagaaatatgagttgacggtttcaaggtacaaagttcgcaggaaaataaagcaccatgagtaaaaaacagcagaaaatagaagaaagggagggaggaaaagaaaaaaaagagaagaaagaaaataaatataaggtcaaaatcattttattatcaattataccaaactagaacaaatatctccaattgcatataacttattccagaagacagaaaaacaaaagtagtacaactttgataccaggaatgcagtaaaactttgacagtgtgagatgtatgaagtaataaaacataactttggtaccaaaagctaacaatgatgagaaagaaaacttataggtccatcccattcataaaaacaatgcaaaaaggtcctaaacaaaatattagcaaaccatatgaagcaacatataaaagagataatatatcatagctaggttgggtttagccaggaatgcaagtatggtttaacattggaaaatctgtcactttttatatttgacattgtactggaaggcaagtaaaagaaattaaagaaataaattgtaaagaaatgaaactgttattcacatatgatgagattgtctatttaaaaaatctcaaaaagtacctatagataagttattagaaataatataaagttatagcaactttgctgaatacataattaatgtaaaataaaacatctatttcaatatgtctgcaaaccaggagaaaacataatttataagttaccatttacaagacttcaagacataaatgatagggaagagcttcatagagaaaa

SEQ ID NO: 126245 - DNA, 1027 bp, Homo sapiens
agccttcagatgattatagagatccctccaaaatgaggctactcttagttactaaagggagctttcctgagggataactaatttattatttgtatgagccctacaggcaattgtccttatgattaaagtcatttaatcagataagatcttatgaaaatggttcctgattttaggtaatgtggttattggtaccacctcagtcctggaaggcagtcatgtcagcctcaaccttttggccagggtttttctggacagtagaattgctctaacccctagacttcctccttgtatgccaaggtttgagtctatgtaattattgatcctgctgtacctggttcaataccttaggccaagtggaaaggtcaatacagaagcttaaggagaaagtcctgggtttctaaggtatatcctgatggtttatgggatttctttaaccagttgggtctgggagcctagagaatatagttgttatcaatgccgaaagttagactaattctgctgcttggaatcctattgatagtagtattaatcatatgctctgagatagactgaatggctttggtcctagccactcttggttacattgatcagtgtggccaagggaatgccatactcggagaaaattcacctcaagccaagactgtgtagaaatgagggtggacgttgtttggagacaattcctccatgggttctcccttctctgcttgttttttgagcagcagcagcaccagcagcctatgtttcagattatctttccaatgatgttggtatcattgggagacagtatgtccctttaggcagtgacaggtttgtttatcactcattattcaaaaatttgaatttcctaagggcagaattcttaagattttattggttgtactatctttctttctctttctttttttttttttttttggagacagagttttgctctgttgcctagactacagcacattgatgcaatcttggctgactgcaatctctgccttacgggttcaagcgtttctcatgcctcagcctcccaagt

SEQ ID NO: 126246 - DNA, 1135 bp, Homo sapiens
gcccttaacattttttccttcatttcaactttggtgaatttgacaattatgtgtcttggagttgctcttctcaaggagtatctttgtggcgttctctgtatttcctgaatttgaatgttggcctgccttgctagattggggaagttttcctggataatatcctacagagtgttttccaacttggttccattctccctgtcactttcagataaaatcaggaaatattctgataacaaaagattgaaaagaaaattttgaatgagttgataagtgggagaaaaaaataaatatatatgctgggccaggcatcattttggatattttgcatatttcatttcttcgaatcctctcaatatcctatgagattggtatcttttacaccattttatagaagagaccacaaaagatacaaactaaatgacttacttactgttatgcaactgggacattaggatttttctctcttctggccctcatctctccaaccccaaatgctttttttgttgcattagtttatggtgttgtcctggagaaataagggatggtgaaaacaatcataatcataacgtcatgcagtcagttagcatattctaggcactgtggttaactctttcatatcactacaatgaattctcatagcaacctctttaaatgaagaaggtgctgttatttccattttatagatgaggaaacaacattcaaagagactaagtgtactaacattataaaattaggacacacaggagtcactgacaaaaaaatggaaagagagatgcttcggcagagagagggatgtttttgccgaaaggcctctggatggttggtgcagatttaggaattttaaacattaaaatgtgagtttgacgttttcctcctccagggaagaagcagctctcctttattctctcacagaagtgcgtctgaaaatacatagcaccaaattcaaatccggtaaacaaattccatcaaaaactgcataattaaggctatttttgtgattagcgccatttagtttccctgaatttaccagagcaaacattgctacagcaaaaattactgctaatggttgaacctaacaacaagagaaaatccccagaagggtcatttaggccccagctgcagctgtgtttcacta

SEQ ID NO: 126247 - DNA, 1029 bp, Homo sapiens
tcccttccaactctgtgattcattaaactccccttcccttttcattgctctcagtattgggtggcgtattcacaaagagaatttaaagaaatgacttatttccctcagcaacataattttatttggtaaaataatcaaatactcagaaaaaacaactcttgtttctgtattaaagatgccactgatactagtagatttttagaaacgcacttgtatatggcataggtttgtcactttggatctttaaactaacatttgtttataacattggctgcatgaggcatgcttggctgaaaaacctacttacacttttaccatttgggtacatgtcttacttgtcttttataaaatattttcaaataactcacctccacctggggtaaggacagctggatttctgaaatccccttcctttcagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagaggtatgccactaagctgcaaaatatttctttatgcctgtccatttcattaagtatatatttctgttcaaataatatattaagaataatcagtttgcaaatcaaagctttttaataacaggttgtcttgagtctcattgaatttcaagtagaatttaagtagatctcgttccacggtcattgatttaaacgcttatttgtcatagtgacatacctgtagcccataatttcaagcagtaacttaaatgtgcagttttatgatgtttaagttatattttttcagttttacagaagttttggtaactagtgataagcttttctctcaaggcagagacttcctaaaaagtctctttttgtctttctgttcatgaaataggtttctaataagcatcagatggcatacccaaagggtttacttgaagagagtttaatacacagactttgaacagagttaatag

SEQ ID NO: 126248 - DNA, 1052 bp, Homo sapiens
ttacttatttaaaaaagagctgtaattacaggccatcaactacatccagcagcagcatcattaataacaagtttatgagtacctacttagggagtgaccttgttagagaatctcacccaatgctacatatgctgccattagtgttaccattcagattagattgtgatattgttcagtcagccagttttagttcattttgcatacatgattccctaagtaaaacactttcgttaatactggatagataccatatgtaaacttttcagcagaaattacaaagaaatatggcaaagcttcatcttaacaccaaaatgtagttaaaaacagctttgatttcttttgtgaagctatattgttgtaggtaagacatacatcactcaaatactcacaaagataactaaaaatttagatcccaatctagaaagcactttataaagttctatgcaaatattagttattgatttgcttttgtaaagcaacagcagaaaatgttgcccttatctgattgtaatatttctagaactagagctctcttaaaacatttcctgcaaagatatttttcactttttaaagaaaaatgtttccatgctctcacaggataagtagagagagggcaaaagttcagtctcactatttaagtttctgtgtaaaggatgtttctatttctagcacagttatatttggattatatcgatccggtaatatgagtgcatgttctgtattcatctttttgaaaaaaaaattatacacagcaggtacaccttcagaatgttaaatgaaagctcctgttctcataggaatgtgtatgtttatttgtgctgaaatcctgaggtgcatatctatggctttcatattaaagatgactgaagagatgaaaatgatggtcttgtaagttaaaagacttttacctgcagtccttaaccttttctttttatttatgccctcctaatcccaactcttttctccaaacctagcttctctgaagcccaaaaactccaacaggcatctcaggctctatttctattaaccagccctgttaaccttctatccct

SEQ ID NO: 126249 - DNA, 1006 bp, Homo sapiens
ccatcttccctttatcatccttcccatgtgtccccatgaacttggtaaaaacccaagggaatacaggttgcaaacccaagagagggctgaggtttatgaggtgctgtggtctccacaggttcacattgctagtctgaaaactccacatttctgtccttctgtcagactcactcacttctgataagaaaacctcttagccttacttgattacagtaatagtaaaagtttatggtccctcatgtacagtcttaaatccaaaacgctcccagtcttttttgtaattttgtgtcaaactaatttagtggtacaacctgacctaacaggatgctatttacagtcttcatgtacctcgcttagtgggaatattcatgtttggtggcaaaaataattcatgtgtttttgactatagagtgcctccaaagaccctgctgtggataataagcaatttgtagaagatacatcgtaactacttttctgaagttggaagaatgctgacttccaaaaacatctggccccaaggatttcagacaagaaattgtgaacccataagttgtttttcttaaatttgggagtatttattgatcccctaaggaaacgaatgattcgttcagttccttcttcttcccttacaaagaaaacaaagcggggggagggacaagcaaaacaaatgtaaactgtgactcttattgctaataagctgtggcagaagctgttgggggtctgagtcttcaaaaggagcagatcttttggaggacagaaatctggatctgtacctttcctgcaattaaaagaaaaaaatatgtatcagagatttccccgtgcaactgcagtcctcctcctctctccctttgcagtggagctgctgatcagaatgtgcttgcaactcacaggaccatagcgccacctttcttgcagatttggaataaatcttcacacgtccaggtttggaattaaatcacactatcagctcacttgcctgtgtatgccgttcagttagctagactta

SEQ ID NO: 126250 - DNA, 1035 bp, Homo sapiens
tgtgcttctaactcctctctcctccctggccctctccactccctttttagttaattttttatatataattatatattttttaaaaactctcaaaacatgttgacattcgttggatatatcaaactctgaaacatcttttactgctcacagaatttcagatcacctggtgtgatggaaatatcgtgtgaggtggaatccaatccatgttttatcacttatcaaatgtgtgaccttggacaaatcatttcacttttcaaggcttccattttatcatctgtggaattataaaaataatacctgcttttctcatctcaagtggattcagtgattgtttatgataatagaacttgatctacaacatgctataaaaatgagagatttttgccacaaaagtggccaaattatctttgccttgacgtttgctttctccagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaagtaagccgcttctaataactaaagaatagttatgtttgtctaaagaaggtttatgtccaataattttgtaatatctagtggaacagaaaagatgaccttagagatatctttcctatccaggagcatagttacagcataaatacacattaagttttggaagtcacttctatcactttttcatgagattatgttttgtatattttatagtttttggctgccagggcctctttgctatttttgataattaatcgttgtttataactgttaaaacatctgaatttctttattctttttgaaacacctctatgatttagaaacaagaagcccagcggaaagtcatgtagaatgactgactattggatgtggagcacgc

SEQ ID NO: 126251 - DNA, 1062 bp, Homo sapiens
aggtctataagtgagtgcccctctcgatgtttctgacccacccagccccctcttcactgttattcatagaaatcttacaattatctttttcgaactcttatctagttacatcagtttactatactatgcttatgacattggaaaaatggaattatttctacctgacaagtaattatctccactaaattacccaatgtgggtcattagtgcagtctttcctatctaaatatgtatgggtgttctagaatcaggagctacgaaagaaaattatagtaagcagaatcgaatcatttttctttgccttgtgacccattaaagatgttttagtttctttcattactatactttttcctctaactgattgaatgttgtccatttaaataactgttcagttgcttatcctactatgcagtttattgtttcagataagaactttcatttattgagtgtatgatataatcagaactattattttcttcttaagagagcttgatttcatcaaaagacaggaagcagaaagaaagaaaatagaagatttggaaaaagctcatcttgtggaagtgcaaggcctccaagtgcgggtaagttgtgttccctaagacactaaataataagatggttttgctgtacttggaggggagcgctagtttagagttttataaatggatttgtttttcctagattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaaggtttgtttaacccaaccacaaaaatcatttttgatgactgtgtaatttggccttttatttttctttttctgacccagagatttaaaagttggaaataccttcctactatgggaaagaagaaaaggcttatcaaaataggagtcaatcattttagctctcgtcttatcaaaaataaatactttaatatgtagcattaacaaatcacaact

SEQ ID NO: 126252 - DNA, 1022 bp, Homo sapiens
aatccaccagacccttcagtcatactgagttataaaatagtactgggagatatctaggccaggcacggtggctcatgcctgtcttcccagcactttgggaggccaaggcgggtggatcacctgaggtcaggagttcaagaccagcctggccaacatggggaaaccctgtctctactaaaaatacaaaaattagctgggcctggtggtgggcacctgtaatcccagctactcgggaggctgagatgggagaatcacctgaacccgggaggcggaggttgcagtgaaccaagatagtgcccctacactccagcctgggacagagcaagactctgactcaaaaaaaaaaaaaaaaaagttgcttcaagaggaaacacaatgttactttgtcagaatgagctttaacttagtaattttctgttcattttaggaaaagtgggctactttgttttggcttttgaattttacttgcttttaatagaacaagatacattatgatcttttataagtaaagatcattttaacccaaatgtgagtaatttcttttcaaggaaacttcagaagactactgtattccaaattatttcttatattgatatatggtctgattcaccatgatatatacatattatggtctggttcacctggttcaccatgaaattctaattatagattaaataataaccatatagctatgctaagataaaattgactaggctaggatatcagggtagagggatctaaaagtatgaaggagaagatgctacccagtgtggtttgtatatgaagtgttgccctgggctcctacattgttttcaaggtgggtcacagtgttcacgtaagatatctaatagccaagagggaaacatgaccagtcacagaggttgaagcatctgtaaagttaaaactgaacagatgaacagttatttagtaccagaaaattctgctctgtgtatggttctgaaaattgtgccaaccatattatttcagcaattagagtatcaggtccatcaggttatgactga

SEQ ID NO: 126253 - DNA, 1022 bp, Homo sapiens
cctgaattctttatattgttgtaattcaaaatattttgtctattcattcagtgaactaaccaagagcattatctgtattgtcatatttcatgatggtgcttttgatattcagctattggttttacttagtgggaaataatgaacgtacaagtaattgtttctgtaggtcttaggtatatgtattagtgacgatgttaatatggtgaattggtatgaaccatgcattctcatctgtaaatcaacaaaaactggttttcatggggattcactaataaaaggttggtcttatttcaaagtaagtattgcatagaactgatactcagtggcataaccttccttataatctcttataccaacagccatcaaacagtttctataaccacatgcatattaccaaattacttccacctaagggtttgagaacgtcttctccagaatcagattctggtgttccacccctcaccccggtggatagcaatgtgcccttctcgtctgaccacatagctgaatttcaagaagaaccactggacccagaaatggggcctctctcctctatgtggggagacacttcactgttttctacttcaaagtctgatcatgatgtggaagaatctccttgccatcaccaaaccaccaacaagaaaatattacgagaaaaaggtattgttaatttctttttctgacttcataacacctcagcttgtacagtataaaaatgactttttctcataatcataagtcatttgttttctcatagctaataattaatattaatttctttttatattatagaataagagaaacaacccctccatgtattttactttaatttagttttatcttttcctatctggttcagtatttttatctcttcagctctctataagtttactactcaagggagttcttcaggggagtggggcagcccagagtttcaacaaacactaacacagtcataaagaaaaaaacactacatagtcatatagaaaaatatagagcgattttgtagaatagcagcccag

SEQ ID NO: 126254 - DNA, 1441 bp, Homo sapiens
ttcctgttatataaacaacctaatactaaagttttggtcccgaggcttacatagcactgggcctttgttcagtcaagattaaataaagtaaattgaacactatcaattttctactcacaattactagagattattattctaattttttgtgtggttaataacacattatttgacccagaagatgtgttcaaaaatattcattgaattaatgtctagtaaatagaaactggcttttttaaagctttacaggatttattgcttattaaaagcattgggcctctgcaagtatagatagagtacaattatatcaacgctcagaagagagagagattgcgtccagctgaggttggtaaacaaaacctatccaaggaagtacaattagaatagccatcaaagcacttaagggaaaaaaagggtaggtaaggagggaatagcgggtaaagtgatgtcattaacagagacaggcacatatcatatgatttaaaggtacaaggctatcccagcctggctgtagcagtttgcttatgcagggtggagtagttacacacaaaagtgagccagtaggttaagtatatagctttagaagttaaacatcttagataacttgccatattactaggaaaccacaagaagtttgaccagaggaataaaaaggaaaagacaccaccaggtatggagaagctgagttaggagaccctatgaggtggtgccctctaaagaggagcagtagacagtgacaggaaagaatgattcaaggacccttgagacataccttgactaggtaacaggtaagaaagtgaggcaaaactatcatgggcttcacgcctcagaacatatggtcttgtcattaacagaaaataggaaatcagcaacatgatgggggaaataggattaactcatttttttaacagaggaggtcatgagcgcaagagagaggtcaggactgccaggtagatttgggagtccccattataaaggaagagatagtcaagtatcttattacagtgagattaaggagatgcagtccagtacaagaccttaggatttggccatcaggagatcatttattatttgaaaatgaaaaccaggttgccacagcttaaagttgaggcacccaatctgggggctcagatgtataattggtcacaaaggtagtattggagagattttaaaaagcctaacagaagtcttacgtagagctaaataaacaaaatgtatgtttcttttttcctgaaatcataccaatctaatgttggattttatgcagactagaagttctagtgtgcattaaagatggatttaatcgattttaaatgggaaagtacattattccttattcttaacatcttcagccctatggaagcattcatttcagtgttcctgggaacgcactttggcaaatgtgtgagataaagatgtaaggttgcctagcaccaagctc

SEQ ID NO: 126255 - DNA, 1471 bp, Homo sapiens
ccagagaagaaaactttgactctgactttccccctaaatctcccagactctcagaggtgatattctgcgctgggctttggagatacgggagaagtgggctatgttcctgttagaaggcactacaaccccaaggcaagaaaggaatggaggacagagcccaggcacttgaagccaagaatttggagccagagaaggaacaaaagtcatgttggtccctacttcgaatgcagaggatgatttgagagtatttattctcccttgttcattcccatgcagttgaagctaaaactctttgtgatgaatgttgagcctctgtcctatagaggacctcccctgcttaactgcgagttcctcaatgtaactgtgtctcctaggtcgtataagaaggcattgattatttattttacaattaggaatttaggcaaagcccttagattcagagatgcattgacttttgaattgtgactttaaaaataataataattgatctttttcacaaatgtgtatatcctagatgatgccaaagatcccaaatcactaagggcatccagttcattggcggtgcaaggaggaaaaattaagcggaagtttgtggatctggggtaagcacttcacgatgtaaaaagaaagccctctgtaaaaggaggattgaaagagaaaatttcagcttcccctttctgactgcttactatcattacagggcgcctttgcgaaggaattccagcaagggaaagaagtggaaagaaaaagaaaaagaagccagtaggttttctgcaggtagcaggtacggttgtgtgattaagaacacgtgtatttctatacctaaactttctggccccctcttctattgttaaccaaaatcagtggtcagtatctttgagctaaagtgatatgccaagaattgagatggaagaaaaattgcacaattagtttatattggtcttactccaattatagcctccatctagccttgggcatatccattggttcttaattgcagaattatggccacatgaaccatttcaataagtgtttatctaaattcagcacaaatatatctatgtgatacttcagaaatatcaaatatatttatgtgatacttcagattttttgcctggctacccacaatgctagtgcattgtattaagtctaaaaggataatcattttgcatttaagtaccttgttgacattcaagattgtcttgtccacatgtatgtaggagtgaccaccatcttttgctgcacttggctatttaattgattttgtgggcactgtcaactatgcttagtcttcagtaaagaccttcccataaagagcgagctttgaacagcatgttatcaaattttcccagttgttttctgagattatataattttaagctgagatttgtatagggagtcagtaaagcatcaagctctgaagcccagctgcctggatttgaatcatggctctcctacttataacttttaa

SEQ ID NO: 126256 - DNA, 1715 bp, Homo sapiens
ctgcaatcttcctctggttgcaactaattttcttcaattaacttcttttactcctgggcttaaattctgtatttcttttatacttcatctgttctggcagtttctgaactcttaatgatattttgatgacatccagttagatgctgaatacttcacacacctgtattcaaagttagaatgacaacaacaaagatcaccttggaatgtttagctggcaatttaattttgggatgccagccccaggatacactggattcaagatatatgtaaatgagttcattacttataagagatattacataaaccatttaaatgccaggaaacagctacctctgaaatggtatctttggattatgaggacgaatttgaagccattctttctcccagttcctaggagtgacttatgattctcttttttccaaaaatgatagcaagccagtaaattatagctaaaaaagaaggtgaagggaatatagactatctacctattttgatccactggaaaaattattttcagattcatcaagagttcatttctaccaatctcgattttggggagaaaggaaggtgaaaaggaaagaaaaggaaggaacgaggaggagaagaagaaagggagggaggaagcaaataagaaaggaaagaaggattttatgttattcctaatggatttctccacaaagtgaaatagactataagagtggtcaacatggaataactgctgccaaaccctttctgcttctattgtgggcccaagagttcaatttattcagaaggaaattgacatttattttagaaagcatgtctgctaagctgataggtctgtaattttaaagcaaaaatttcgttttttaaatgaatgttctctaggtccgagaaatgaaagcataccactcactgttcagttctttaaggatactagcaagtacccaggggttacatcagttcatggggttttaaaatcacagatactcacagaggaatgagagatacaggatacaacttcagcaggggcacagccaagcctcatgggaaactgaaaaatattcttcaaaatatccctgaatctggtgatttgccactgtagagacgtaggtgtcttctcggaagtggcctctcattgccttctgcctggctcttcctccttcctgtctattacttggtgtgcaaagctagggaaaggaagcctctgggtatcaccagaggcccagcttctgtgatctccttcaccgcacatgtaagaaccacatggcctcaagaccctcctcagtgctggatgcacaggtccatgtggaattattagtcttgaatatttttctgacagtgaaaatgttgtgagagagtttaattagatgtgaccttcagatttttttcttttcaaatgttgcttggacaggatttggactaccaaaagtccttttcaactaaagcaatggaatgaccacaagtagaaaacaattcttattttgtccctatttgcttttaaaggtaatagtgattgttctaaaagcattgttacaaaggctgttcactgggagtaggacaagattgtcatgctgtcattaatcatggcctatttataaactttaaaacaatatccatatatttaagcactactatattttattgaaaattgtggatgaactcatttaaaaattcccttgattcagaaatctataaccagaggagataatgatcatccggtccagtttttcctc

SEQ ID NO: 126257 - DNA, 1034 bp, Homo sapiens
gctaagtggaagagggggatgagaccatctccatggagacattcctagagttgtaaagctggagccactagtcatatctttccctagagacacatgtttacatcccaaagggtcagagcccaagatccttcccaagttgaatttacattaaggagataagatttctccctccaccctccccagaggctgcagaggggacagctttccctctcctatataatcaaccagattcatgtttttggagttcctcacctagagtgtagaccatgtgtaggatgacatctggttcccccagcatgctgatctcaatattttatcagaacctcactgacttcttcattctcttcagttatcagccttataatccctttacatttgtatcttgctttacagtttacaagatgcttttacatttatgtcccagtcgatcctcacaataatatttgcaaataaatgggaattgttaggtgttatactatttatataaactggaaatatatttcaaaatatatttgaaatgagatgtaagaagactgaaattcagtatacatgtggtgggacagaagttgtctggctgtggtgtccaggcacttttaattgaaagggaatctctgtgttatcgtggtatcagcagctatcaaataataggcattccatcaaacggcaagggtgacctcttccaagatgcacataaactgctgcctgttcctactttggtttctgatagttattttttctcttaaccaaaagataattacagatatgaaagaacctacattaagacaaaaaaatctgttttcaaactgcgttcttcaaatgcctttgaatcctttaaatgttaaacaataaacatagaccattgacaatttgtaagcactttcacatatctcatttaattcttaacaaacacatatgagatacataaaaatatccactttttacagatggagaactaaaagccgagagaaggcctgagaccatgtacttaggaggtggtaaaccctggccctccaagtgggagatgaggacttcag

SEQ ID NO: 126258 - DNA, 1138 bp, Homo sapiens
taaaagactgtgcccctccctgattataattcatctacgtacacttattaggcacattttataaaaattcaccatggcaatagcaatacgaaaatgttgatcattgtcacagaatccatttagaggcaaaaagataactattaagattagtgttgtagtcaaaagtgcaaactttttactctgttgaatagaacagtttctcaaattgttacttcaaactatattcagagtccttgggttcagtaggtcttttatccgccctttctttatctaacacacccattcttttcacaaaacaggatcttcagaggcagactggaaaactggacacccaagccatgttcaacagctcagacctccactcgttccccttgcatgcctttctcatggtttaatgacagccggaaaggatcctattccttcaggaacctgcctgcgcctacaagttcccttcagccttctcctgagactctaatttcagataaaaaggggtccaaggtagaaaacacatggattacaaaagcaaacaagagaaacccaaatccctcctcttcttcaatctttggaaggcattctcaacttatgtctgtagtctggatccaagaaaccaatgtaataacactgcaataaacaatgcatggtatttcttatgtggggaaaagaaagcctcatttaactaccaccttctttaatgctgtttcattgtagattgtacattactctttgatttgcctatcttttcacatattgctatttaatctcagtttgacagttaagccatgctgggaaagatgcatttgaatcatagaacagaatgatagatctgtttacccagtattctactttaaattacattactaaactatttcactgtgcttctcaagatttactgaaaagcaaataaatttgggactgaatacgagttcagtacatctaagtgaaactctttaaaacaaaccaatgatgacatagcatccttatttatttcttcttttaatgtcaaacttctgtgttgaacaactgctgtataattctatcaccaaagttcttcaacagaattaggaaatatatgcatgggtgttacttgtttttaaatgcatgatggttatttccagcatgacactgcaaaccttatcta

SEQ ID NO: 126259 - DNA, 2258 bp, Homo sapiens
aattctgccattatcttgcactgtagagactccagatttggttaaaaatgtttttacaagtgcagctacgtagtcattgttgtttgattttcatatccactgaatattttaatgaagttctggggaagttttatttacacgctcccacctcccccacccccaggtgattatttggaaacctgtgtctgtgctgtgtggcagcctctctgatgctctgcgggtgcagtgagagagttgtatttcagcatgtaactactagtgtattgtcaggctgtgacctcccccagaactcatcatcttgaagggtacatccaggagaggatctgccatttctcatagtatttatcacagccaacaataagcgatccttcccaggaggtgctctagctacctttctaatatgaattgccatctgttcctaataactcagcctctccacaccatcttgtatttttacttacactgttactcatcacgattagggtcaaagaagataggcttattaatattattcctctgagcagttgcagaggataatgaattctgtacccttgaagagcaattgaagaattgtctctctaaaacatctatcctttcatcacatggagaaagcacccagaattccctcaaccagacaaggtgcagcattctcaaccgctgccccattgaaggtcatcaccaaatcatacatgaatttctgctaagattgtttaaaagagcccttttagagcttgtagacacacctacctcttgctcactcactgcactcatttaacactgagcttcatttatttttacagaattttaccttcaatgatgacttcagtcccagcagtaccagttcagcagacctcagcggcttaggagcagaacctaaaacaccagggctctctcagtccttagcactgtcatcagatgaggtaattccatggcactatgacagagctgctttgtcaaatctgacgttttacccatgaaccatcaccaggaaaatgtttttagggtagatattgcatagaaatcatcaggactgtggtttatgtttaatttgaagtcttcatgatttctctccctccctttctcaacagaaaagcaaagtcttgttcttaagctttccaggggccccttttacacgtatatgtaaacacacatgatggggaggctgggcagtgcagagttaaacatgggggaacagctcagaaatcacatagaagtttcctaattactcctttctttttttccttgcctcccctgacaaccacactcactccaagattctgatactgcctctgattagggtgaggtctctgattgagaatcaatagttttgataaagagggaaaatagcatgagaaccatttatttaaaaacaagggtcaaaattagtattgctacaaattatcaggagataaatgtgtacaagagagtcaggaaatgaggttagtgatttagttccttgaaaaatggagggaggacagaaggcaccataaataaagatatttttgctctaaatatttgttcttactatttctttctaacatgattttttattcacaaaacttttttttttcttgtaagcttttctgcccgtattcttcaagcttggtgcaattttaattttattaaaattatgtactatatatgttgtgtctcctgtttctgtaacacttttcttcttgattcttttattgctccctcactcagagcctggatatgatagatgacgaggtgagctatcagtgggctgtgtgtggtggcttgtgtgctattgtttgaatgtgttttttcgctctttggagatgactgaaaaatcagacaatacaagaatatcttcctctgtagtgaagggtttccttgtgttaaatagctttactctctgcctttgtcatatcttagtttaaaagatgttcctaacttaagaggatctccgcattgcacctccagagttcctcgatttctcttccatcaccattacattgacatggtccattcttcttcctctcctttgccttcatctcagcttaccctatcccttcttctgtgttccctgtgtgggtcaccaaggtgactcctgtctttccttcaagacctatcatcaccttcatctcctctcagcttagtgggtctaggaaccaacctgtccctttgcactattaaaaggaatattctgcagtggacagagccagaaatttagaataaactcctaactattgagctctaccacttactaactgtgtgatcttgggcagatcacatag

SEQ ID NO: 126260 - DNA, 1009 bp, Homo sapiens
ttggttctcattgtaatgaaaacattggcagaaaggaagccatttcaattcttcttgcccttcttggagccctctgtgacagcaggtgctcactcctatgctttgaaaatattgatgagtttagcaatacctttacccgtaaatgcctacagcccaaaggttggagaagtagaattgtgccctttttccattcattcacccattaattactcatttggaaagcatttaattaatgagctttagggtatactttgcaagggacttcaaagaacaaaagaaaaaataaagggtagcccccagtgtgttggtttttagcaaatgtaactagttcttcctctgttcttacctcttcaatgtttgaattagtttacgaacttggatatatggtatgttaacaccatcagagggctcattggttttcaaattcagtttgtgtgtgtgtttctttcttaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactactaaaataatcccaagccacctttggttcattaacaaaccagagatttcatttaagtagctgtgttttgctcttctctaacttaccaacatcttgtgttgtgttgggtgtgttttgtcacttggagaactagtgtgaccccacccaagagcatgacaca

SEQ ID NO: 126261 - DNA, 2813 bp, Homo sapiens
gaaattgaacaggaaattgatttttaaggaaaccaccattttcaggtttcctctcctggggaacattctggctggtcttcagcctgcctatgtcacaatcaggaactcatcacatattttctactcaagatttcccaggtgggctcagttagtattttaacaaatgtacttttaagaaaaatagaaataccagttagaggaaactgtcagttaacattttagagagattttgaatggtttttccgaaccattcctttccatacttcaaagattctcaattttacagaaaaagtttgtttaaggcagtgcataggtatactttagtagtggaggaacttatactaattttaagccagcattaaggatttccatgtttcaccaaactaagtcaagtgcaggagactggggcagaagaaggagaaaataaactcgttttgagaaatttcatgtgatgagggttttttgttttttatgctcatgtatctggttctctttgctgcgttgactctaaaaatgaggttatccactttccaaaggacaagtttcagaataagacttgaggccacatgaattcttggacagtattttacttcttttactttatgggaatctctgctctgttcccagcatctcgtatcttccactagaagtattccatatttagagcctcggcaaggcttttgagtgtaacagattaagggaactcccttgtagccccatcttgtattttaataacagtgtgatttttttttatctgaaaatctgaattcagaaattatctaaactggacatttttaattctgttttacccccaaggcctgttttcttttcattgccagagtattgtcggttatgcgtcagctcttttgtcattaggtacagacccttcattcaatcctcagaaacgttgacatgaagtaacattgtgttttacagttatcaaagtcaccattatgtttttctgtctgtcttcattaggggtatgataatgaaactgccgtattggatactctattaatgtcttgagatgtctggtgctttgttattttttcacatcatgagaaataagaagccactattaatgagtgatacaatttggcaaaacttttcaaatactaaaacactaaattagtaaaaatctggtaatattagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcacctaatttatgatctattatattgcattttcttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgcacattttgttttcctattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatcctttagctgggattgacaattgatttcacaccctcaacatcacaagctttttttaacccacagcagttcatgattgcagtatgataggtactaaagccaaactcagctttcaactggcacaaaatgggactgtcaccttttgctccattgttgttggaaacaaagtggcaagagggaaaatgaggaaccagatttacctttgccactatctgtgaccctgtaatcatcactagcctgaaatcttaaaatatcccagtcccaagctacaaaaatggtcacaggtggtttgatctagcacctcggccgttagagtttgtgctgaagacaaatttgtctgggttcattgtgcaccagaattagcatgtgcttgaaaattgcattttataaaagggaaatgaaaatttgcatttatatagatactctgattcatgtttaagtgttaaaggttatgcagactaaacttcaagaggagatccagtgtttaacaatagtgttctagaggattctaaaggaagctgccccagcagccctgagagaaccatctatactttggatatgttgtagccc

SEQ ID NO: 126262 - DNA, 1639 bp, Homo sapiens
tacttgaaggttcacatatgtaagcgtgtggacccagcacagtctgtgacctgattccagatcctcaagagtggagaaggaaagaaatatgatgatttcctatgcttgaccctaacccaaccccaaaactgctagggattcaacagtgagtaagatgtatgcaataagagaacagataacttctcaacaatgtgcatgccgtttgtgtagatgttcagaactacatatgtgtgaatatcactcccaccttacacacgcacacacactgcaatcacatggcattaaaaaatatattgtgtatggaacttggcgaggtcagtcaggacctggagctgtaatcatagccttattgccacttcttgcgttgtgtatacattgaatggctcatagattttaagagatttttttattgtaagtatttctactaaatgcacttatccttctatatgtttatatattttggtaaaattgatttatcagatacttggtattttagtaagaaaatttcctcaaatatttggctaatgctttgatgtcaagattgcatattgctgagttggagctcagaagaaatgtatgcagctaaaaattgcactgtgtgttcttgtgaatttgctcacaattctaaaatgacataattggtggctgtgatgcttacagtcactgcctactggctctcttatgatgaatgttgccatcatatgatcatttatttactttttgtgcaagcaatggcattttggttgttgccaaaaacaacacaagtggttgggagtgtatgttgttggaaggtgtacacttctgtttctttcagctgtattatttatacacccaggttttctgttaaggatgtaatcattcattcaagaaagaacaattggcaagaaataattaaattaccttaaaaagaattaagaggcactccagccagataacacctcccaacaacatgaaatttagttagtgcttagtgaaattccttaaatatatatgtatatgttttcttcaacattatttaatataactactgcttttatattttttaatggtgttgcaaccacttgtacacctgctacaccttactgacaaaactgggcagctgaaaataaaagagaataaattctattccactgtaagaagttgatttcttttcagctttctttgtatatcagtaaagaacacgaattgtttgaaaataattttaagtctgataagtatggatagcatgttacctaagcttttaatttgtacattttgatgtctgatcatttgcatggaagagacaatagtgccacgtctgaattgttctcttgtgcttggttaatatgtacttctctagattgttcaaaaagtttcaaatgacattccttactctttggttttcagaggcattcaagcaaaatatcacagtggtcttttgttttctgaccaatctaacaatacctgtgattaaatttaatttgttagtgtaaataaatttcttgccaatgagtattattgttgttagacaacgaatgcaataaaaagaaatactgaggtctgttgaagcaattttttttccctcttccattttcaccttcaactaaaacaagccttgactgggtaaacctgtatcaattgtcaaagcatatatctgtca

SEQ ID NO: 126263 - DNA, 1044 bp, Homo sapiens
atttggaagcctgagtgcttaaatatacactgattagcaaagttaagtgtattaatcctgggatcaataacagtactaggcagtgatgtgtcaaatgaaattccaaagtagtatccattatttatgctttctagcaactttgcagatgtgaaggggctccagctgtgatgactgccatcccatcagttaccatgttgggttggctggataactgggtgtttcttcattattttgtcttgtttctctccccatactgtaatctcaaaggcaagattcttcccacagagggaggaccaccatccacttgagaactaaataagagcatcttaactccttctgtaagggatgcctgcactaaaaaaattgtgtaagtcatccctgaggaatttggctaatgtcagaaagccagttcactttggtgcatagatatctatgacattagtactttcatcagaagaagaacaatttattgaagatatacagattttagcttctgatttctgaaaaatagatttatcctagaatgtttgggaaggacatcatgaaacaggtgtttactcacataatatactaataaacgatcttttctcgacaggtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaagtctacatattttgtaaaagtaaactgataattgtatgataagtggcactgtaagtaaatagcaaacaccaaccagtgagtgtggcttttcttatggatagaagtaaaggagcagacagagattccttgatagccatcaaattgcaagtcaggttaatgacagtccaacaagaagccaaactttacggatctttgttagcagccccaatgttctttctacaataaaacatgtggactatgtccagtgaggtctccgactca

SEQ ID NO: 126264 - DNA, 1058 bp, Homo sapiens
ctatcagtgaactgcactacaactgtcacagataaccatgatcaacatttacaagtcaacagattttggggtttgagatttatttgtgaatttatttcttttcactgatttctgtgaaagagaagagtaagaaaataacaaatggctaaagaaaacccatcagggcaatgcagaatcatgattttctgtggaattccttaatccatactagttcatgtatcctttttcaaattgatgaacgtattagtctatgtagagatgagtgattttgacaaggataaaggatatttaaatacctcatgggtctctttttccacctccctttcactttagtgtgaatgacattgtggttcttggaccagaacagttctatgccaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtaagctcttttgtgtatttttctatcctttgcccttgacattttcgtggactcctttccttacgaggaagttacttccttacttaggcttacgtagtgaatatatgtgtggagggatcagttgtggccagggttcacactaaatctgtcatcctaagcaatccatttgtttccttggactttaggttcttcccagttaaaggagggatgtggacttaaggatataaggacctcattccaaatttttacataactcttgaaacacactttcctaacacactacaaaggaagataaatgagcaatacccctgccccttatgaaagtacaaagtatttgaccacttatgctaagttcagttacacaaaagctcttaggagagagggaaggctaccttagattgggcatagggattgtataagtttcagacctactgacttacaacagcagaccattcaatgagaaaaccctattttaaacagcatgaaattttatgagaaaacacttttaaaaagtgtttaaaaat

SEQ ID NO: 126265 - DNA, 1085 bp, Homo sapiens
actgggagatacttagaagggagtcaccacactaataaaatagttgttagacttatgagaaaggtgagagaactcaggttggagtagaatgagaattagaacactcttcaggttcctgatggtttttatgtgaaagacagtgagcagctggttattaccactgaggcaataaagagatactgtgggctttagcagaaacaccagtatatgtatttagtttttaaaataaggttttaaaaggaatgttttatttaattgcctacacagaatgaataaagtgatatttatagtaggactctgggtttgtttaggagcacatgcttgcacatgtgtggcttaggaaaaaccactgggaccactagtctaaaatattcataagtaaagatgcaaacattctgaataaagtagaaggcagttgcattgatttttttatttgtttatttgtgttttttgttgttgttttgcaaggatgtgttcttggagatttttataatctagaattcacctatttcaagatttctctccagcccccatagtaataaatctgaagtaggagggatgaggtctccaaacacataaatctacagccattttagcttgggggcatgttatagttacaaagatcttatagccatatcaatagaactttttctgctttttttctgttaccctcctttgctcatttgactttttttaaaatttagaaacattcccagtttgctgctgtttttcatttacttggcattgtctctaataaaacctagagtgtactctcttctaaataaagaggtcctacattgtggaggttgttcattcttcttcctagcattttagctcatctaacccaacctattttacagttatgggttgagggtcacctcaaaactaatgtcacacttcatgaagaattggatgacatagaataaaatataaaaaatgtaaacaatgtgagtgtgcttaacaccactgaactgtacacttaaaaatggtgaaagtgatgaatgttgtatgtattttatcataattaaaaataaatttttaaaaagagaaaaaatacttaaataaataaggagtgcgaacataac

SEQ ID NO: 126266 - DNA, 1042 bp, Homo sapiens
tctaaatgtctggccttcaaaatttgagtggactgtctttctcaagataactaacaattttatgcacttggcagtcaagacctttacaataactgctgcttgggagattgaggggaaaaaagcattaaagtttgtggcccttataatcaagtactttacagtctactgatgggagaaaaggaaaacaaaacaaaacaaaaaaccactgtgagatatagatatgtcttttctttctctagcagataagtacctgaggctcaaggaggttaagcaacttttgcaaattcactttccaatatagtgtcttttcccagggtgactaatgtatatacttgatgagtgaaccagaaaagtaggaaataatatgttacatatgggatgctctattgggtatagtaaaggatgcgttgctgttataaaattatagtcacttagaaaagagatgtttatttttatttttctctcatcagtcttaaggtaagtgaatggcctagggtagttaggtgactgtgttccatatggtcattcaggggcaaatgctgatgaagcaacacagctgtcttcatctaagactagaactctgcttgttgccatttcccagcaggaaggggttgaaagaaaatttatgtagatttttttttctacccagtagttgcatatatattgtattctcacatcctattgacccaaacttagacatatggccacatctgtcagccagaaagggtgggcaatgttatctatagctgtgttgctacgtgcctattgctaaaaaggctaaaaaggaagaaggggaacatggatgctggtgaacacttggccacctctgacacagataattgctaaagtaataagaagagatggaaattaaatgtgctaagctaggagactttctaaagaaagggtttgtcatgctacgctgtgccattcatgtgtttttttgctcatgctgttccttgtgcctggaaattctccccctaattcccctgagcagtggatgcagtggataccctccccagatcccccccaacttccctgagtg

SEQ ID NO: 126267 - DNA, 1049 bp, Homo sapiens
aaaattctgagttacattatttgaacataaatacatttatataattttttagtaattacaataacattgggaatgactagtaaaacattactagagattctgttagacctagattgataaataaattaaagtgacaattagcagcttgtgagtaaatgatgcttgaaaacaacaaatgcaaatagtgcttgaaaataatgcttaaacatcgcccatattttgtaattattaattagcaaactactctttcatagattggattaaggcagcttctctgcggttaatgaaattatcataaatttaaaattagtctagcctgaattatattctgttctaaagtgaaaagcttgatttatcttttacattcttaacacttttaattttatcctcctgaaaccttcactcaagtctgacgattttgttacagttaacctttttccccatgagacacatcaatagtaaggttgaatgaaatcaagattcttttaaatgcattcagaactcatttaaatgactggtgcagaagttctgtgcaccagcttggaagacatttttatgttaccaatcttgacttacaaatatctcaatttctacaaactagggaaaggtaagacattttatgtttattgacaacaataagttatttttctcaatattaaattctaaatgaaatcctataaagaacatctaacaaaatctttagtctactttatggctggatgtctttaggaatactgctaccttctgaattttctgttataggggaaaattaaatgacacctcagaagaatcaggaaaagattaatactaaaggatgaaatagttgaaaataacacacttggcccttttctatttctttccaaatatgactttatacctagcatttcaacatacagaattatccttattatagccatattttattctaggcttacccagagtgcagcaaggcacaactggggctggtgtggatgctacttataagaaatataaatggcatcctctggagcctctggctcccaggctagatactgagatgtcaaagatcg

SEQ ID NO: 126268 - DNA, 1020 bp, Homo sapiens
ggattatgggagctacaattcaagatgagatttgggtggggacacagccaaaccatatcagccaacaataagttatttttctagaaccacaaaataatgatttttttctgtgaacttatatatacgtaaacagcttaccaaatgtaaaaattaagttacttaaaactcatttaacaaatcatgcttattgagaatataaaatcatatgcaaagaaatactaatttcaacaaaaatatatgcatccattaatacagcatttattaatgttagaggcagtggtttttgtggcaatagtatagcctactgctaccctcttcatatctggatacaaatcctgactccaccaacacagcttgtgtgaccctgagaaagttacttaatttccgaacccttattccttttcacgaaaatagatgaattactttttgtgaaagctcagtagtggatgggtggggtgtggggaaaaaaagaaaactcagtagtaagcacttgataaatgttaaatttcttactattggcgtcagggagtgggatagggtatgctagaggacagagatcacaagtcctcagaaacattgtaaaattgtgtgtgtgtgtgtgtgtgtgtgtatgtatgtgtttatagacctatacagaagatgtgaacttacacctacacacatgtgcaaaaacatattacttaatacattttaaatcaaatttaacttgatctcaagccaccgttgtgtcttggatgggagaaaatctaagctcagtcattgctgatactctcctagccccacctgtgggcagtgcaaaggttcctgaactttccagcggggcttgcataaatggattgtagtctatgctctgcacaaccttagggtcaccattcacatctcaagaggcttgaccacattcttggagcaggagagaggaaaactccagcatgaaacaactcaccaattaacatttcaataaattatgcagccacatacatttttttttgagggaagaagagagcccatacctttcattag

SEQ ID NO: 126269 - DNA, 1046 bp, Homo sapiens
cagcttttcatattaaaatttttcaagtctaggtcacttgaaaacctcctgtttgtcttcagatatgtatgacaatggttgattttacaagctcatattgcaaaattattacaggtttttagaagcaaatgtatccacaactgtaacagattttcatttttggatattggcttgtcagagcaagacgctggatctccagccaggcaccagatgtttttattgaggggaaaaaaagagcattaagagcttttaaatcttatattattactttgatcatataagaaataattgtgacatttcatgcctggaaatgtatcacgggggctttcgttcatattgacactatatattactgaatggatcagttaatatataaccagtttaaaggacctgaaaatgtagtgacagccaagaaggatattttgaagtttgaaatgatccctatataaatagaacggatcagcataactttgggataaaattagccgacagtttgtggactctccagcatgcgcctgtttgctcggtgctgttctctcgataaatcacaacaaagcttccagagggagaggaaggatggacggcaccactgcccctgtcactaaatctggagctgccaagttagttaagagaaatttccttgaggcgctaaagtccaatgacttcggaaaattgaaggctattttgatccaaaggcaaatagatgtggacactgtttttgaagtcgaagatgagaatatggttttggcatcttataaacaaggtaaaaacatataggtgttattgtagaactgttagaaaatgatttaaaaaaatgcacagtgtcagttatccactctaaacagtagtttttattgtttctttaagtattcatttaaaaaatatttctaaattgatattttctttctttttaaactaaaacacattgtgggctgatatatatgtataagtcgtgtctctccttttcttttcccacccttgggcctaggacttgaaatcccagacaatcatttttagcaatgcactctctctgtttttaacttttc

SEQ ID NO: 126270 - DNA, 1053 bp, Homo sapiens
agcatagtactgcttggagaagtttctgaatagtattaaatagcctcaaattaacagattttattccttagccacctggcatccttccacagggtacatctctctgcattcctgacagatttctttgtctctttatcattatagttttccatatatttgcattgttgctgaaaatatttacacatttgttgcagtaatcttataaggaagatttcaagggtttaaatgtgatatcactactctggaaatatcacagctccccctccagcctcttatcccccaactccaattccatgtccccactcattaaaggatgttgtgttgttgacattgtggtgtgaccgaatcctgcagtcttttataaattctaagaactgtgggatattcttacttcttggaagtgaatcctcttcaaaaagagaagacaataattctcctatatctgtcactttttaaaagaaagaaggaaagacgaaaggacgaagggaattagtcaattaaggagacaatcgcccctgaattatcgattaacagtaacccaactgagagtgaaatataattttataatatatgtgtgttcaatatttgatagttaatgctatttagatatatcatttagacacactttttctcaaaactaaattgatttcatttattataggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtaagtggtgaaccatattgaagtctctagttttgaaacagttacccgggtatgaattcttatactatgttaacatcataattggaaaacaggtgatctgaatggtaactacttttgaaagatgtaagaattttaaaattaatttagggtaagttatcattagagaagttataaaactataaacagacatttttaccctgaaaaagtagattactttataataaaattttgagttctaggaaaaatttga

SEQ ID NO: 126271 - DNA, 1047 bp, Homo sapiens
caggaagccaatggaggtagggccacatgtctgtgtgtccttaaaatccttgccttattctgttcagggataggcagtaatgggagactttgaaggaggcctaatttccctctgggttctgctcagtgggtggtgttactgtgacatgccctgaacaggactgcaatcaccgtgtggtgaaaaccactgtaaaattcgctctgggtttcccttctttctggtgacagcacaatccgttgtcgtcgtcagtggtgtggctgttgttggtgccgtgggtcgtttccctctgtagggctgaggaactgaagctggtaactcccacatgcctgcctgcttgcctgcctacgtgagggggccagcctcctctgctctgcctgccccgagtctccactctgctcctggtccaccacgtgattccttgggggttgggagagaggtctgattttcatagcagctttttttttttttcaaggaggggaaaaatgtgaagctgaccacaaagtgaacacactgattcttgggttccagtcatggctgggtttcttgaggctgggtggcatgctgtcgccaagctcctgctacacctcgtaacccacaaccatttgctgagctccctggggttgccttaatcccagaagccagggtcgcacagaggaaaataagaattctggcacagaaaggagtcatttaagtgcttattgcatttcaagctttagtttctacttagctaaaatatttaccattgctggaaaacaatgtttaaaatgttgtgcttatatgttatttaatggcgtggcctatgtaaacctcaggatgcttacattttgacagtcttctggaaatgtctaacagcacataacccagcgagtggggaatcaaaacgggaacaaatggcgcttgaaactgtttgtaacctcctccaactaggtattcagaatgcaagtcatgctggaatgcttcaggtagagggagatctcaaaaaagaaatttgatgagtcctgtcttatggccccatttatcaaccttccaaataaactgtccctaaaa

SEQ ID NO: 126272 - DNA, 1779 bp, Homo sapiens
tggtatggaaataatgtgttcttaactaactctttggtatcaggtaaatttttaaaatatctaattatatctgtgatttctccatttttttaaagctcgtgtatttcgatcctcaccccagtttggtgtaactttgctgacttacgaattgctacagcgatggttctacattgattttggaggagtgtaagtatcatgctaaatctgctgctaaattttggctgctgctaatgctctgttgtcgtagggaaaggtacctcagtctagtctctataataaaatagaagagatttagggaaatgttgaaattgtgttaacaaggtcatttccaaggggaacatacaactgatgagaatgtatcaactcctttacattaaatatttgaacaggttttgaatgttatttttatcaagttaaaacaaacaaaaaatacagcttcttactctgttttctcttcttttagaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccataggaagatcagccctgggatagtgctgtctttttgtgggtactgcagtaaagaacatccctcctgggaatgaagcaatgcttcatcccttttacgtccatctcttgtttaaattcaagtccaggcttttttatcatgtgaaatcattcattttctgggtgttttcttaaccagatcattgtgaaattattcataattattatttggccctctgcccagaaacctttgtttgcatctgaaaattgatgggatttggtcaacactaacatgatttggggaaaggagcaagtcagaatagaaattagtactcccctccttgaactaggattgtagtcccaaagaggctactgtaaggcaatcatggtgctcagagcagtgtttcgtgtgtgttttaaactggtaggaaactaggtgcatatttataaaaataaaaaacactgggagaaatgaaaaaatatatatcaaatatattcagcctggcttcaaattgtaagcatgcacaaattctgtctctggattatattatgaagcttttatgtgaaacatgtttctttgtaatgaaaaccacattggagatgtttagtaatcatattgttactggtaccaagactactagggaaatgcctttgtactttagggaagtacttttggcattttactgtacagacagaaaaaactgagatgtagcccctctcctggaagtgctaattttgaaaaactgctcatatgatgtacatgtactgattactgcctattttaataaacactcttgaaaaatgcatgttgccctgttgctgcctgccctattctcctcatctccccatcattggtacccacttgcttttaaaatccactttatcttgaataatgtaagacaaatatgttctgacataagtatttaattcatgttgccttgcataatggtcagaggcgcatgaatttgtgaaggtggaaataaactatttgtaaagtgattgagttgtttggtcttgtgcatgttgcatggtgagtggatacagtaattgtcattattggcctacatgttttgttttgaggggaattttattcatattggcatggatatatcctcagtatctttcaaggtaatgtgttccctcattttcatggttca

SEQ ID NO: 126273 - DNA, 1029 bp, Homo sapiens
actctttctaaaccaggaagtaaaacaaaatcggtggtgtgaacacagtgggtttctaagcatttttcttgtttccttccattatgttggaggataaattcctggcccaaagttaaaataattcctacaaatgaacaggaatttcagtatgacttatccagtgaagcactggatataaagtgagctttttgcatgcagaattgtgatgtattttataaaacctcttgagattaatgtttgaggagctaggtaaagatggaagagatactccttcagtaatataaatggaagcgtgtagtatgcagatttacaccccccttccaactcactgtaactttaaagctgtctgttagaaggatgaaatgtagttgtgagccagaccatgttggtttggacagaaattcttacagaattattaagccttaaaaaaagcaaaggagatttatgcatctgcatttgaccaatttggtttggaataagttcataatggaaaagtaataaaaccataagagacagtgtcttctgagtacagtctcgcttttaaaaaatctaaacatgcactgccctattttggatacagtgactgtagaaaaatttcccattggtaactttgggagggttttctgttgttgttgttgttcctttttcattgattatcagccagtataaattttaagctttctgtcaaatatttttctggagatgtcagtcttagggaaaagaaatcctaaagtgttatctgtaggagtctccttctcccaatttcaccccctccccgaaacctccacctcccaccccccaacacacatagtgttttttagatatcagtaaagtctttttctggtgtaactggagaggttggggtttggagagtagggggtggttgaatgtgtgagagaaagcacctcctgtgactgccagcagccacagaagaccatgaagaggaaacgcataacaagcttcacctctgaaaaatcggacctaataacttcgcaagtttttgatttcaacaggaaagaaaaagaaaag

SEQ ID NO: 126274 - DNA, 1029 bp, Homo sapiens
cagtacccctagtaataacaaacactttaagatgagttttgaaagaaaatctagtcatatgaagtttcataaaacagtgacatagaaagattgaaagacagctgattgaaaaatatgtaccaggcaaatatcaacaataagcaagtagcaatattaatgccatactgaatggaattcaaggttttaaatagcgttcagaagcacacaggcatattttataaaagataaaattcactatgaagacgccatcaatttctatgtaatatcaatgtataatgtcatctctcagcttcaaagtatgaagaaaatgcgatattttctcatacctgatgaaaaactttatcacactgcttttagaagctgacgtattaagtagataatatagatagagatgcaaaggggatttggaaaacagccttgatccaaaataaatagatattaacctttgtattcaataaaaagaaaagcactttccttataaatataaatgggatatttataaaaattaacgatgacttgtgccctaaagctgtattttgccagtcatgttttctttttgttgtaaattatattctactctagctgggccccctttgaagacttgtaattttttaattggttgagacatgccccaagttactcctgtcacagaggtggtggatggcccctgggtctctgtgtttgtcttgtcattgaagaatcaggcagcctgccagtccctttcctgctgagggacctagaggaagcatctctgtttcccagtctcctcttgctcccctgtctttaggaatagagaaaattcagaccacttgatcagcattggcttagccttttggaatccagaagagagcaggcagatctaccagacgtccctgccaaccctggcccccaaaatcaacagctctctggtggccaagttcttgccagtatctgctgctttcccagccttgctttagggcagcctggtgcagttctccaggttaacttagcaaatcctcacactggaaatctcctgtccaccaagatgtc

SEQ ID NO: 126275 - DNA, 1008 bp, Homo sapiens
aaatttgttaattatgtggacataaagcttaagttataatagtttaaaaccagtccttaaacccttaaaaaaagtaatgaagaaattgaatcaagacaatagactgagcatattcatccatctctcctgtcttcccaaataccttaaaatgtcaggaaatgcatttttaaaaaattctttattggcactagaaaatgctaatctggccctcagcagaaaggaaatagccatattgactctgaaactggactgagagatgccccagtccaaaacacagcaggagaaactacctctaatgcaagggctgaactggagaatgttaacctttgagtgaagaatagaatgcctggggtggaggtggaggttttagggtaaatcattaacatgagttaggcaactatactttcttcaggattgccaggcttggagctctctcctggttttcatatggagcttcaggagacagttgtatccaagttaaaagctcagagctcaattttaaagaaagagaccacttccctagagaggataagtgtaaggaatggacagaaagtagggcaggacttaaggtaattcaagacttctaccacagatgcaggaaaaaataaagtgatggcagcttttcccaagaagaattaaggatttaaaataaattcttctacccccaaagtgaagttccctacatttcagcagttcggagggtccacaccctgccagcatatcctaaccccttgcacccagttacacaaagcccatagaccctcccattcaggagagagacctgtgggtgaagcatacctagaatatggtagaagtcacccacaacatttgtatataatactaatcagcctatcctttgaacttgaataatatcaatagacaaccagagatccccagccatgaaggagcaacaaagtaagtgaacagaagaattagagagaaaacaggcaattcaggggacagaagacaacttttaagaactataattaattaatataattaattaga

SEQ ID NO: 126276 - DNA, 3070 bp, Homo sapiens
gactctggctggattcattattttcttttgggaatctctgtatttggtggaaatttttagttattagaaatctgttaaagaaatggtattaaatcattacatgttgaaaagtgatgatttccttcctattcaccctacccaaaacacaatatatgtgttgtggttttcatcataatatatcatatttctgggcactcatcaattcgcggggcctctgcatggcattatgttggcaacagaaactatttgttgaagactttgctgtaggaactgattgttctacacacagctttaaaatgtatccgaattattgtgaatatttcaggctttagagcaggcatttatcaatgtttcataaaccctgggtggcaggtaagtaagtatataataaaattagaaggatccatgaaccccctgaaaagatataattttttatgtatgtgtaatttctttctgggaaacagtccaaacgtacaaaaagcaaaccccttttccccccacctgtataatttgtctacttcctagtgtgtaaacaaagaggcatcttgactgccgttacccgtctttggtgagaccagagaacagatcttccttgaaatgccagtggcttgccaccagtagggatttaaaaggatgtcacaggcagagttccaaaaaggttttaattgaagtcttagcattagaataaatgagaactgccctcctcccatcacagcacacaacaaaactagtttttgttttaaaaacaaagtttagatttattacttgcagaatttgggttatttttttctgttcccctttcaatgtgtgagtacaaatttggtcttctccaggaatattttgttctgaggtgagttccagagaagcttgatctcctcaatgggatatgtgtttcatgtggtttttcttcctttgcaaatgtgcagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtgagtgtcccccatggagttctcttacttccctgacccttgctgccccccttccctagctgcatgctactacattgaaatttttttgctgatagttcttgacagggtatgtgtgagtttgctagagattgaagagctactgaaaaaaaagggaaaaaattaatcttcattctggcagatgagattattagacaagcttaatttcttaactctagaaaaggctcattaaatattggcttattttgtggtattgtggaactccaattcaagttccatatcatttcatagtctcacttcacagcataagaataactgtttagctggaagtttttaaagatttgaataggtttgtcttaaagatgtctaaaaaaaatagtgcataaaagcctgtccagaacttaaacaatagttagagaaaagaaatgtagtagaaccagaaaagacctgggccaattagagacacctgtttcctccctgtgttacggggggatggtggtaattaaatcacagatggaaataactatcttctttttttcagtgctccattgaaaacatcgatagaaaataattaaccatgccagggatcagttcattttttgatgctgcttcttttcaagggtccctaagagcaggaacagtctggattagctctccaagtggtgacatttaataagttaacaaaccctaaggcggtcacaggatgcctggatccaaacatttttgatacctgtgctattctcatcagatatgtaactagagtctccatgcttttctcaaagatagcataagaacaactcccagctttgagaagttgtttgctgttttgtgcacaccccacctaccctggctgcagcctggggaacccctggatgcaggaacctgtgtagctcctccttaattcttagttaatccttttccttcaaaggcagtgatattggtatataaggcagggctactgtttcctggctgcttagaaacctcagttgtattagcagcagtgataccactgtatctagagcaagagatcatgatttcaggagttgagtataaaattcccaattttaattccagcttgactcatggtggcctatatgtaatttctcatatatctgtaaatgagaaaatgttttgaaccaaagggttataatttatttcaaattatttacttgaaataaggtaggacctaatgagaataactgagtaccacttattaatgtgtgaccttgggcaagttacttcacttcttgtaagctttggtttcctcagctataaatggagatcacaactgcacctgctacagagtgtgtgtgaggctcaaatgagaggatccatgtgaaagacttggcatagttcttagcatacagtaaatgctcaataaacattagccaagtattacattgaatccaaaagaatctgtctgtaaatcactccaaaaaataagttgtgaaattagaagttaagtagtagagctcagatcaaggtctaggactctttcctaagcctcactttcctcacaccataaaaataccatctttaactcttttcttggagaagacaggtacccagaaacgattctgtctctgtggaggtaatccattctaccagagctatagaaatgactggtgagattttttttcatttaaggtttatttttctccttttttaaatgattttgaaactaatattactcattataaaatatttgaaaagtactagaacaggcaaataacaaaaatattattcattatttcactactctaagataattgctatttaacatttttactcatttttcctattcaggtttttcacagagctgtaatcacactttgtatagatagttttcacttaaggttgtgtcttaagcattgttacccatcatggcaaagtagttaatgacatgtgcctgtggggtcagactaccaatgttcaaattccagtgtttccaccctgtgtgaaccacacacattattcattccctctctgccatttctccatctgtatt

SEQ ID NO: 126277 - DNA, 3828 bp, Homo sapiens
tgcccattgtttgtagctctgggatcaaaatatataattatacatgccaaataaattctaaacctgtaaggtaggaaaagagggctgggtggctctgacgacaggtgccagaagcattgaataaccttctcagacaaggtgcaccactgttgtcttgaatgctgcagggtccccagtctggcattttccccgtgctagacaatgtgcattcactgctggagtctctgttaagcctccgtctcccagacctgctggctcctggtgcccggcccgacacagaggtgcctttgtgagtgtaattacctttccctgtattagaaatagtctgtttagagctgtgtttgcaggtacagctagaataagcaggaattagcatgcaaaaagacctgccctggccctgacttctttatcagcaccatccttcaggactggttttttccccactttggattgattgggcaggtgatttaccatccaagatgaagagttttaaaagaagaaaaagagacatcggaaattgctgtgcatgtgcaacagcatgcgtgcgagagaaagagagatacaaatcctgttgtgttatatctattgacagtttcataccaggcagagctggcaaaataaacttgagtggacgatcctagcaacttgagaattgattaaagcttccttgggctttcagcacagtgtccacatcaaaaaggcatgagaagcaaaataaatgattcttttgccatgatatgctgccgccagaatctctaagcctatctaattggcctgtgtcaattgtggactattaatttgaagttaagtgaggcctacccttaaagaagcttttctagatcttaaataggatgatgatggagagactttggcatgatatagaattggaatggaggcagagttgataattaaactagatctgagggttttttcccagtttataacgtaggtctaccctgagatgatttttgttgtccctgtctggatattagtgtgccttttatttaaaaagaaaaacccaatagtttatcatctttagagagattagatgattgtattttgcatttattaattttccccaactgattatagtatatactgaggaaattcaggaccaatcagagaatgtttaagggcagagctgcctagaaaaccagtttaaaaaaaaaaaaaaaaaaaaccaaagcaggaaaatgtggggattttcttatatggcaggaatgtttaaatatttttttttaagtggcacacctttgtaacttattaattctcaaatggccaaagtaatatttttgtgttgctgatgcaggctctagggcagcatggaatgtttccctttgttataaagttgccttttcagaatggctgatctcttggtaaaaattatacatggaacaagtagaattcaagtcaaacaggtttatgttttgctgtagtactggagaatgggtgttcaccacaaagtgaaggatttatcaaggaatctgggagagaaacattttcccccttagaactttaagtctttttaacatcctgcttcccttttcattgtgcaagagcaacaggtcaggtattgcctaaggcagtcttacaaattggcacctgcctttatgcctaagacctaaaggaagtggtggggaaaaagaggccagggaaatttaataagtctctgtctttccttgggaattgggctttgatgcctggggtgcaagagaggtgaagggccgcctcctgacgcaactgggagaggtattttctgcagggagacaccagagaaggtgctaggagaggcagggagacacagccctcaggtgaacacatttgtgtcctttaatgtttgtaatgcagtggataccttacaaggactttcacacatattacttcattcattcctaaagtttcagttgtcccagtcacctgaagaagatggcctttggtatttttgacaggtgaggaagcttaagagcttgatttctacaggtgctcatcacatggctaggggtgacaggatgatcacaccaggtggaagttcttttgcttccttgacttttccatttcttcctttttctcaggtaatcagacaccaaagacttcttgcatatcctaacatttgttctagtctgcataaacactttgaccacattgcttgattcctggaaaacgaaatacaacccatttctaggcatttttcctttagtgttgcaattctaccctttcctcagggttatatatatatatatatataaaattgtttgtatgtttggtttttaatcaagccatttctcatctcagccatgtagagttgttttccagcatctcttgaagtacatctcacatctcttgtagatgccattgtaacagggatacatgatttactgtcatgatttcaggaaaggaagaagaaggaggttctcagaaggtggaacactcagtgggtccttcttcagaagacccaactgattcttcatgtgcctttactcttcctgtgcctcagggatgtttataatttcgagtcatgtcttcccatggccttctgatcatactgaagccacatagcataagacaggttaatctgcttctctttctcccctcgccccctttttttaaactttaatgtttcaatacaaaattagtgactgtttcctcctacgttttgttacattcccaacaaataatatgtctttgtttgaaaagctaaaagtggccaggcgcagtggctcaatgcctgtaatcccagcactttgggaggccaaggtgggtggatcacctgagatcaggagttggagaccagcctgcccaacgtggtgaaaccccgtctctactaaaaatacaaaaaactagctgggcgtggtggcaggcacctgtagtcccagctactcaggaggccaggaggctgaagtaacagaatcgtgaacccgggaggtggaggttgcagtgagctgagatcatgccactgcattccagcctgggcaacctgggcaacaaagtgaaactccatatcaaaaaaaaaaaacaacaaatgaaagaaaagctaaaagcttggttttagtttctgatatgtttttccaagaaataatgttttttaatttttattttttatttatttatgttttttattaagatggagtcttactctgttgccctggctggaatgcagtggcatgatctcagctcactacaacctccacctccgggttcaagcgattcttctgcctcagtctcccgagtagctgggattaaagtgatcttcatttgagttgattatttgatgtctaatttgagtatcttctggactgaatctacatgtggatgaatagctagcagcacttacaagaaggcttggggcaaaaagggaaaaggaaggaaaaacagaaactaaacgctgatattgttagccttatacaataacagcccgaattataactttttaaaaaactagttgtaagaaaaggattggatgttacacacagttattaacattatactgtatgttttccctttgaaagagctgggagaagtggaaaaaactcttagagtattgagttttggacttgtctctggaactacctccagggtgccctctgaacaagccaagggcatagccctcggtaaatgcacaattgatagattacccatccaggacgatagattacctgtccaggacgttagtttgtacgtgcctaaaatgactagcttgggtgtggtggatattgtgattcttaattagacatctaacactttgggggtggacaagatacagaagcctgagccggttggcagtacatgaggtagatgagtgcttctctgaatacctgtatacacagagtg

SEQ ID NO: 126278 - DNA, 1055 bp, Homo sapiens
aacacaaatagaatcttttcaaacacaatatatcttaaagctctttcctcattttatttaataactatggaaatttttttgtttaactgtttgctgttgatgaatatgtttctagtttgaagatatatcaagcaatgccatggtgatcatccctatgtatattttgacatacttttgtgattgcttagaaaagataaattcctagcattgaagttgttaggtcaaaggacatgtgcactttttagtgttaatagattttatccagtttttttcagtttatcccttttttcttggtaacatataagtactcataagattaattcttcagtttatcatcttttaaaaacttgtatttttacgtgctcacagccggacctgaaggaagcagttgtttagtctactttgagaacacattgccattctagttttctgatacccagggacatgctgtggttttacaaccagcctagtggtagttctcacccatccatttctacttttatccttcatctgagcatctgtgaaagcctcttcagggctttctttattttgtctcttgactctcctaaatccactgttgccacagcagccaaagtgatccatttaaaatgtaaatcatattaattcactcactcaacacactcattgagagcttactgtgtgccaggcactgttccagcctttaggagatggctgtttaaagccaagtccctgctcacagtatattgggtaggacagggcagctatcaagagaacaaagatatggccgagcatggtgccttacgtctgtaatctcagtatttcaggaggccagggcaatctcttaatgccaggaattcaagactagcctaggcagcatagcaagacaccatccctccaaaaataaataaatataagttagcggggcatggtggtacacatctgtagtcccagctacttgggaggctgaggcaggagaatcacttgaacccaggagttcgaggctgcggtgagctatatgattgcaccaccacactctagccctagcaacagagtgagatgctgtgtctaaaaaa

SEQ ID NO: 126279 - DNA, 4301 bp, Homo sapiens
taactgtattttgattcatacttgtaatccctaaccgttttgattgatgggacaagggctgaaactacattctcttgaggatagaatatttttatccttgagaataatcattcatctcttcctgacccaccttaccatttctttgctttgatcctaaatcttttttgttctttttaggctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaaggtaacttttttttttttttagtcatttatttgattactttctcatctcctaatgcagaaactattcttcaacatgaaatccatttttttttgcatttctacacctggagaagatgttctacccaagctgcagaggcaccttcatgccaattagaaggaggtgccccttcctgccatctgccaaaaaactatcctcatcaatacacaaatctaggatgactatgataggaatcgtgccctctagagttgttcagtgcagctctttgcagcaacactggctagaattttatttggatttgttattgatacgctgagttcagttcaaggagaaacctgtatcataatttattttctgatcctatgcatatggtccgatccatgttttctctatatatgtatgccttgtcttaattattataaatcttaatcatttttcatttagaaaatgttttttcagaatgattacaaaaccaaacttctagatgattcttgaaattttttattcatactgctctaccaaaaagttataatggaatttactagaactgtctgcctatatgccaacctataaggctttatcaaacataatgtatacacaagttttcaatgaagaattttttaaaaaaacattttacgctagcttgactaagtaaacctttagggatatgggagaaaaataaaatgtctacttaagatagtttcatttatttacacagaaatgtatacagtcacattatataaaattaatactgctttgtttctataaacacatatcaagaaatattaaaattattcatgaattttgaatcagcatcttgagctccatttaacccactttttaggtcatctgttagcatggttttgcagaatacattgtcttcatttttatcccaagctttgtaatttgaagcatttttgacttttatgtatgatattgttcctgcaaattttatcccatagacacataatattaagacagtcaattgcttttttcctattcccagttaatcctgaatggatataactggtccccataatgtaacaacttaccatattgctagagtaaacttgaaatgacttgttttgacatttgacacagtatttgtgagatcctcctcccagaaatacttttttactctttttctttctaacctgagttttgcaagtgacctcagtaaacatccagaattagtaataattgtggctgtctcaggagaatctcccttccccgaatggtactctgcttctccaggtcaagtgattggaaagagtactccatgatctgagactttgtgaagattgaatataaagtgatgccctcttttctgggattaattttagcaggggaaaattttgccttatatttaggcatatgtggtacttaggaataaacctgctgtttttttaagtagaacttaaaatgctcaatctgtgattctacaatataacacaatgttctatagctattttgcttaccaatttattacccagctgtaaaaaataaacactgttgtcatgaggcatagcattgatcaatttgaagaaaaatcatcttttctaaatttttaggctcttgcagtctgtaatatgatgtagcagcatgtcattttgacaagatgccaggagtctttcaatgggttgtctggtaaaaagcacttaggtactgtggcagtgactgttattgaaatgtctagatgagtaaaatggtaggaacttgtttgctgatacagaaacagagactgttaaactacctgcaaatgatacaatactgggacttagtgcttttcatcttcacattatttaataatcttaatcccctttaacacttcttggaagtagttggtatcctggttttgtagttcaggtgaatagaggctgccaaccatggtatctgagctgaaattgaggctcagaagtttcttgtttccacttttgtgctaaaattgctttcctgaaatgagcaggattgctcaagtttgagcaagagaactctcccatatgaagttagtttaattactagtctagtagtttaatctagttcagaagcattccacagggcttggtgctcccttctaaaatgctgtttttggtgtactggtaattaccaagaaaatcagtaatgctttgagcttctggaaccttgattttgttgcaagaaagtgacctagtaatctctatcttcctgttggtcatcagtatcagctacattcagagacccgggagtcaggatttcattcagcagatgttgacctctgtggtttggtctcctttcagtctgattagctcttgtattacaagtctggttggtcctcatttatatattcccagcattctgtcttgggctttgtttcatgtgaacctctcttctccagccccaccccacttcacctttacgtggtcagacatcacagcaggttaagatccatctttctagggagcatcacagcattagcattgctttgtagtttaatgtgtttttgtttcaggatagcactttttagtaataaagcttttctgtttctagtcctggttggctagaaaaatgcaaatgactaggggtgacctcacacagtacttttaaacctggtatgtgtccctccaggtgggtctttaaaaagaagaaccactgtcctagatttagttgagacaggtaatctttctccttccctctgttcttttgtttctgttgttaacattacaatgccagacccaagaagggtgagtggttggctctgtctgtgtgtttaggcctgctgagctttaaccttacctaaattggaaaatcaggctttctgtttttcttctgtattgacttgcaaaataagcaaactattctgacttcccagtaagtggcaattagaatacttgttttagaaatacatttgcaactgaaaaaaagtggaaaatggtaaacattttgcattcctaaagtaagaaatagtttagcacaaatatagtaaacaatgtaaataaagcccccctctaaaatgctaacatttagagagatttagttatagcacagaggatgtaggtgactgaagtgaaggcagcataattaattgcctttgaaagagctatttgaatgtaatgtagctaagaaaacaaatctgcaatgtctacttctttttaaaaagaattatgagaatgtatttccctttccctgcataacttctgttttattgcataaacccctggagcataaaaataaaagtcaaataaacttaacatagcaaaaaaagttgtatccatctacttttgaacattaccttttccgtaggagctgtcagagcgttaatgaggggacaaattatactttaggaatggaatgaaacttatcatttaacagtaaatggcagcacagctaattaggccaaaaagacgcttcgttaggaagcagtggaactgtccatgtctctttttgagtacaaaacatggtcagtgaagcaatgacagctgggatccatcaagcactgttgaaaagttttcaaattctataatcacaaattaaaccttgattctaccttggagggtcacttaggaatatggactctgtctgctgtgttctaatcaaaggcgttgtttttttccactgcatttgacagtattcaaagatatttttatccatatacataaatgttgtatacatgtgttcatctataatgtgtgtataaatgattcattggagctattgttcataaactcagaaagcaagttatgatatatcagtacattcttatttattctgccagttatctcaaagagagattgatttttttagtttaaaaagtaaaatataatttatatttcaaaaaaatcaagtaatttagaaaggtgtatgaagaaaagtaaaattatctctctaccctttactgctccattctcttcaaaggatagccactgctgaagattttatattaatatatccttaaaaaaagaaaaactttctgctcagattagtatttctctttcaaaaattttacgaat

SEQ ID NO: 126280 - DNA, 1505 bp, Homo sapiens
tcatcattctgccaaccgtaaatagctgagtccatatcacatgggaaatgtaggtgcaaattcacaaaacactcacgggctgtaaacaaccagggagttgttcttctcatggacctgcaggttgcagcagcagcatctgagcaaaacagagctgttctgagcagtagggcggggagcagcacgtctttgtgtggaccagaatgcaccagcctgtgggtgtatcatctcacactctacttcctagactaaggccctttcttgggcctttcagtgaatccaacccaggttggtattttgtgttgtcccccaacccaaacaaaaaattcatttgcacttaaggaagaacaagagtgacttgattaaggtatcaagttggtaaaaatggaaaaacaatttgatttagagagttaatgaacgaacatctttctttgattcttttcattaacattacacatattaggtaaactgtgtataggtgtttatttttctttatggaagtcacacatgatctatatagaaaaaatttcaaatacatcaaaaaaaaaaaaggaaaagaaagatacttgtaatcccaccacttcagaagcaccactttggtgtatttcttccacatggtggtaggggatggcagggggaaatgtgtaccagtattttaaacatatgagcatttttacttaaaagtatatattgaacatttttcactgttgactgcatagtatctccatgcatgaacatactcaagttcatttaacccatcccttaccattagatatttatgttgtttctaatttttctttccagcttttataaataatacttcaaaggccatccttgtagctagttctaattagtacagtatagtttggatgatataaaaatttcatatatgtgtgacaaggaataacaagttgaagtacagtaagaaagaatgtaattgcttgtgataaatataggcttagcttcaaaatagctagcttaaaatttcccttatagtgtactttaaagatttcactgatgatcttggaggtgaggcatctagccattgctggaatgaaataacacacgatgttcaaagtttggttggtaattgacttagtgcatatttttgctactttcatataccacttatctcatatgaaaagagcaattctgtacacaagtaatacataaacaaaaattttaagaatatgtaactccataaaatgagatttgatgattgacttgagtttctaagagaaaaaaataataactttcatctaagtttacgtgttcgctggcagtttttgaatcgttgccagaatcatgaaattcatcattcaagagcctttgtcctcctagtccccgttctgttctgtgtctcctcatttggatacgttctgtgtctcctcatttggatacgttctgtgtctcctcatttggatacgaatgcttttcattttattactgcctttgtgcccttggctttgagtcctgtggtggcagttgtttgtgcttcaaggagcatt

SEQ ID NO: 126281 - DNA, 1090 bp, Homo sapiens
tttaatgaatattcatgacttctacccttactacttcaagcttcttgagaatgagaataaagcatcttgtgtccttgcagttctaggacaaactttgaattgcttataaatatttggtgaatgaaaaatcaaatagcagaagtgagtctataataattgtatgcatttctctttctctcttagatggatccagatactagatgataactaagatttcaataacaaagagtataccaggaaacatgtagaaaagtcagtgttaccgctgtaaatataatatgccacactgagccagttcagtatggaatattttcccatgtcctacttgccacagactccagtaagtcatagggaaatgatttgtgacaaaattgcacacacacaaaaaaaacagtatcttcacacagccagagctttcaagtgatgagggacgcaaagacattgtgcacaataggtgttcctgtccattgtctgccgattcagctatctttgatctctgcaaaagaggaaccatgggtatggtactgtgaatgcataatagaccaggaattggaagagcggcacgcagtgtgctgctcagtgatcaagtcgtggagagacccagacaccatgcatctgatgataagcatcttctcttggtgccttggagtctctcatttccttccagttcgactccaaagggcctgtttcatcttcagcacctttacaatgtgccactttgagtctgtaggttctttctttcagaggccaccacagataatgggtacatcattatgttttcttgatatcactacattctttcttccccgtgcatctgcctcctgcagctctctgaagtggatttgactcctcatcatccctagtgataactaactctgctttaaaagaattgttatctgttggttggcttggagtcagggagttgagtgtaagttcttgttttattgtatataatgctagcaacttttaccagtgttagtaaagataagagataataagacaattccgtacctaagaattgtaccctttcataacagcaccacttggatatgtagaaagagtttgttgtgagatcagatgtaaaacaaat

SEQ ID NO: 126282 - DNA, 1034 bp, Homo sapiens
agtgatgccctcatctgtgtctctcatccctcttaactcacccttccactgccttctgaatgtgtcattattcgtctttccaacactttgttcctattacacagcaaaaacttggatcctttctttgagcttacccactctttttgccctatattcagcagccaaatcctgttggtctctgttgcatccattacccagccacctctattcagtatagatatgactgttctaattctggccttttatcactcacctagtcggctaacaacctaattgtgatccctgcctcaggctctgcctcccggatgagccctctcccctctgctccctaggcatcttcccaaggcatagataatgctcagacctctacagctcctaagctgtgtttaccagctctcctgctgctacatagtcgcacagaccatctccagaatgcagcctgttctaggcagcatcctggaccttccatgagttggctccagcaatcttattttcagccaccttctttcataccccttctccatgccatctagagcaaaaggctgccatgataagaactgtaagtgtgccgctggcatccagccacttgagcttggaatccaaggttcaccttcctagctgcatgactccaagcatgttaaatagcctcctttactttttgtagcctcagtttcttcactgaaaccaggattttatttatttatttatttttattgagacggagtcttgctttgtcactcaggctggagtgcagtggcacaatcttggctcactgcaacctccgctgcccgggatcaagtgattctcctgcctcagcctcctgagtagctgggattacaggcacctgccaccatgtccggctaatttttttgtatttttagtagagatggggtttagccatgttggccagcctggtctcaaactcctgacctcaggtgatccacctgccttgacctcccaaagtgctgggattacaggcatgagtcactgcacccgacctattatttatcttattacttaccttataatattat

SEQ ID NO: 126283 - DNA, 1971 bp, Homo sapiens
aatctgtttttaaaaaataaatagctatatcacttccctgtgccaaaccagaagtgtcaacaatgaagtcattatgtaacatggcaagagggattcgggtggcaaaaccgtaaggaggagaagaagaaatcaagcttatagaagcatgtagacactgagtgaaagacgcagtgataggaaccacagtttggtttttttgcagactagcccatttcagagaaggcggtattagaagaaaaaacctataattttactgtgagccgtgaggaccatttcacatgaaaaaaaaacagagcatttggaaataatgatgcttcgtatcagtagaatgctgtgcgtttgagaagcttggcgcttggacttcatgctgacatggttgtagtcacagtcctattgccctttctggttgctctcagcactcctggatgcaaaggtgaatttatgaagatcatggacttccgatacaaattacagcagccaaaactgtcatatggagatgtgaacttaagattgtattggtagataggtgaagcacccattgctcctatcttgaaatgactatgctatatttagacaaaacctacatcagtataattattttgcaagcccatttgaagaaaattaaaactgtcactagttatatatttttgagcctaaaatatttctcacggctgggcatggtgtatcatgcctgtaatcccagcactttggtaggccgaggcaggtggatcacttgaggtcaggaatttgaaaccagcctggccaacatggtgaaacactgtctctactaaaaatacaaaaatttgggaggctgaggcgggcaggtcatgaggttaggagattgagaccatcgtggctaacacagtgaaaccccgtctctactaaaaacacaaaaaattagccaggcgcggtgacgggtgcctgtattcccagctacttgggaggctgaggcaggagaatgctgtgaacctgggaggcagagcttgcagtgagctaagatcatgccactgcactccagcctgggcgacagacggagattctgtctcaaaaaattggctgggcatggtggcgagcgcctgtagtcccaagtacttgggaggctgaggcacgagaatctcttgaacctgggaggcgaaggttacagtgagctgagtttgcactactgcactccagcctgggcgacagaacaagactctgtctccaaaataaataaataaataaaatatttctcaaggattcagatttggggattttactgccaagtagcctggctttctcattattgattaacctacaaagaaaaatttgatatatctgatgaaaatcagttatattgtacctacaaaaacatctcttccatattacttgatgtattttaatgtcactgaatccattggtttatctttatctcttagaagctcttaaagtcacaggaattctagtccatatgatcagattaaccaaaaattcaggcagctactccgttcaaacaggaaagaaaaaactgaaaatgaattgttgtattgaatctgctttttcacaagagacaactaggcgtaatggttctgagcgtgggttagaaattgggcaagtcgcgttcacattcttttactaccttgaagagaagtctctgcctccatctcatctctagaaagatgggaataatatagcttgtgtcagcatgattgggggattgaaggagatgatgtctgtgaagagtttagcacagtgcctcctacatcagaagtgcttgacacgtgtctggctcttgcttctccaggaaggagaggaggggagaagagagagtttgcagggccgtagttattcaagtagttacagctatctcttctttctggtcacactgctgggtaatttgttcttgaaaagtgtctcaagatgactgctcccacttagtagctggaaaatcacatccttccagaaagggatctagagggcagacatgggtgaagt

SEQ ID NO: 126284 - DNA, 3563 bp, Homo sapiens
ccagcaaagaggaattaactccaaaaattagtgggagagtaggggtgcaggaattgagggaatagctgtaaccatggctaggtgtctgcatatccaggatatttcacaagaaagtattccatgatcacccagtaatagaaccaacctttataaggctcctatttattttatttgacttcatttctaagaatgacaaataaataatccccaaatatattcagaatcttaagaacaggatgaagataaacaacttggagcatttggtatagcttatttattatggcttgtattttaagtagaaaagactttattgaatgactaacatgaaattatgtcagagtcatgaaggaatcatagaaaagaggagctttaaaaaaggaggagccaattaatagccaaaaaaaaaaaaaaaaatgctaacctcatggcactatctaaattggcagatttctgaaaagccaagaggcagctccatcggttttctcaaaaagtcctccaggcaatgggactaaggcattggtcttgaatagagttccactgcttgcctactccaatgagaggctctttctccagatgatttcaacttggactgagggcaaaattaaaagaaatatctgatggtactaagggctcatgggtgctatagattgaatgtttattttccccacaattgctatgtttaaacctaactcccagtgtggtggtattagaagagtgggacctttgggggtgattaggtcatgagggtggagcctacagtttgagattagtgcccttataaaagggatcccagggaggtccccactccttcctccatgtgaggacacagtgagaagacagcatctgtgagccaggaagcagtgctcaccagattccaactgtgccggcactgtgatctcagatttcgagcctccagaactctgagaaatgaatttatgttgtttataagccacgtagtctatgatactttgttacagaagcccgaacagactaagacagttaaggatagcctccctggctaagggctgccttcagtggctcagaaatgtcatcttattagaggaaagtccaactttcatgctagacactgggccagccagatacttcctttctgtttttctccctttaccttctctgggaaagtctcagagttgtttgactcaacacagttcaaatattgggccatctttctggatttctagtaaatagggaggagtttgttacgataggaaaatctgaagaaagactgggccatagctttcatacagttaaggtactttagacattgaaggtctgtaaatcattaaactattctggtagtagtagtcaaaatacacatgtataacaggcagaccccaaatgttaacatatttgacaggcctgtaagttaattgctttttaatgtcagtcaaatggattccactttggtttcttggccaggcttctatgggcccattaaaaccccatgaagctgaaaacatgaaacttaatatttgtaaaacatgtaaacagaatagcctttttctgccttaccgtgtggttaagaaattaggactaggatatttcagtttggtatctttctcagaatccaattagagtaagaatttattttattatcttttcaatattgttaataatctagtaacacatttttcacttaagagttttattttcataccaaatcaaaagaaaaaaaaattctatattgctttatgtttagagatgtgcatttggtcagacagtctaacttagtgtattcgtttggtcaggctgccataacaaaatgcctcataccacagagcgggaggcttaaacaacagagactggaagtccgaggttaaggtgttggcagttttggtttcttctgaggcctctcttcttttcttgcagatggccgccttctcactgtgtcctcacgtggtcacccctcagtccatgtgtcgtctgtgtcttaatctctaattataagggcaccagtcatattggattagggcccatccatttgacttcatttcttcttaattacctcttaaaaggccgtaagtccaaatccggtcacattctgaggtcctgagagttaggacttcagtatacaaattttggagagacgcaattcagccctaatgctagggtttaagaaaaggtctttctttcagtttgtgaggactcaggtttctgattgcaggagggtgatgatgtatcttgtgaaggcagtgagcccaacacacttcccttcagagctcgacagggtgagtggccttccgacctcatgccacctcatctttgccagcttctttgtgaggttgctgaatgccgtcttcagcacttgtgaacagttttgaacagcacttgactgcaatttggcaatgtgttttaatttattccatccactgctatttgctgaatatctcttttttacctgtgagctctgcatacaataatagttggttacatacaaattattttcatgtctctatttaacattgagttagtaagaaagtaaatggaaaatatgttgaaccttagattcctttacaagtctttattttctaatttattcaaatgtcaaacactgtcatcacttgtgtattcgtcttaatgaaacataaatcactagacatttattactatatatcttgtttgtagttacaattgtgtttgtgtccagataatcaaaataatgtatttgggtttaagtaaaagtctattctataactttatattaatctatttttgacacgtgtaagcacgcattttagaatgtcagtgtgcaattagatattcttagcacatgtcatttgtgaaaagcactttaaatctaagtacattcaattgagcataattaaaatatcaagatacatattcttcatatacattttgcctcttaattttttaagtagctataagtatctaccatgtgaattcaaattaaaggagggtgattaaattacagttatatttattgcttttagtttaaaatatagttgaaattgcgctatattaaaaaatatactgccatgttttctgtggacagcagactgatgatgggtttaatttgttttaatgcaagactattaatagtctctgaatattctcaagactgttgactagaatgattgggggttgggaggcgtaagaaggcttgtatttttatctaatgagttcttttgacttgactcctgaagtctcaagaaaatgttcaggaatactacctcatttaataaagaagcattggagaaagccttgttttgttgatacaaatgaaaggaaatggatcatggggaaatatgaactggagctcctgaacccttatcctttagataatgtatttaggctactgatatttcctatcattgtgaaaatgagcagacagccttggtgagtcagttttaaggcacatgtaactgttaaacctacttgtccacaactgttggacctaaagtatattatgattttagtgaaggccattgttcttggagtacttagagaaaatggggctgtacgttagaactctggattgtgttgcctttctaaaatatttgatttcttaaaattctgtttgt

SEQ ID NO: 126285 - DNA, 1096 bp, Homo sapiens
gttcttgccagccacctagcctttctctacagtaggagacagcctcttttcatcccttgccccagccccagctaattagcttaagttgttcagttttgttttgttttccatttaattattgagagaggaaatctgattggcaaacctcatctttgtgcgccaggccatacatatggcagccttgagtcatggcgccacccagatattaatgactttgcttaacatttccatttgtttcaactacctgtaagtgtcttcaaacctttcttgtactgttttgtttttagctctgaattctgtaagtttgccctgaatagtattgtgtatactttggtcataaaatatactcaaagtcaccattccttatgattgaacttgaaatcccttaagatttcatactcactcatatcaaaccaggaagaaaatttcctcatataatgaatacatatactctgacaatcagagctgatgagacagattgcctgaagtggatttaagtcttacttcgcgatctttttcttcccaggatttcctgtggatacgtagcctcatagtgtggttttcttaaggtagaatttttatttcactatgcaagtctctgcacatatcttacttataaatataagatgatgtgaggcttaatcattaggttgagtttttatgaagtcactcttgtgtgacatgtgaattaatcaagatacattatgcattatagtgatgctatagcaataatgttaatttttttaatgcttgtatctttacagtcttttgtagttcagtgaaaatctagtgattatattgttttcaaatgttattattgttattgtttggaatattccctgggagaactttttgcctactccgccaaaatgtaagaccatattaaagattttcttgatttgtacttgcactttatctctgccttccatctcctcttgacttggagggttggagactgtgtctggtattatatgacctgctgtctttgtcaaccatggtcactgctttgccacttgaggagatcttccttcataactttgtgctgacaactaattgcatctcacagaccttgagtaaatggctgaactgagacatc

SEQ ID NO: 126286 - DNA, 1095 bp, Homo sapiens
tgttgaggacctcagctacctcaggtgctcctgaaatctctggtcttctttgtgaacctgcttatttgccatttctctactgattgatttcctctgctgggtaacatagcatctttattctaaaaatgactttaatttcatcctgtgtccacagtgcatgccaatcccagttccaaggctttcctcctaacaggaatgatctcagtgtttctccatcattgaggaggagaagtgttctgattatctattgctgcataacaaataatctgaaaatttagtggcttcaaatagatacttattattattctctcttgtggttctatggattgacggggctcagcctgggagggttgtacttgggatccttatatggttatgggctagtggcagctggggccagactcatctgaagggtcaaccgggatagatatccaaggtggctcactcttgtaactgaacagctggggctgtgctccagagcacctgcttgacttctctgtgtagcttggtcttttcaaacattgacaatttgattctgagagggagcctcccaagagcaggcatcttaagagtcctgggcagaaacaagacttcttatgacctgaccttgaaggtcactgccagtgcattctgatggtcagacaagccagttaggctggcccagactcaacaggagagaaattagaccctacatcgtaataggaataatagcaaaggatgttttaactgccactggaggattcagtaagctgtgttgtgggctgggaacatcttcattgcccttcaccttgtgaaggtttcatagcccatctcatgccttctctgagggtctgttgctgatcctagaacccattcattctctagattgcttctggtagcagggggcagaaactcaccaaagttggagttaatcaaatgaaggtttactttaagggtacccattaaatgaaactgaaggctcttgagaattgaggcagcattaggaactggctactctctccattttctctacttggcctttgtctctctcacagtgactttgcatccctctgcacatcttttgactattctaatccataacttcttctcttcctg

SEQ ID NO: 126287 - DNA, 1058 bp, Homo sapiens
ctcatctcatacattacattcagttgcagttaatttatattttgaaaaattttgaaaaacacaacaatacagacacaggtgtgcctaccacttagattggtgacaaacttgacagtgcagttggaggcccttaatgtacctgtccaaattgcttttcattcccttacctctgtctcccaagagaaaactctgtcctgacagtggtgtttttcattctaagcatgtctctctactttttattacctgtgaatatcctaagcagtataaatgtttgtttttgaatgcctcatcctaacccagtgctctaggaacacctcatatgattcccagattgatgcctttgcattttttcccattagtgcaactcatgtgctttgcttatcagaaaataatagtaaatgggagtattacattcaaagtgttggaatgcggcagatactgcgtatgtctgttacagatgtgtgggtttctagatggacttatggttggaacagtgtattcatttaaccaagtttttggttacttggggtttctccctagacaacagtcatttcttcagtcttatgatttaaacttatacatgatacttagtttaaaaatgttaaccctccccactgccagcatacgctccctatctacctatcagcctgccttcccatcatccctcccttcttcttctgctgccatggttcttaccaccttcaaacattctgtataacttacttatttttcatgatttttgtttattttctgtctccttcatggtagagtacaagttctgcaaaagcagggatcttcttattcattgatgtatcctgaggactgcaggcattgcatggtaacctgtagactctttgtaaatattggttaaatgaaagaattttaaagctaaaatcactcaaaagtgatcttgtcaatcttcacagccaatcaacgacaaatctgataatggactcatttatatcttttctttaatgttagtcaaaccccttcccatcattaacaataaaacttatcacctgtctctccaagccatacttaatgataattcccaaatc

SEQ ID NO: 126288 - DNA, 1882 bp, Homo sapiens
ccttataaaacagttttaagttgtaagatgtatgtttttattttgtcactattgtcagtgtgtctcccttcttaagctattctaattgcagaacatatttttggctttcatttatcttttaacttttctcctgaaacatcagtgatgcatatatatttttcattttttaaaactattatactattaagagtacttctcaaactattttaagatctgttaaattgtgcaatttatgattactccaatagactgatagaaaaaaatagcatatattgacagatgcatatttataagtgtttaatgactttctttatatttttcatcagcttctataaatatttttcttcaaggtgaacgattttgtgagggataaatttatgcacaaagatggttcggtcccacttgcagcagaaattcttgctggaggctgcgtaagtaccttttgaagctctcttcattgaaaagacttgtttcacatatatatcactaccatggtcaacaggtgtggactaaggcttctgtttaaccacagatcctgcacaagggcagagtctactagggcacctcggcttttcctagacaggcgaaccattccagaggtggaagggtaaatgtttctgaccttactgcctgttaagtcatgcctgttaaattcgtcattgcttatggtttgttctgcaatggaagtcatttgtggcagaagtgtttggcctttgaaaaatctttgctaaccttttctaaagttaatttttagtacattctttcctcatggcaccctctgctgggtcaggcactaaaacttgtagtctgaagtcagcaaccgtagctctctgcttggctttgccttgcaagtggcagaactgttcaagcttccactgcttttgggagaacaatgctgggaaataactggctgagtgtgcgctgcattgtcaaaaatgcttggaatgattgtttccttatatggatgaacaacttgcatcttgttctgaagctcagcaaaacattgtgtctcgttttatctcgtactggtttgttcatgcgaatgtaaatactttaagtaaattaaactcttatacaaagactagtgttatttaaagataagattggttaaataacaggctttgatcactcaggcgatacaatattggttttttttatccgaacctatttcttataaaaaagatgaagtcacttttttaaattggcttactctgggcaggaagtagtattcctaaagtaatttttttcttgaagatccttgaatgtagacgttgggcaatgtttgtgtggaaagggcttattgtcctatctaatggtgaatgatggtttcttaaatgtagcaggacctaagaagtcctagctcctggtattctttagagatggatggaatttggctactgcctgactctctgtttgatcactgacctgttggagatgggcaggcaggatccccttgttctgtaactttaggagcgttcaggatggaaaaaaaggagcctttaatgtcctaaatataaagggcacacaataataatcaaagagaattttagaagttgctcttccccataactactctccatttaaaacaactctgtagtttccatttgagtaagtaggttttctaatttttgagtaggtatatccataggctgtgcctagcctagtccttcaggttgttgcagggcccaggatatagcagggttttttggtaggtcaggtggggttgttgtttttttaagttacattttaaactttctgaaaagatatgattatagatttctgtaagaattaaaatgtaaaattaattatgtgatactactcaagatgttggcaatcatcatggcatggtgcccagaggtttattttctttttaatgaaagca

SEQ ID NO: 126289 - DNA, 1256 bp, Homo sapiens
tttgttactcaataaaacacacttataggttggatacatatggcattcaagctagtgacctctcaggctgctcctttaggaagagagtgtgggcagggctggtccctcagaagaggctgtgagtggactttcttacatagataaattagaaaattgtacttccaatgaagaatattaccatgaacctctctcagtatgacacagggtgcaacatgctcctaccttcagggttagcttggtgtgtgtttccaagaaaaaacaactgtgatttaatttttttttctttaagaagaacaaatgaaaatgatgacattttttagttcagatacgtagctccactaaatgttctaactgccttccccaaaattggtccttgttttagaaaatcaagtggtccactgatttagaaggcagaagggaaggagcagactttgggggaataatgagatttcctatatcactaatactgttgatttacccaatgtgcaaacgatccagaatgtgagatggaatgtacttgggactgatgcggctgttagaagttagtacttaaacattccatttcaaatattctcattaagggtaatagcagaaaattgcagcagagattaagcagtttttaagtggtaatcccctctgtagaactgttgatttgtttagttaatgctaatttatttaatatacttctactttttgttgatttttaggtctgttgccacagttattgggagttgccccagagaaggccataaaacttacagtaagtcttttgagttggtgcttcttattaagggattttgtacatactcaagaatctagcaggtattcttataggaaacagcaggtttgttttctcagaggtgctagctaatttgaaagcaggggaactcaccacacacattttttcattattctccatttagcagtggacatccaaaaatgtgataataaacttgaggacttttggtggttgctgccatcattgttgtcatcacagcagtagcagctaaattcccttcagtatctaccatattaggcacatgacgtatattacgttttactggtttaatctcaagcaaagcatgatccacagtttacggataaggaaactgaggcctatcgggcttaagtagcatacctgtgttcacacaaatcatgagtgggagaactagaatttaaaatcacacttgtctgactccagagcatgtctttctattacacctgctgtttttataggattcatggttagggtgtgt

SEQ ID NO: 126290 - DNA, 2468 bp, Homo sapiens
ctctgtggtcctgctagcgttgcccagcgtggtcctttggcaccctggccactctgggttacagtagccgctcagcgtggcttcaacccactcctgaccctgcgccttcttcccagtatattcctgctctcactggttcaccaggttataacctacagcttggctctgacattcagtgccttcgaggttttaaggagtctaatattcaccatctgtagagacgggggaagcatgatgtggatgcctgctacatgggcaccatccctttgttgtgtacaagggtcaggcagggcagggtgctgacccagcctgagctgaggcctagagaaaagtttcagaacagtctagttgggaagaaatgcctttccagggcagaggaggaacttggagcagtaagtctgttagagaaaactggtaccgcagagaattaaggagcacagagccctgatttgagagtactggcaggcctgaattcaactttgagtgctactacatagtcgctcagaagttagtgacttgaaacaagctgcttagcctgtctggattccagtttccatgaaggaggaggaggaagaataagtgatagtgatgatgaagatcaacaacaacaacaaaaatccatttctgtagtctttactgtctgtacttggtactggtctgaggattttgtgagtgttaactcatttcatcttcacgactaccccgtgaaaatggcatcatgattattcccattctacagatgtggaaactaagatacaaagagattaggtaacttgtccacaattacacagctaacaaatagcaaagtcagaattgaagctcagcagcctggctccagacctcgtgttcctaatcacttggctcttttgtcacctggtagaaattacattgtgaaaagttgcttgtcagcagaggttaaggatcatttaagtttttaactataatattttatttcagcttaataacatagttgaaatgtgttgttttgtctgtgccactactttaccttgcccaaagtatacagggcccctggacacttccagaccacatgtgctctcactgcttggggacagctgttctaagataggcataatgtcatgggcacagcatgatactccttagctaatggtggactgtgaacatgattcaggctgaattgcctcttgcaaacaaaagaaatcaaggctatgtattgaaaagataggtagaaagaagcattatgtcttttggaatacataacatatgaggtaaatagtgtctggttctttgtacacttattcatataattatcaaaataaaccaatagatagtaagtagcacccttgttttgccaagagggaacctagaattcaaagaattactacccaagatcactcagtgtgaaagatgcacagacctagcattctagcccaggtctgtccacctccaaagcccatgccctagattgttcattttgctgccagcccgttggaaatagcctaaaattagtttaaattaggccagcaatattgagtttctttcataatcccttccaaccctgaaattccagttatatttctaacaggttcttaagaatagcatgctagccctctagttgaacacagtgggcccaggaacctcttttggggatgtcctgtgaagcttgagttggagacccctgatctgggcttggtccccacaccttcagctccttggtttgcgcaagggactgaattcagaggggatagtgtgatttatatctccaacccatgaaatgtgaagacaaaatactacattaatactgtaccctgtaaatcttttctcgcattagcagccttctggtagagtcgagttgccaaggaagcattgccatatgtgctgatggagctgaactaaaaggagaagattggaaaactaaccacactaataaatttcttttgaggcagttggaaaatggactgctgttttgacaagttagaaacaacacacacatccattctctgtttcaaatggttaaagtgaatttccaggacccaacagaaacatcttatattagaaacctgatttttctgctgaattacccagatgtcagatatatatgcactttagacttaattgtggttgtgatgaagtgcctcacctagactctctgctttaggcattactgggctgtgctacctctcctccctctgaggtcaaggtacaaggagggagtttggaattcccacctctttgacttttcattgtttcacagatcatgaccttcttacaaagaccatttacccaagactcatgttttcaaggcccacatctgtagtgggcctcagattataatccagtcaccttcattttcctgtttaaccagacaaggtagtcactacaagaatggttcttatcaacaacttccgtgagtggcagcatctggcctaggtcttaggaatggatttgtgctttggttttattctaagttgaagttaatcatttaatat

SEQ ID NO: 126291 - DNA, 1035 bp, Homo sapiens
ttaaaatacagtatcacaaggcagttcaaactcagctgctttataatttggcagcggcaaagctggcagagttttccctcctctcccctactaatgctctctctagatgaagaaaacagtatttagtactctgctgaggtggacggtgaaactggcagacatggaaacctgtgcctctgggcctcttctgccatctgctgactctagtcttcaaattaattaccccagttaaaaaaaacaaaaaggataaacctttcttgaaacctctcaccttagaagccagaaagtctcaaactccagagaagttccattttgcaggtcctattgtgtaggtaggtagcccccatcaaaggccttttgatctttgctctgccctcttttccttatcccctgcctcttcttacaatttggaaggtctttgacctcaggtgattgatgatgaccctttcagggtcactgccttccatttgaaatgcttttcttccctgatggcaacaactttgcaaatgaaatggcttccaagtagtacaaggttaatgtcacagttcctattctgcagtgagtcaggcaaaattggccgccttacctgtccatatgggtggtttttggaagggaaatctcgagtctcaagtctgggcagacatctgagcattgcttcataaactactttttgggcttttcttggtattagattaaatgtcaaggatgcctttagaattgtaagaatgcttcccaacactgctcagtgtctttaatttgcttaagttgattttttattttgagtccttttttctcgatctttgaccatacctggcaggtctgatttttggttacgtctatatttcccttttgcaacctgtactgttggcaactagaagtgtgcctgagtactgagtgctgagctaatgtgggctatgcaaagaggcttccactcttgccgtttcagttcttttatctgtaagatgagagtgactgcttttaacttctcagaggagtagtaagtcaatatattaggtacagacagaggctcactgt

SEQ ID NO: 126292 - DNA, 1163 bp, Homo sapiens
gttgctggaggttagtcatggatgagagaaaaattttcacttttgttattcctattctcttttctctgattttccatcttgaaatgttaaaggacaaagtcttctctagtctttcccaatgccagttatcagtttctacctgtgaggtagggcaagagtaaagggaactcttttcccatacctgcatgtgatcagggacttacaagtggcattttcctctatctacagatcaggccttccaaagacaggttactaatgaggttgggctgtagcaatgtgccttaatttaaaatatctatgacatccttttattaggggatacttgaatgaaaaccctcaattgtttattaaagatataagaaaggtagtactgttttaaaatctgtatttaaaattcaaaacacatttcttttctcagtcttgtccttgactttaactaccttcttctttcttctgacctatcttactttcttctgagataatgatattgtttaattttagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggttagtgccacatgctcaatacctgttaggtgaaataacactcaaaggtttggtttctcatcttagtgcctgacatgaattagcaagactgcgttaaaatggaaatacagcagattttcaattatccatgctaatgggagtaggctggaggcatctagggcttggctaatcaaaacagcccataatctgaaaattatttatagtgctctgttgtatgttttatttcttaaaataataaattatttttataagcatcttccgtgaatttttgaaaggctcacattgtttgcatccttgaagtactctattctccagctaacagggaaaggtattctgccaccaggacaaagcctactcaggattcatgattttcctggaatacaccacaaaaaagataacgaagggttcagtagagctctcttttgctgcttcatcctgaattaaagttgccccttttcttcatctgactctcaacccaatggagttgattcacacacccctct

SEQ ID NO: 126293 - DNA, 1069 bp, Homo sapiens
cagttagcagatttatatgagccaagggggtaagttggcttttttttttttttttttggaattagcttaataaaaggaggttaggaggagggcagcaatcaggagaaaaagaagccaaactgaaggctatactgaaatatgagaaatgaaaaaagggatgtttttaaattttataatgtaaattgtaataaattggtatatttgttgcttgtgtttgtttttcccctacagacgtatgaccttagcagacattgaacggattgctcctctggaagagggaactctgccctttaacttggctgaggcccagaggcaggtgagcaaagaggagcaaacttgcattctggggtttccttagcaggataccccaaccctgttccacttgcagttgcctttgcggcattggtatctgacttaaccatttttctgttttgcaccaaaactctcgataaattttaaaggctgtaaagagaaattgcttagaaatggtgtgataaacaggtatttggcatttgctcatttcttgctaaggtggagtgatttcctaactgcaccagaagcctaatgctccgaaaacatgaaggaggtcttttctcctttcttgaagtctcatgttgagagatgtagcgaaagaatcccgtgttggtgtcactgtgcctgtcggcagctgcacgttgctaaatgaaagccgtctttgctctgtggagcagcccttcatcagcgcatcgtctaactgccatgccttccgtttttctgaatatcaaaatgagataattttgtttagtctggagttacagtttaaaggctttcagacctattttctctgtgaaaggattcataagttatatggaaacaattttaggaatgctaaattttattttatggttaacagaaaccaatctcttgaagttgtgggagtcagaaacttaagacatggaactttctcctttaactcttacccagctttctgtagatcaggattagagaagaaaagccttcatagcatgtgttagtaaaataaatggtgtttgtaaaataaatccactcacaggcgagtgtcgtttttaga

SEQ ID NO: 126294 - DNA, 1048 bp, Homo sapiens
tcagctattttaaatgattactaagtgaagatttatgtggttgttaccttgtaaagaagtgctttcctaataaaaatattttgccttgctagggaaggatagaatttgaaactccaaactgaagtctcattcataatggacattctgtctgtttcccttgtcccctgtgaagaaatatggtttcttaaaaattctgattatcagaatttttactagtcttaaccccccatgaaagtatatggcatctcataattttaccataatatgcttgtttgctagaaatcccaccaatgtaaagtctgtacctaaatgattatttattactggttataagtaacttgacaagtcttgatattaatgttacattgactacttttcatagtatgtttgcattgatacaatacagtttttcatgcataagcacacacatgtgtgcatatgtacttatagtttttgcatgtttaagcctttaagatttgctcattagatgaaataaaccaacttataaaacatttccaattgaaatttgaactctaaattactactagtcctgttataatcctacacatgtatttatttagttttctaggagttgtgtatggagagtacaagttctggtcatgattagttgcagttgcttctaaaaatcatttatagcttttttttaatgcaaaagaaaaatacttatagtcatttcttcttgtacatgcatttttgattactttcaaactagttttagatgtatgtacttctgaatcatctataaatcttttgtatatttttcttctctcttgttttcaatttatttgaggctgctggaggtaccacatcccatcaagttagtttctcctattttaatggatttaattcgctccttaacaacatggaactcattagaaagatctatagcactctggctggcaccaggaaagatgttgaagtgactaagggtgagtgagaatatatctgaattctagcctgcaagtattgtggtgtattattattagggtgaagaaggcaactagtactttattatttttctatccca

SEQ ID NO: 126295 - DNA, 1007 bp, Homo sapiens
catatggctctatgcagagacatttttgattgttatgaccttagagggaaggggctacttgtatctagtgggaagagaataggggtacacacgacagccctcccgtaataaagacttaccctgtccaaaatgccaataatggcaaggctgagaaaccctgtgttggagaaatagcagagaagaaccaccactcttttctatctattgttacatcatgtgtttgggtaccaggttgcagttaagaatttttctcttttctttggagagaagttaaagtccctggcagtgtttttcctcagatcatctgcatcacctaagctggggttggccagatctttgaacctacaacacttcattccggttttcattttctttgtgttcatggactctagagagcacggaagtaattgggtttcattgggtagcagagtaaggtagagtgcactttctcaagacatgttcattggtctgagcaaagttctgtctcttggaaggagacagtagcttggtggtgctattaggcagatgagggcttgttagatcaagatgtaaactctctttcttcagtctgattttaaaatgaactgtcatttgtagtaattattaaatgagaagcataaattaagtattttactttctttatttgtaggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgtaagttgtaacttgccctaatgaagtggtttaactcagtaaataaggaattataaaaacaattcttataagttatgtagtgttttttttctgttgcaaacactaacattttaatgtgatcacatacattactaaactcaaacaaagagtgtgttttggctagttttagtgggtaggttaatttgttgtctgggtaatacggaatatcttc

SEQ ID NO: 126296 - DNA, 1017 bp, Homo sapiens
gtgaataactgattatgatgtaagatcaaataagacaagttttataattgatattcagacagggggccaccggaagggacatcagttatttccagttataaggcctggttatatttgcctaagtggtaccatttgagctaagcttaaaggaagtggcaggatttcaggagctggagaaaggggcagcagtctacactaggtggaagtaacgatgtgggcaaaagcccaggtgtgtggcaggtctggcaggggtgggcatgggtgataggagatgaggctaagactagttcctctgggggcttgtatgccttgcttcagagacgggtctgtatgatgaagggtcattggagatttccatggagggggagggagtcaggtttttaattctgaaaagcaactttttatgtgtgcatggtagaccacagaggtccagactgcaagcccaagctccagactgacagtcagaaccactgactctcagtgataatttagatgaggtctgaggaaagtctgaaccagtagcatcaggaacaaaaaggaaaaggtgcatttgggcaaactttcaaaggcctaagggacagaatttggtaactggtttactctgggagaaaggaagcttgaacaattcagaatgacagctttctaggtgaggtggccaataaaactacatgcctaataattaagctgtgaacatagaagagagaccaggtttgagcactgggttgggggatctacaatatggggttagcgatgtgtcattttatggcctttacacgatacccacgtggatatattctctaaacagaaattctggtccagcagaaaggaatgagacttgaatatgggagttaagccttagcttttaagaaatccttgagggcttaagagagagagcactctgtctaggagagtagagtgagaagatgtgaggacagagggccaacagatgcttcccatttaaggagccagtggtggaggctccagaaagactgggatcccagaagagagtttcagctg

SEQ ID NO: 126297 - DNA, 1060 bp, Homo sapiens
aaatagcttttgaggtgcaaaccaggagctttgattttaagtcattctgccatgagtagtgagcctagtcatttatttcaaagaccacacatttctttcatatttacggagtaacctatgtgttagctcccactggcctcctgatttaattttttcctcctttgtctcttggggctatgggaaagagagcaaaaagggagtgaggccaggagaaggccttttagatttggtttctctcctccttggtctctgctactattggtaaaacaatcctgatgctctgggtgtacagaagccctttgccttaatggaaaactttagggaattttattatttttccacaaaaataggcaacagtaaaatctagagcattaaatgcaaattgagtttttatctttccacagctgttaagatttcttagtgtcaaatttattttttaatcaaattcctgacagtagctttgtctgaggttccccatgcagttgagtgaagtattaggagcatgggtagatagagggctggggagtagaaatgctgaggcttgaattccagctttactgcttcctgtcagtgagactttagtttgctcaactgctatagtgaggttaataatagtacctaccttataggcttgcagtaagcattccatgaattaattcctgtaaaatgctttacagcagtgcctgctgcataatacatgcttgctaagtgctattgcatggttgtcatactggttgaggtcatggtttcatttcttcacccggaaggagaaacagtcacgacataaacagatgatcttcagaaggcaacccacgtcttcagaatgctgcttttaaagttggagagccacctaactgcgtgttttcactctgtcctgctatttagagaactacatagatctagcattttgtcttctgtggaacttataatgcccccaatctttaagagctgttggaaatgtattctcaggttgttcatcatcagacttaaaataactttcttactccaacttgaggggtccctgctcatagatgtttaatcatggaagcgtgggcacagg

SEQ ID NO: 126298 - DNA, 1829 bp, Homo sapiens
attttagaaaaacttaaacctactttcatgtatatttataattttagaccatataaatataaaaatggataataagtgccttagctttacataccagctatttagtaaaaaccttctgttactttctatgggaaacagagattgaaggagagatcaagaaggggaaaaatcttatttttgacaattatcctatgattattacgttaaaactttatttcactggaatgcttggcagaaaggaatttttaagttaactgaggataaaccagaaaaccattttttcttgcatattatttctctaaaattttattctagtataaaattttatttacagtgtgaattttttttcttttggtcacatctttatcatttgagcattattttcattagataatttattcatctagattagaaggttatgggagcctttattaaaactttattgggcctgcttcctacagagatacagacacttacacctggaaaggagtcacagattatctcggttaatatgttttgcactgaagaaagtcatgttttaagatattaagggacttacagccattagaacaatacttggcacatggtgagtgcccaagaaattttagctgctgttagtagaatttgaatccaagtcatttgaatttcagtttggtgatttcttctcagaaatcttctacttaattccttttattgacccctggtcagactcactgagaatcttttttgtttgtttgtttttcctttaaatcctaattctggattcacttcattttccttatatcttatctcttttttccctaaaagtaaagaagacagaataaattcagtacttgtactttaaaacttttattgtcctcatcagggccagtctgaggatttctgccatgttttataaaatttatgcccagcataatcctgattttttactgccttctctgtgcaaatacacacctaaccttatgctaatggtggcactactgtttcttcatgacaaggctttaaaaatttctggaaactttaaaaacgtggaataaaaactgtgggtataatgggggtgggagcaggaaatttgaggggaaaccatagacacattatgccaaaggttttggcacttttcagaggactaaataactttcttcttctttttttgttttaaatagaagcaaaagagaaaaaaaggtatcaagcacagtttgctcatagaaatgagcaggtttggtagatatatttaaagatgtgaaagccaggaaaaattattaatatgctaataatttgtatttcctccattctccaaacacatacttttatcaagaggaggaggctaaaaataaaaatagaagctttagaaaagtaaggtttttcatgtttttttcttgtttgtttgttttttctctgtcagtcctcttacagtttttctgtagaggctaaaaagagatcctaagccaggaccagcacattcagtggcccatcttaaatgggattatttgaacaatttgagaactcttgggtcaagccaaaagagtgcagtagaaaatcaaagacttgggctgctgctggcttttctcctcattttctttgtcttcacgtgcagctcgataaagtgttggactttttcaaacacagaaacagccttaggggtgttaaatatgtgtgtcaaattttttcctaatggatttctaaatcttccaaaaacttttaaataacttgttaaaggctatatgtaacgcttgtatcgtgtgtgtgtgtgtgtgtgtgtgtgtgtgtgtatgtgttttcctgccactaagattgaattctgtcctctgtacctagaaaataatcattat

SEQ ID NO: 126299 - DNA, 1026 bp, Homo sapiens
tcttacctctgagagccttacaagacatagaggaatcttaaacaatcaaatgttaagtgagaaagctatttgtgcctcctaaaaggagaaaagaatattaacctgacgtggtattataatgtctcccagagtgagggagaaatgcaaggaacccatagtgattattgagtttatagatgtttctattcatgagcctgcaggaaaacgtagagaccaaacatttcagaaaatgaatgccctaggatgattcattagagcagaatgaaatattcagaaacttatgagtctataaaatatttttggagaaaatgtgtgagttttccagaggaacaagatttaatattttgttttaaaagactttattagttgtgagatgaatagaaatattggtaggtttcctttaatcttttgcatatcatttggcttctccaattagaatggcttggcaatcttatgatatttgagtacataatcctgctaggtaggtcaagagagtaaaaagtaaatttcgtagaaattatgccaagtggtaaacaacttcaggcctttttttccctgcagagtcccatggccaactgttctttccatagcaaacttttcttcaccataaacatagcatcatgccccgggggctttaaaataatgtttgctgctggcaggtgatgccaatgtctgtggctacctggagcaggatctatcatgtctcagtgatcccaggtggctttggtccaaagcactgtaactggacctttgattcacttcaaaagaaatgaacctttcttcatgccattgatcgccattgaaaagctccctcaaaggtccctcttagtaaatccttgacacctttcaggtcccagatcatggtttatctgctccagtaagcttttctctcttacttctctccttaaatctccatttccttaccatgaggccaccctgtggtttagtgctgatacagtgtactgtttgaatctgctgttgaattatttctcaagtattagacttggatgtagcctcatacctttt

SEQ ID NO: 126300 - DNA, 1098 bp, Homo sapiens
ttgcatttagagagtgaattaggactctgtaatgctttaagaattttaaaacattagttgtattctctagtggtaatgaaagttaacaataattaacacacagcagatgattaaagcaagcttacacatctggagagtggccacagtctgctatatgcctctaaacaccattttaattgacctacttttgatattatgaaaggctaataatgatttattctacccagttgaaaatactttttctagcagataattggaaacatctcagttggcccctctgttgatttagttagtgtgtgtgacagatggttaatatcttacgctaaatatctgccagccttgagccattttgttgttgttgttgactcacagtcactatgatgacttaaatagtgtatgaatcttgagaattgatagatctgtcagattatagaggaggagggagtcttatcaatgaggtagaccatgggttctcattgtaatagtgtagaatgttggttaactgtggactccctggctctgtctcaaatctactgattcataatttttgggtgtggggcttgggaatgtgttttaaacaagctctccaagggaatgtagttcctacttcaaatgaacaatggctgagtatagtttatggctttctttcatggatgaggaaacaggcccagaggggaaaaggtgactagtttcataagaatcacaactttgacttctggcactagaaggatagggttctttcctgaatgccacatgaccttaactcaggctagttccatccctaagtacagaactggaagagttttaaattagccctaatttttacatacaccaataccacatatgactttagtataatatttggctcagcttggctgtgtgtgtgcttattttttgaaagatacctatcaccactgtacctacatgttcagaataataataataaaaagtttacaggggattatagagaactcaattttaatgtgaagtacttatgctctacttactatgttttaatggcaaccattttccccctagaagtttcttgagcgactctgaattgtagccagaatacgtctttcctcttcagacccttag

SEQ ID NO: 126301 - DNA, 1055 bp, Homo sapiens
gatttgattttattttatgagaggtaaagagggggctgagtatattctcttatacatgcttacatcccaaatagagagtaagaatttcgaataagaacagtatgagttttgaaagtaaatagtctctatgttgataagaattgtggcatgcctgggtactgagtatcttttcagagatcctagagactgtccagaaactgttccagttcattgggtcaaaaatccactatttacgaaaagctaaatacggatttgcacgattgaccataatggcttcaattttgaaagatagtagtatcagagagcacttccagttggtgggataatttaagaatcgcccgtgctcaaatggctaaaatattgtactttttgctacttcatcactccattttaaaaatagagagggggagaaaagaaggcagacctgttgagaaggtggaagaatgtcagttggagagcaaatcaaaataaccatgtgaagccactccttagttaactactgcctgaaggttaactgttccttagaagcctgtcagggagtggagagactggactgggggctgctgtccctgtgtgtgcatgtgcacctgtgtgtttgtgtgtgcatgtgtgtgtgtgtatgtgcatgttcatgtgcatgcatgatgaagggtgaagagaacttgtgagtaggaaagaaggtgtagagaacagaaagctaacataaaatcctgaaacttagagtcctaggaaaatttgactattttaaactaactgtactgcttatttaaagataggaaaattataccattcttcttctggtataagagagagataaaaatacagtttttctaaattggaaaatttgctgtaatcttgctgctaatgactgatttcttccaacagttgcaaggcagtttttgctctgataggttgataaaggaaacaaaatcaagaacatattggaaattctcagagaaaattacagtttaggtatatgttgggggtggatacttagacattttaattgaaataaaacagttttatactaatatgggatcactgtgggtgtacat

SEQ ID NO: 126302 - DNA, 1738 bp, Homo sapiens
aggtcaattcacaggtggtcagtaaataccagtagtgaatcaatatctgtgaaccgttttttgcatggtgtataaggatactaatgcataacaaagttgctctattttgctgttaggcagtcacatcttagtctaaagtatctgcacttttattatagaacccaaaaacatgcctgaaggaagactgaaacatatatgatgctggataaaacagttatatttgaaattataatgtatttagtgtgtaacttcatggtcaatgctgtcatgtcttttagattctgtgcattattatttcagtccactatatgtaaaagtaaatgctaaatgtttataaatgttttcagtttgaattttatgttttggcagtgatatcttattttttccctcagtgtatgtttgtatatgcttctgttttccacaagctactgacttttgctttatgtttgttttatgttgcagattaatatcttttcaagaatttgttgcctttgaatctgtcctgtgtgcccctgatgctttgtttatggtagcctttcagctgtttgacaaagctggcaaaggagaagtaacttttggtaagaagcatgcttctgtgcacgtctgtgtaagtgtggacttgtgtgagcattttcttttttttttttctaggaacaaaataaagtgtatggaaattctttatagaagatagtatatcccttttagtaaagatacttcaatgttttggagctccagttcaaacatcttcctattcgaaaaaaacaagtttctggcttagtagttttgatactctgatttagttttaaggtgagggagatgtggcatgactgttttcatagagtcatagcatgtgagagccagacaggacttctgtttcttccctgcatcatcagtagtgctttccactgatagaacgaagaagtgaataatctgcctacacacagaagttacttatgcaccctatacttcttgtcttcacgttgttcccatggagtagtttgcggccagagctgctgcacaagatggtggttcagaatggtacatgaaggaccttgttctaaacaacccccgctcccccgacctgactgctgtgctggcagtgtctgctctcctgtggccttctttattttgcaaggcacaaacatcatcatgggaattagctacaaagctgcagaaaaccctgatgtttttcaaattcttagaagaaagggaaggcttggaagtggtgggacagtggtaagttattttttaaaaaactggctactaaggacagatttaacggaaagtaccatgtttcccttggactctgtggtgtccagcatatgttgtctctgcatgcaaatctgcagtagcattgctcatgaagaattttggagccctttaggcatgtggattgtgctttcatgagagatggctttaaagattagggagaatgtggcatgactgttttcatagcgtcatagaacgtgagacccagacaggacttctgcctgtcttgtgcttggcatgtgcccattttaagtgtctctattcatagtttctaattcattcagacctttgggacttgtcttatttgatgtattgtggaaaacatacagatatgggaaaaatacagatggtgtaacagtgttgcttccagaatcagataagcttagccccttccagctctgctgctgttgtctctgagccaaattagtgatcctctccagtcctcatttatcttatcaagaagtgaata

SEQ ID NO: 126303 - DNA, 1002 bp, Homo sapiens
gtgtatttgcaaggaatatgggcgggaaagagaagagctataaaagccaaaagctattaaaagatgttaaaaatcatggagaccaaagctttggataaatttggataaactggtgatcacaggagagtccagttccagatttttcttaacacccacatatacttgtgtggtctgatggttagaactgtgtttttggagttagattttactttcatctctgccattgaccctggacaattgcttggcttctgctgtaacacacagaagaggtataaggagaagttatttttgtgaagtactcttgtggttaggaaccttcagtaaaagtggtaattggattttgatggtacattgtctacaaccaaacttcctgaagtatgaacagaacaattcctatgtgctgttgcttaaactttcgtagccacagagttggcctggagataggagccaggcaggagatgaaagggatcacatggggtctaagcctctgctgagtgagaataagcgaggacagagaggaggagaagaactggaggttgtccgttagtgtgattctttcagatcctttgtttcttttttcaatttgtcttcctctccccaaatctcttatatagtcctcctgccactatctaagttgaggactttgctattttgtttcatatgaatttttatttttttcttactgtaagaacagtgcagtatgtatattattgaaaggattagaaaatatggacaagcagaaaaaaatcttaaatttctaacaatttaaccacctagagatgatatccactgccaacactttggtgtgccttcttcagactttgtgtgtatgcaaaatattattgtccatttttaagaaacaaataattttctacacatcattgtgtaaatgactttttacttactaccatggatttgtttataacactttttagtggttggatagtatcctgcatatcaatgttctgtattcagtccatcacatattgttgtatattgagg

SEQ ID NO: 126304 - DNA, 1301 bp, Homo sapiens
tttcctgctaactacttcccagcccccagactgaactcgtgattgaggttctatttacttttgcaaacagatgaatatttttggagcagtggaggtaggagcatggtacctaagtccaagttgcaccattttgtgtggctgtttctttcttattttgcattaggaaacaggtgcaagaaaaagaaaaaaaattccacttcatcatcgtagtagtatctggaatctcattccccataaccaagaagaactcatttattcttggccaccctctctcttttgttattctaagttgactgtggacagctttgatgctgcccctgaacttctatgagtccccctgcccttgctgccaggattttagaatctacccttctcctatactaggagtggtaagaaaataaattcgggtagtagtgccatttgatgattcattttctttttatatgtgtcctttaaaattaacattgacaatttggagcccctttgtaatgtggatgatagaggaaaagctgtgattgcttataggctgaatttaggttcatctgaaattatgatgtatctcagaaacatcataattccttggtttgggagtggtaataggattaggactgttgagactgtagaaaaagcacattgtttttcttagatgtggatgcttgtttggggtggtgtaggctgatggagagtatttgagacagcggctactctttcttttttttttttttttcccagctgctactctcaatgcagacattgctctagaacaccctgtataaactatatattgccacatctaaaccatatagtacttcattaaattttgaacatttaaaatattttaactatatgagacaactatgtggtgcatgtgttaattagcttgattgtgataatcatttttcaatgtatatgtatataaaaataacacattgtacactttaaatgtatacaatttttgtcaattatatgtcaataaagctgtaaaaaaattttagataatgcacaatggatcccatactttgtatttattcctatataccttgatttttaagcaccttattctttaagttcattttgttgccgaatttgagtgcattctccctagtccttattaaagagggtacaataatctttcatctgagatacaattgatggaattattttataggatcgagtacattttaaagcctaatctttctttgcttacattgaatattatgaccataatattatgaaatgttattctgaaacttggtctgagttctcttacgtcatcagaaatttctgcaaattcaatctga

SEQ ID NO: 126305 - DNA, 1843 bp, Homo sapiens
catttgtataatgtttgtctccagggaagacagacagacagacagacatgcgcacacacacatacagcacacacacacagttgcttttatctcttagtcgtgtgttttgaagataattctataaatatgtaaagaaatcttcctcattcctttttatggctgcatagtgtaagcatatacatttataattatttttccagtttattccaatatctgttaaagtttacagaccagtgcttttaaggtttacattatttggctcatcaggatcttttcccaaaccattttagggctgttgtcaaagagcaatggacaaaccctaatgatgagatgaactttactctcagaataccgtctcacttgctcctatgttctgcattccctgcaccaaacacttcctatgctgtctgcttccctgtccactcatacaggaaagggcttcgatgttatagagtcactcttattgctcctgctaactgctgtcctgataacaatgggtcttttgcatgggaaaagcattatagagtgaaaggatcactgatagcagtcaaaaaaacacattttactatgtcttttaaaatctgtgggatcttagacaagtgacctatcccatgtgagcctgttttctcatctgattaaatggggttgttacttgctcggtgaatgcttgtgttgtcacccagtgaaataaactccagggaagtttagttagctttcccttctcaatttacctgcagatactgtttcaacattcctctctcctctcattccttccctctcttattcctttcctcacctcctacttttcttccccaattcctggcatctttcctggtggcaaacagaccttccatgtgaagaaaaactcctcataattgcactttcctcttcagattctgccccatttctcttctttctgcaacactcatcaaaagcactgtctgttctggcccttacaattaattcctctgcccattgattcttttttgagatggagccttgctctgttagccaggctggagtgcagtggcatgatctcagctcactgcaacctccgcctcccgggttcaagcgattcttctgcctcagcctcctgggtagctggaataacaggagcatggcaccatgcccagataatttttgtatttttagtagagacagggtttcaccatgttgtccaggctggtctcaaactcctagcctcaagtgatccacccacctctgcctcccaaagtgctgggattacaggtgtgacccaccgtgcccagcctgcccattcattcttgaatccactctccccaagtttcctctgctgctctactatgctctaatctgcccttgttacgatcttcaaagcagaatccaatgataatattagttctcaggttaacacacttgcctcttacccctttttgcaatactcacttcacgttcattataccatgttcccttgcatccctcagacctcactggttctcacatctctagtttttcctaactactttttgggtgatcttgtcccatctcatggtgctaaatacttcataacttctacttttatgtcttcagccctctcctccctgctgcttctgtgagagtccatttgcgtacctaataggcccctcaaatgtcacatgtcctgacctaggctcctgagccttctctctccaagcattctttcctattgcttgctcagtagattctgtcttgcagttgctcaggccccaaactctagggacatccttgcttccttcttttctttcacacctcccttcaaatcttacatccagtctagttggcctcactatcagtatatgtatcgtcagtactccctctgcccaat

SEQ ID NO: 126306 - DNA, 1141 bp, Homo sapiens
tcccaaattaatctaccaaaacaaaaagcctcattaacagctctcattgaatcagtgttattttttcctttctctcaaggtgtctgattaaccccctttctttttgcattactcactttgtgttaatatttgatgtctgaaatcatggggcaggggaggggttgtgcaatgtggtggctagacactgtctacaagcagtaaattaaaaagaatttttaaaaaggtttgtattatgttgctgatgtattagaaaatctctaggaatgtcaggtgcctgggttttctttttctttttaatttcagaaagggttgattgctgattgggtgctgattttgcttctcattcatatgtacagatagcgctcctcctcctcttacccagctcctcttgcttaccaatccaagccttcttttggagagttttattgaaaaggaaaggtgagaaataaggccataactggagggaaaagggaggttgaaggagggtcttttctaggtgaatgccaatgggaaagactcacttgagagtagataagattgacaatgtaggagagaaaggaaagacattctggagcattgtctaggaggttggcctcttgtaagagcatggagagttcatccagaacacctgacctcaaagtgtagccagtggactcctggaagtccctgagaacttttcagaagtccaggaggtcaaaactatttgcacagtagtaaaagcatgatctacctttttcaccatgttgatatttgagctgaggtttctaaaagcaatagtgcgtaaaacttctggtgtcttaacagcaaataaggttttgtctgaacattgatgtccctccaaaattcatgttgaaacctaacctgcatggtgatagtgtgaagaggtagaactttggggaggtgattaggtcatgagggctctgctctcacagataggattagtacctttgtgaaggaggcttgagggaatctgtttgccccttctgccatgtgaggatggagcaagaaggcaccatctatgaaggagaaagcttttaccagacaccagacctgctgctgccttgatcttggacttcccaactcctagaactgtgagcagtaaattctgttacttataaattaccaagtactaggatatttt

SEQ ID NO: 126307 - DNA, 1641 bp, Homo sapiens
actgctatgaaagagagagatggtgtgagtaacaccaaataagggcttcatttggactgggaaattgggaagactttccatgagtgacatctgagttgcaggagttggaggtgggagtacagaggacagagagttgcaggcagagggaacagcagttgtaaaggtcctgtgttttgaaatgcagaggctggcttgcctggagcatggaagtgcagggcatggtggtgggagaggtgggctgtgcccagactgtgtagggacttgtacctcatattaaggattggggttctttatcttgagagtgctggagagccatcaaaggctaatttgaatgaggggattggcacgatttgcctgtgtaacagcatacttgctgttaatactctttgttgtgtttagacctccctgcattccactgttttaatctacttaatgatggatttaatcaatttatgaagttccgtaagggagatgagaggagactttgagtgtctagggctggaagccttttgtttttggtgggccttaatgaatgaagagggcttgtcccagcatttgaggaggaggtgggactctaaggacttctcagggcctagaccttactgtaccacgtaactgaactgtaccttttagatttggttgtgattattattttttcattcaaaatgagaataaagctttgtatatcttctaagtataatttttatacattgttcatacaacttacctgttaagagcaaggtgaaaattcttcctttgatctttgcacacgttctatttgttgttgttactgactgttatctcgttaaagggagtcaaggctaaagaactgtcttcacttgtgactgaccttctcacctgggaagaccacatgggactagaataagctggaggtgttgagtgcctgacttactgagggttacgggtaccaagcactgtctgtgaggtgggcaccgggtggctcagggatccagttggcttgctagggtcacaaaggaatttaccacacatatgtctttcatctccagtgtggaacctctttgcactccatgtgcaaacagaagttggcacttcttttggaaaagggaatgttagatatctcagtttgctagtgatgaagctgacagattcaccataccgccttgtcagccccctgccactttgttgtaccaaaatgacagcaatataatcaaacccttaatttttttttttttttttgagacagagtctcaggctggagcacagtgggatgatctcagctcactgcaacctcccttactgggctcaagcaattctcctgcttcagcctccccagtagctgcgattataggcatgcaccaccacacccggctaatttttgtatttttagtaaagacggggtctccccatgttggtcaggcttgtctggaattcctgacctcaagtgatccacctgcctcagccctcccaaagtgctggaattacagacgtgagccactatgcccggcctcagataattcctttctgttcagagtaaagagattgagtcctgggacagttcctgttttgatgcatgaagaataaaggcatcaaagaagaaaagatgaaaaagaaatctaaagtttagaaatatgtggcctatataaataaagcatgttctct

SEQ ID NO: 126308 - DNA, 1415 bp, Homo sapiens
cccacactttgggctggagaactgtctgttgcagggagtcatcctgtgtattgttggatgtctagcaacatccctggcctctacctgctggagccagtagcacccttcctcacatgttatgacaatcttaattgccatcagatattgccaagtgtccctgtgggaaaacattgctcccagttaagtttataaacataaaacttgacttgttttttctttgaactgttgggagataatggtcattatgaagcgtacatgatcatatctgatattttatcgtttggatattttcaactttttcacatatcactctcatgattatatactgttgaaaatcaaatatataaaatactgtttttcttttttttaaacagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatgggtatgtttatttttaattattttatttaattctttttgtttgaaacagctttcttttgctctaatgaccaggaagtcattaaatgtataccttcccatctcttaggaccattttctgtacttactactattattattacattatttgagtaataatgtagttccttcaatcattgtttcaagttggggattcaatatgtatatatttgactcttttaaagaatgctttatcgtatcagagaactattattgtcaacaaggtggtgatgtgcagatgtatgagagtatttatatgcctttggtatttttcaaggcagctgtaaaattgtgagtaaatgtacaacatagctctatgaacgttacttttctataatctttctttctgagcaaatcgcctttaaaaattcacaggtgattccaaagccccaagaaaggcactctgcaaaagctagaggaaagaaactgtaccatatagaatcaaataggacacgttgcagaatgcctttggattctttttttccctaccagtcttctctgcttccattttgttggaacttttttccctccttcttttgaggcaggttctcactctgttgctcgggctggagtacagtggcatgatcttggctcagtgcaacttctgtctcccaggtacaagctatcctctcacctcagcctcctgagtagctggtatcaaagccgtgcgccaccatgcccagctaatttttgtatttttttgtagagacgggattttgccgtattgcccaggctggtctcaaactcctgggctcaagccatccgcttgcctctacctcccaaagtgttgggattacaggtgtaagccactttatctggccttctgcttacattttaaaaatgggttttccttaagctgtata

SEQ ID NO: 126309 - DNA, 1046 bp, Homo sapiens
ttagatcacacacaaagataaagtactaatgtactaaaacttaaaggtaaaagataaacctactttaaaaaaactcagataaactctctgatatttagtcttgaaatgaagaaagactggtgatatggcttggctgtgtccccacccaaatttcaccttaaattgtaataatccccacatttaaagggtggagccaggtggagatcattgagtcatgggggtggtttccctcatactgttctcgtagtagtgaataagtctcatgagatctgatggttttataaatgggagttcccctgcacaagctctcttgcctaccgccatgttaagatgtgactttgctcctcattcgccttccaccatgattgtgaggcctcccagccatgtggaactgtgagtccattaaacctctttttatttataaattacccagtcgcaggtatgtctttattagcagtgtaagaacagactaatacagctagtgtctaagcttagaaaagtaatggaagaaatttcaaaggagaaaaaaattctatacactcaattatataaaaatatcaaactggaaaaatatttgcaacaaatataatagaccaaagtgagtaaagggcatgttcacacactgttggtgggagtgtaaattggtacaatcttttccggagagcagtgtgataataagtaccaagagcccagaagttcctctcctttgactcaacaatttctcttctgggagcctagcctttgaaaattgccaggaatttggacaaatgttatattcaaagcttactaccttagctttatttaaaaatacaaaaaactggaaatgtctactggtaggagaaaagttaaattgtatagtaaaataaattattcactatcaggggcaaacttaggtataattactaagtcataagattgctgtaattagcagtgatatttcctttatattttcatcttgttttggctcagttaggaaaatcaaaatataattctttacatgtccaaaaagccgaattaaatgctaactgaagaatagtaggatcact

SEQ ID NO: 126310 - DNA, 1098 bp, Homo sapiens
tcttagcaagagtcttgcccttaacttgttgtttacaacagtgccaacagcatgctgggggcattgtagactcctctacttttgccatggtaacacttgtaaagcattcctttttgaacagtactcattcccttaatgtctacaatatcacctttcttatagatttgcatatatgtggccaaaggaacaactctatgttttctaaaaggcctacagaacatatattgagtgcctctcctctttccctttgtgttcatcccattttggtgaattactggaagatggtggttccagctgaaaggaaccctactacaatatttttaatgctgcataatattcctacatatggctgtttctgttttgccctaacttattgaagcactatttaattattgaatatttagttgtttcctgtgctttactatcatgacagcactgtaatgatagtattgtacctacatttttgcatatagctagcattattttcttaggataaattcctagaagtggcaccattgggttagaatgggtttagaacatattaaggcttgtgattccccttggtagactgcctctcatgaaggttatttcaatatttattttgggtgggaacacggaagtgttcatttcctacattatatcaactcagattattatgagtttttgttgcagcagcaacaaaaaagactttatgccaatctgttggttgaaaaattgtatcttatttaaaattttcatttttaaataaatagagcaatatgtttattggccatttatgtttcttaaatatgtttttaactttattgtgacaattttcagacatacagaaaatagaatagtaaacacccacataaccaccatctgatttaaagtaatacttgtcatgttagtttatacatttttttctgatttatgttaataaatataacttagctatcactataattcaccctaaataatttagcatagagcttcaaataataaaaacaatctcctacacagtcataataccattgtgcacctaataaagttaatgataattccctaatataaaatacccaatccagatgcaaatccttaaattatattttgttccat

SEQ ID NO: 126311 - DNA, 1015 bp, Homo sapiens
caaaagagatgatgtgtactattgtattagtctgttctgttctcatgctgctaataaaggcatacctgagactgggtaatttatcaggcaaagaggtttaattgactcacagttccacatggctagagaggcctcacaatcatggtggaaggcgaatgagaaacaaattctcgtcttatattgtgacaggcaagagagcttgtgcaggggaactcccatttataaaaccattggatcttctgaaacttatggggagaccgcacccatgattcagttatctccacctggccccgccctggacacatggggattattacaattcaaggtgagatttgggcggggacacagccaaaccatgtcaactgtttagaagtatatagtctcaagtaactaaatctctgtagcgaaagatgggaaaattggggaaaagggctgaatgagaaacagaagacatattacagagtaacatagtgaattacacttggatttttataattgttttgtcagcaaaagcatgatatccacttttaaaatgtctgtaggcaaattttgaaaaacagttaattctgtttttggaaactttttatcacatcaattttatatgcattgaaaatttaaaaggcagatacataaacaaaagtaacttgtgatctttgtgtaggaagatagatatttatatatttatttatctctcagtctatgtgtctctctgtatgtatataattttttttccccttaggagaaaaaaatactgttttctatctagttttttcccttacctgctatgttacaaatactttttcctataattcagtgtgcttctatattttttttatttttgtaaattattttgtttcttccatgatgatttagaggaactacttttaaaccagtacaaatatgtcataaataatatctggccatcttctaaccagttgagtaatttcttgcgcagtaagttacctcacatcttttggtaagcaatacgttaaatttgattagtaaagacattata

SEQ ID NO: 126312 - DNA, 1116 bp, Homo sapiens
agcctggccaacatggtgaaaccccatctttactgaaagtaccaaaactagccaggtgtggtggcacgtgcctgtaatcctggctattcaggaggctgaggtgggagaatcgcttgaacctgggaggcggaggttgcagtgagctgagatcgtgccactgcactccagcctgggcgacagagcaagactgtctcaagaaaaaaaaaaaaaaagaaaatcccaacatgtcttaagaggggagagccttacaaatacgtctgctttttaaaatgtaggtgactgtgatgacaacatggcttatattttaatttcttttatctcatgtggtgtaaggtatgtgaataaaagcggttgctggagtattcagttttgcaacccatttacctttccaggattgacccgtatagctttttctcctaggaagtttaaagctcattgtaaacatctcagtaatccttcactcatccatgggactatactgtctctccctggtagaagcctattgttgtggtcatcatcattatcatcactttatgatgactgcggtatcctgagaggaggctccagtatggataatactagatactagagcacaacagacaccatggaagtttgtgtcttatactggcatcttatatttccacctattttgtgatagtgggcagtgaatgattaatagaataaaagtctgtctcaggttccagacaccgaaacacctttatgttattcagctgaaattaaagtactcagaaaagaaaaggccacttttgtaagataatatacacacatataatatatatgtatatatacacacacatatatgatatattattaataacatatattaatatacacatattttatatatatatgtttttctaaacattatgaaaaggcagctgagttgtatggaaagaggaccagggtgtcaaatgagaaatttgatgtgtactgaatatggtgtagaaaggtattaaatctatgaacctctctttcctcatcacaatgtgttactattaaaactaattgagacatcaaggactttgaacatggacaggatatttgatattaaggagttggtattaatcgatgtttaggctgataatattctcatta

SEQ ID NO: 126313 - DNA, 1098 bp, Homo sapiens
gtttgaaaaccagttacttgatttaaaattcttgatataaaatttttgttttaatgttggaatccattcttacaaatgcaaattcagaagaagaatcataaagaaaatcaggcagttataacaatagtagctgtaaatatttgcatgctattaatatatgagaaaaaaatgtaacagtgaaagtaagccttctggaaacaatctaaagtttgatgactcttctaaaccccaagaatgaacgaagtctaataattccaggcttctaaagcccaagaatgaactaagtctaataatcccaagcttatgtgatgcaaagtatgcatgctggacagctgttctgaattgactttaaaagggtggctacatttctgtggcttcctttttccagctcatagaacttcctgggtattggttttgccaccaggtagaattcattgaaatacacctttaaaaaactggtacatctcatggtaactttgcattgtcttcaattaagttgtgtaagtgttcttcattcatagcaaatgacacttaaaacaagaagataggaatgggaggtagcagtataaatggaaattccgaacagccacacagcatttgactggtgaataatagatggaattactatagagatgaggcccaggaggctggtagtaatttttctgaatccatcccctgttgaaccatacttatctatccttaaatagaatgtaccaggacctgagccaaattttagtgggcctcagagaaatcttgtggtgatcattaaccatttgctgtacctggaactctgggttgggggtagggtagctgagacaattatcagttaggatggccacaatgtttatttagtggtttggtgagtgtgtttgaagacccatgagtttctcttctcttttgctaatttatcccttctaaattatgagccagtttacccatcatttagatttcttaaggagtaaacatggtagaacataaacatctttggataaataatacaaatagtaatagataccatttattgagcactttaactgtgtggcccttttggtgctaagcactttgtgtaattatctcatattacttttctagctgtct

SEQ ID NO: 126314 - DNA, 1032 bp, Homo sapiens
gtcacataatggctgaaatcatagatttgcaatcaaattagggctctgccacttgctaactgtgtgacttggggaagttactcaacctctctgtgcctcagtttcctcatctgtaaaatggacataacggtgtctactcctcagggctgttgagagtgtcagtaagctaatgtttgcaaagcattagagtcatgtcaaaagctgtgggctgtggaatagggcccaggagggctcactcaagtgagatggtgtgtcgtctttgagatgagcctccagctgtgcagagagcccctttccttttcctttttgcttccttctggttcttgacgtgcttcagttagatgaggttgatagcaggaatttggacaggtaaggcatatttaatggaagcaacttctttattgtcctttcatttttggcttcctcttcctctgtatttattaaattagcttttctctctcagaagtgtttaactttttatggcattatctgggcttcagcaacttgtgatctcctaagtagagcttttcagcactttataaatacgtcatatactttttatattcctttgttccccatcaggaacatagccccagtcttcagaatagcacaatcagtttttattcatttaaggagcagtagtaatttgacacttgctaatatgtaacaaattatattgggcgtggtaattacaattgcagctggttcctaattatactgtaaccttgatgcttacaaaaattgagactgaattcagcataaaatactggagaataatattctgcactaggcatttctgccttctactgagccatgggcatttatgaatcataatgccaaattaaaaagaatttattttaaattggttacaattacaatgttgtccagtgtctccattcttaaaggtagctttaaagtccccctttttgcttgctaaactctgggaatatccttcaggtattataattagtgtctaaataacctgagctcaggggtcatttctggctgtgtgatctactggtattcatttaa

SEQ ID NO: 126315 - DNA, 1003 bp, Homo sapiens
tggtccaaattcccatgaatgcctttgcttttggcactgctctaggccagtgattccctacatactgaagtcttctggactggtataaaaaactgctgatgcctgggtctccctccagagatcatgattgaattggacttgggtgtggcctgagcctcaggatttttgaaagcttgacaaccactgttattttggtgcacattgcttcaagagacctgctggctccttcttggagtaagaatggaatgcagtgagattaagttaaagtccctggtgtgtcagttcaaaggaggggtatgtaggggtttctccaaatttctcttctttcttgacagctttgtcttagtcctgcctggtgtctccagggtgcttaggcatcaagtttatacagttttgtgataatcctggaatagaggttttaatcccaaacttgactgaaagctccatttgtctcctgcagagtctcagtggttttttgtgatcagagaaggtgctggaggagggaagcattacaaagagcaaacctggtctcagagccctctcctgggctaacctcatccagggccatgtggtgccagtgttccctggcttaggtcatatggcttcacagcaaatagagggttggaaaggtgtggggagagttgaaaggtgatatgtagcgtaaaaaagtcagggagcaggtcttttttggatattgagttcttttagaagattgtccgaggagctctgactcctctgtgctttggtctcttagacctttagtcccatgaccagtctctgcttttgatgaattcttagagggaaccattcctccctttgttctccactatgtgtgaggattatctattatggcattcctgctgagcgcttcctcctctctggttggcatttgctgcctcataaacacctacagatttcctcataagactctgtgggtttgccttagggtggaccttgcaacagaggaatgtgtgacgctgagacatgtgttggttctgcttgg

SEQ ID NO: 126316 - DNA, 2228 bp, Homo sapiens
tttatcggttgattctgttggcagcctgagttaaaggctgtgctccttgctttttccctggagcatagctattccatgttgccagctgaacacagagccataggggtagggttggcattccctcttaaaagttgaggagcctggataggagaggacttcacctcaatggactgttaggaaattgggctgagactctggggactcagcaactgtgagaattccaacactcactacactcactgtgacaaattgtttgaatatttaagcagatttggtattttctggatagatgtagccacaactagcaattagttttctgatctgtttctttctttggtctttatacttatttaaatacagctaattattcatgaccttcctttaaatagttttaatggggagatggagaatctagtctttggctgctttttattttgaattttgctatgaagattactagttaatggttcaagaagtgtttgttttctttcgtgaatgaacattaatctaaaactcttagtattctgagattatctcaaaaagtgtccattctcttgctgcctacgtttgtaggaataatccttgtgggttcccttgttagatctgcctgtactgtttgcgttgtttgaatatttcttttaaacatttcccaaaactgccataaaaaaacagttttaaaaggtggtaattgagaggtcacccttttcttcgtctctgcccttttcttggttaaaggagagctttcttcttcgtcattggttaaatttatgcgttacgaatgatgtaattaacctatatgaacctactaaaagttagaatatgctcccttgagttcagacctgtgagatgttctggggtaaaactgaacacagaccaatattagcctagaaccaaaagaaggaaatttgggggcacattaaagcattaataataaagacaatttggtctgtaggactagtacactttgtattgacttttcattcttggatgagttgttgctgtgatcattgattcatttatgtgtattgtgttctttccagtgttgcaaatgggacaaaattgagaatactaaaatgaattgttagctgggcatggtggcacgcatctgtggtcccggctacttgggaggctaaggcaggaggatcacttgagcccagaaggcagaggttgcagtgagctgagatagcaccactgtactccagcttgggttacagaacgagatcctgtctcaaaaaaaaataaaataaagtaaaataaaataataaaataaaataaaatagaataaaataaataaaatgaattggactccattttgatgttcaagaaaaccaaaaccattccagggggctaagttctctgatggaaatgctcccactacaaggtttgtgggagcagtaggagaagagcccatttctgaggagatgagggaagtcttctgaaaattgctagtatttcagaaggaatggatggggaagagtaaagatccaatccagtggttggaaacaaatgaagggctgggaggtgagagcacaggctacatttagttaacagcaggtaataaaaactaaaagcagctgacacttactgagcgcttactagataccaaattcagttccaaatgtgtttcattgttgattcatttaaaattcagttccaactgtgtttcgttgttgattcatttaatgcctcagccttttgagttagttactatcatcctttttttatagatgaaggctctgagataccaagaggtgatgttagtggcctaagatctgataagtatggctgggtacggtggctcacacctataatcccagcaccttgggaggccgaggcaggtgaatcacctcaggtcaggaatttgagaccagcctggccagtctggcccatctctactaaaaataggaaacaattagccgggcatagtggtgcattcttgtaatctcagctgctcgggaggctgaggtaggggaatttgcttcaacctgggaggcggaggttgcagtgagctgacgtcgtgccattgcactccagcctgggtgacagagcaagactctgtctcaaaaaaataaaataaaataaaaaagatcggataattaggaaattatcgagctggggttcaaatcctgccagtctggctccagcagctgtggcctcactctgtccaccatgtgtgcctggtagtttagtgtggtggagaataaagtatatgggagaggtgtgggaga

SEQ ID NO: 126317 - DNA, 1504 bp, Homo sapiens
gccaggaacgcacgctgcctggccgtatcgccgcccccaccgccgccgccgccgggactagaagtgagccgcccgggtcccaaacgccagccagccagtcagtgggtcccgcagtcgcccgcaaccggggcgaatcatggcggccgccaaggtaaccgcgggcccgaggccggggggagcgcgcctgccggatcagcctgggggtgcgagaggctcgggcgctcacgtgtctgggttggtgccacaggcggagcaaaatggggtgccgggcagccgttccaccttgcggctgctggagggagggggccactcctcccgggcagcacaggcggtcggtgcagagaccgaggcccgacctcgcagcggaaactttgtgggccggacactcccacttggccggggagggaagttggtgcctgacggggctgagccagggccgacgaggaggagcgggcgcgactggggcctggtgcaccctgggccggcaagcgctgggggtcctctctaccttcccagcgcgctcctgctcctgaccccgctggttgttgactccggcttcttccaggggccagagcccgggctgaagcctgatcctattacgtttcaagggctccgccctcccgcgggtggggaagttactttgacttccgttttggaaactgcctaggagacttggtctgcgcctttgtgaataaaaagtccagggactctccccctccccgctttcccatcattcccatcttccccctccctctctccatctgacaacacttagatacccgcctcggagcatttgagaggcttctttttgggaacgatgaaacagattgtcctgggagcctgtcactcctgtgaagttgtacttgaaaggggttctgtgtaatgtgaatcattcactaacccagaggaaaggcaactccaacacttgacctttcctctttcaccatttcttgaaacctggacaccatttcagtctctttggactgcatttcaacttctctggcagaataccatatttagtcccaatcacttgaatcatttggaatttattgcttttaatttaagttcacgaaggcagccctctaatcaagcctatacaacttcttagctcattttaagtgcagtgaacttaaatatacctaacatttcaaacatttgtccttaatcaaaactctgtgataaccctcaagaggaaaacatggccaacacatcatattcctatttattcaagcaaactaatcacatttgcaatggaaattgtaagcagacaaatatatttaaatgctgttctatgacttaagtctctccaggctccccaaatccgtaggcttcttcatgttgttagtttctgtggtctaagtggcatttctcttttctgtaattactctgagtttcatccttaggaaagtactctgggtgtgtgggctcatgtatgtttgcatatgaacacacaggtgtgcgtgtgtatatctatctataacttttcagcagtttctctgagcat

SEQ ID NO: 126318 - DNA, 1033 bp, Homo sapiens
ttattctttctgcatatacaacagtaatatagtaatacctgttatgatcattgtaaaatccctaaaggtttgatagtgatgtgtactttgcctgaggttaatgagtctcaaaacttatgtttaaatatttattaggaacagaacattcatatagcatttggaaagtatttgaaggatagcagtaagtccctcacatttcttccacaaatagacttataagaaaattaaggaagataaaatacaagttaaataatgggaaaaacaaaattttatagtattatattgactcatatccaattttcttatgtttttttttcagagacaaaagtaaaactattcagtggtattgtaaattgatgtctcaggcatagctcatttatttgtttatttattgtattgtttctaaaagaatgtttattataaagaatacctagtgatgttctttctgttttatcttagagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataatcttggtttggttcagaagtcttaatcttttgcttctaatcaattttcttgtcatgattttccaaaaccttattatatatagatagtaaaatttcatattatgaaattttcttttttttttttaatgttaactgagtgaggctcaggttaaatgatctggagtagatttcacctgattcccaattcagtacttttcttaaaccacatcaattaattgttacttctattttataaggaatttcttttacatcacattgaaccttaatctcttctgtattttgatagcttaggcaacatttgctgacatttataaggtgacctttcaaaacctgtgttttaaaaatattaatcattttaaattgctgtaatttact

SEQ ID NO: 126319 - DNA, 1088 bp, Homo sapiens
tatgtttattcttcctttaaaaatataaattttgtatcagttgtattaggcagatactagtggtggcttacagtttggtctacttttaaatatttgtatataagttatccttacgttttgcagttttgaatttcacactggtatcttcctgccattcaacttgctttagggttgttggtgttgtgttttgaaagattgtgaagtcgaccttctaaaaatgagttcaaagaaaaatcagtaaagtaaatatcctcctgaaattgtaagtttcttggcaagtagaattttttgtattaacttctgttttaggttatctgcaaactcaagaattgagagaactagacagcataagctcagatttaaggaagataccatttttcatagatatggttttagctgtttttgaattgtgagtgttcagtagcaagcttttcaaagtttttgtaattgtggaaataatgtatgagaaatatttagacagcatctgtttctatttttagactgggctggcttagatgaagatgaagatgcacatgtctgggaggataattgggatgatgacaatgtagaggatgacttctctaatcagttacggtaagttttaagccagatttttattgtagttcagtattaattataagcatggaatatgtaatttacatagatgattaacctcttaaaagctacttaatctttgaaataggtttttgaactgtgtaaagtaagacatattgtcttcatctcctgtgattctaaacatgaacactttgtgtaattgcatacaacttttattctttctggtctttttacaaaggtagtaaaatagaagcatatttgctatttcttatccttaggaatttaattctgtcaatgttaattttctaccaatatcaaataactcagcagaaattagaatcatagagtgctgggacctaatagattggtgattctcaaactggaatggagattggggttgtgagaatgtactgtgtcatattcatgtataaatctacctgatttcatttatttattgaggtaaaattcatgtaacataaaattaagcatttgaaagtgtacagttcagtggc

SEQ ID NO: 126320 - DNA, 1030 bp, Homo sapiens
tttgttccattactggggatgttcacttcaatcactattaaggtggtgtttgttaggcctttccattgttaggttactaattttcccttcctaataggcagttttgggggagggactttgaaactatgtaaatacagtattccagtgatcatcaaacttgtaacttgttcatcttttaaaaaatgtatagcagtgtggactagtggattctgactcagtaggttataatttgtaactattatttggattctcagattgtcccatatttgaacatgcagaactccttcaggctgtcttctgtgtccttttgccatgtctccattattctttgtgcatttcctagcattctggcacaaggtgtattccaaactaattttatatgtgaaatcagccgttgctccaatgtgatttctttttagtggagaatggtatttagaatgcagggtcttcactttgcttatgtttattgcatttgggatattcctgctcccagaccctctaagtggaaggaactagggatgtacaggagtgtgtgtgtgtgtgtatgtataaaaccatgggttcacacagatgtctccaattgcagttcaacaccactggattcattctagttttttccctttctacatttgttattcccttctccaatagtgagaaacctggcttccattatcttcaatgtattgtctatttggtcatcccccttcctaaccaatctttgctgcccccaacaggtgcccttcttgcccaacttgggctccacattttatgccaggccaccctcccatcctctagtgtgggtgacttcgttctgtccaggctctgacacaccagccacaccatgctgcccctctccaggaatgccctccttgctctacttgggcttagacacctcatcttagacctggcatatcttaaattttgacagatactctcaaattgcctttgagaagggttatgccaatttatgttttcatctacagttcaccttttccctcataagcttgctacactagatagtaaacatgtt

SEQ ID NO: 126321 - DNA, 1057 bp, Homo sapiens
tcaaatagcattcttcattatcatatacagggtggaatgttaggcactttatttgcattacataatctaattatcactatcaccttgagaatatggaggcttagagacaaaaagaaaaacaaacaaacaaaacttgccattatgtccaagccaggatctgaaaggtctaactccctgatccaaactttatctgtaacatttagcaaagtgcctgatacatagtaggtggtcaataaatgcatgttgaatgaatgatgaatgaacccgcatttaaaatgagtagttagttgataattgactgcttaaaaacgatctagagataactatgtacctgatggtacacttgatttttttcagcaactttcatcagcttttgcgagtgtagtttgtgcttgttctaagtttatatgtgagcagcaatttttcaaagtgtcagtagttatatagtaaaacaaaacaaaaaggtaaaaggaaaagcaaaaaaaaattattctttctaaggacaaaagactcacaacagacttgtttattaacattaagtaattgaccatttatgggtctccttacagaatgtttgttgtcttcaggtataaatgtgtagaattaattcattcaggaaactttccattttagagtgagaaacatttttaatgcctttattttgttcaagtttctcttctctggtttatgatttggagaggtttttcttaatttgaatttgtgagaaaatcatcccacaaggtgaaaccactcaatatttactcatgaaagttgttctgatgagtaacaaaagcaaaagaaaaacacttcagaaaatatcaccaaagaattatttcttttctgagaatctacatttccgacatgttttggtctagtcaaggtttagagtctgttactattcaaaatgtgatccatgaaacagcagacttggcattgcctgggagcctgttaaaattgcagcatctcatcattcctcaaacctagacctacttaatcagtgtgggctttaccaggattcctaagagagatgtttgaaaaaacattaaagtttgaaaag

SEQ ID NO: 126322 - DNA, 1053 bp, Homo sapiens
actggcttaaggactggaggtaataacgtatgtgaagggctgatgaatgtttgcagtcacactgtagtctctctagagttccttcctcggttgcaaactaagggtttttttgtttgtttgttttacacattatgagtctcttatagtcaggaaaactacacggatctcaactttggcaatacagagagtccgaataacaaggtagagaccaaaaaaaaaaaaaaaaaaaaatcacctctacaactcggaaaaagcgctaaccccgcaggaagcgctgggccgacctccagtatcccagcattcctcgcgctgctcccgtattctttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaaggtaaccgctgggccccggtttctgtgtcgcgcgaacggtgactcaggcctccgtgtggaggtagcttgggtgctcgggcccagctgggggcaccggcgggaagtttggactcccagggccggcactcgaggcgctaacgctcacccctcagtggcgccccagattcgggtttggggtgttgcgctgggactcactggtgaggcccaatggcttcggcttcctcactgggaggagccaccgtgagtctggacccatagccccgcgtctgtgatggttggtccatttactgttcacctgggttactcaccacttaaacttagttcaagtctacataacctccttttctttttgttttagcagtctttctttgtctttaaacctttccagaattgaattgtcagtagttacgccaatgctgcttaacttttaggatgttacaaatgaagcctcattaagtaggataggagggtaagatacggggtgcttaatacacattattgcctcattcctgttcctcaccattttgatca

SEQ ID NO: 126323 - DNA, 1116 bp, Homo sapiens
tcttgttcagatattcccaatgtattcaataaagaaaatggtttagaacctctggtccaacaaataaatttaaaatgggaataaagaggggccaataatcctggtttcttataagacctctgcctggtatcactctgcaccctccatctagattcttccatggtcagcagggaaaacagaatcatccatctacaacacataatgcaactctccctgtgcttcaaaatgtaccaaatagcagggacagctccaggaggcagacagtagatcaaggaattgtctgtcaagatggaataaacactaggaattgttaatgctaatggtagcaatttttcctagagttacccagaattagaatccaaagatttatgagcagcttggtaataacaatatattgatcgatctttcttttttgccatcatatatacctatgtcttccccttctcgacaaaacagccctaccccaaatttagttaactcagttgtcccttctggcttttattccactgcatttttattggaatgcagcctcatttctaaactctaactggtgcacttacatcactttcatttctactttgcctacaacctccttattttctgcaaactagtttcctttcctcctcctttcccacaccttcaccttcacatatacgggcagtcttaagcccacagtactgaaacactcaaaggtcactaaagattcctctgtgatagaatctaatggcaagtatgtcatcctcttttacacttatctatctgtaatatttgatactattgaccacacactgtacttctggaaaagataactgccatttagtaagagttcactatagttaatattgcgtcatgcacaatattaagcactttacatgcattaatctttgtatttttcaaatgcccacctaaagtaaggaccattattatctccatttaaaaaataaagtagtggggtcgagagaggttaagtaattgctcaaggttcccaagtagtagaggaagattcaatcctaggtcctactgactctaagcccatgctctgcttaccacattgataccacttctcacaatgtgcttttacccctttacatttataaccccattttcctctggatc

SEQ ID NO: 126324 - DNA, 1101 bp, Homo sapiens
aggctaaaacaaaggcaccactcaaaagtaggcatgacagtgtaaaaaagccaattagggaagggtgtatatatgtaaaataggtgaagggtgaggatcaatcagaggaaagagcaccagacaggaagagaggttctcaatctggcctgtagatgtatctgagactcatagcttgacttttaggctttaaactgcctttggtttgaaattgaggtttcactgtggacctgcccctatctgcctaggcatttgtctgcctcctgctgctatcagtgtggggtaggaagtaggttgacaggaaggagacaagaattccaggtaagagtgctctgaaaacaaattttgtaattttgttattcttaattaagtctttcttctttcttatcctctgtatgctgttagttgccaaatcctgttgactgttttcttttacggtatcagaactctgacctattctctccattccaattgtcagtacctctggatgtttgtagttatttcatgaataatcttgcctttagtctcttttaactgtcaccttataaaatacaactttgatcattttattacccttgtcaaaacccatcagtgttttcccattgacctctctttaacgtgacattaaaaactgtgcaaaatctggcccgaatatatttttcctacctttatctcaatgttctttgtcatgaattctatgttctagtcacttaactgagcattgctctctgaaagtggcctcaagttgttttgactctgactgttcatttggcttaatgttttactgtctttgtctgcatggccaaaccctaaagtgtctttcaaaacaaccttcatatggtgctgtcaattcttaattgattaattcttcaaatggtaagaaatctctatgtcttaaatttccctcaagttgtatttttctcttttggtagtattttttttttttttttttttgagatggagtctcgctctgtcacccaggctagagggcagtggcgtgatcttggctcactgcaagctccgcctcccgggttcacaccattctcctgcctcagcctcctgagtagctgggactacatgttgcaggaagtcagggaccccgaa

SEQ ID NO: 126325 - DNA, 1031 bp, Homo sapiens
atgaaatgatcaatgaattgtatcttcacaactatatttatatctccttaaccaaatgcttctgcatttactgatgaggaaaaataggtgactcagaattagaattcaagtcctctaatgttaaatattatttaaactttacatctataaccttcattctttatctttttaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtatgaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataatacgtttcctccagtgtttgtttgttaataacaacccctgaaataatgtgtagctacattgagactctcatttatcaactaatagttgaggacattacaaatcaact

SEQ ID NO: 126326 - DNA, 2420 bp, Homo sapiens
ctccagatggttccagctgctaatctttgagtattctacctggagcccatgcatgggaaggagagatgagccatccctgttgtgtgctctgtccaagttcttcattcacaaatctgtgagcataataaaaaagcttgtttgacaccattaagttttgtggtttcttacacaggcatagtaactgaaacagatgaacactgttacccccattttacacatattaaatacgttgctcagtcatttggctaattagtaagtggtggaacctcaaattagctaggtaggttgactgcagagcctttgagttgttcttttctaaatattgtcttgcaatgtcagcctgaaactatatcctgggtctctggtgtgagttgggagactaagggaaagggcttttattgggagcaagaacagggattgcagggaatctcccagggatggcagtgaggctaactgttttctgtaatggcatgagctaggtgatactgaaaaaacaattccaaaatttcagtgcattgtcacaaaaggtttttttttttttttctcaaactatgtgtccaccttagcccatggggggctctgcacattgttgagggggttataagcactctggaaccgaggctgatggagggacgaccttgacataattccaccatcagcaaggcaggggatggagaaagtggtgaattatttactgaaacttaaagcttccactctgaagtgacacatcacttttgttcacattacatgtaagtcacgtggccacacctaacttcaaaggagcatgtaccagaaaggaaaataaaatatctggagaatagcactagtgactccccaaatctgctcttcggtaacaaaatactgaattcactctcctatgcaagaaatatattcaccccctttggaaggttacaactgtggaattccattgtgcaaggattccaagcccagagtttaggatctctgggtgatgtacttatgtggaaatctatttcagggctggagacggcacttcatgaactaagaaaaaagtgatctgctccccatctgtccactgcataattcagcaggaatagaataactgcggcaacaacaaaacatattcaaaaagaataaaacagaagaaatatagcaagccctacttaggagcaattttgacatcctgtggtcagtcacttgagggcctccaactccagcagaaaattacccttcagggctcatcagccgccaagtcatcaatgtgttggcagaaggaggcagattgaaagaactgggagaatcagtatctgagcacaggtgagaaagggaacagtttgtagggaaagggttgatttcgagcaataaagccaatttggctcataccattataattgtggttatacagagtaagtgttaacattaattggttacccttcctgagtgccaaggactgctctaaaaggtataatcagtcttcacaacagtttgtgaagtttgttcctttgagctcatccatgttttgtggataaggaaagcaacatacagaggtgttacattgcgtgcctgaggtcacatagctaacacctaatagaagtgggatattggatcccaggtttcagggttttagagaccttatgcttaacccctactctgtgttacttttcaaagggatagactatagaatataattacatacatggaaaaattataattccatattttttctctacttctgtcttgttaatgggagtatatggcctattttatgggtagctcataagttatttaggatatctataaatttaagcataagatactattttaatttttaaaatttgccatgagcatgtatatgtatgcatcagtggagtaatttagatcttctgtgacttagatgtgattttgatctttgtgagtttttacctgatttcaggacctacctagtcaataaattgatactgataaattaattcatagtcctctttgcaacttggtgaatttttaataatactaagaaagccatacctagaaattgccagtatattttacaaattgcttgtggcagtataaaatatttatttactatctgagggctacaatataaaacaaaaccacagggtggcagcaacaacacatatttttctctggaggcaattttatgccttttctgaaaggtagtggtgtggggaaacttttatgctaaattgaagagatgacatctttatttcataaaatcacccacgcaccgaagctctataatttgctataagtaattagtgagcagttttaataattagctataagtaattagtgagcagttttaacttgtagacatcatatgactgttgtacaggccactatgaacttgtatatgtattgtttttgtgaaccttttatctccctcttctttgatccactagcctaaacatacctgcacgatg

SEQ ID NO: 126327 - DNA, 1200 bp, Homo sapiens
gacttggaaccaaccaaaatgtccaacaatgatagactggattaagaaaatgtggcacatatacaccacggaatactatgcagccataaaaaaggatgagttcatgtcctttttagggacatggatgaaggtggaaaccatcattctcagcaaactatcacaaggacaaaaacccaaatgctgcatgttcttagtcgtaggtgggaattgaacaatgagaacacatggacacaggaaggggaacatcacacaccagggcctgttgtgggctacagggaggggggagggatagcattaggagatatacctaatgtaaatgtcaagttaatgggtgcagcacaccaacatggcacatgtatacacatatgtaacaaacctgtacattgtgcacatgtaccctagaacttaaagtataattaaaaaaaaaagtgagtaccataaaaaaaagtctaaacctacttgaaagagaaagtacaataacgcattcaaagaacaggtagaagattttcatttgaatgctcattggttgtttagggacaacattttgaaatacattataaaggtgaatttagttcttagaaacttttgaaaagggaattgctggtgtacagataaatacaaggatgcttaatagaggagtgagtaggcagaaaattatctggtaagttggaagaagggtgtattttaggctacccataagcctgtatgatttaagaatatcgctaagaaagtgaggaaagtcattcatcttagatgacttttttttgtttgtttttgttttgttttagacagtcttgctctgtcacccaggctggagtgcagtggcttgatctcagctcactgtaacctccacctcctgggatcaagcaattcttgtgcctcagcctcccaagtagctgggattacaggcaggtaccactgtgccagccaatttttgtgtatttagtagagatggagtttcaccatgttggccaggccagtctcaaactcctggcctcaagtaatctacccaccttggcctcccaaattgctgggactacagatgttagccactgcacccgggcctagtagatgacttttaatgataatcttgtgtttgtaggtgcttaagttgcctaaacctagaatgatttgattctaggcatatttattcctggtaaagcctcagacagccaagctaaatgacatcgaaaatacttg

SEQ ID NO: 126328 - DNA, 2696 bp, Homo sapiens
tgttgaagaactgaagacttttactgtacaggataaacaactgacattaaatgtcttagttgcctctgctgaatcacacctagataaggatataattaaatatgggtttgaggaatgaactgaatctggtcattatcctctctgcttgtcctaactagagtcactaggcttcaggaaaccggtgatttggaatttgatgaaatatagtgggacactggtttatatcgcatattgtatgtgaatttttaatcagtggcaaaaaaatactgtatcgtcatcacaattgttagaagagatggtctcacctagtaaacactgagttaggtctaggcaaggtattttcttaatgattgggtcactcatgttttgtaactttttctgctttttgaaatatgcatttaactattcctagaagggaaagtaaaagtaatagtctcagttagttttactccctagatgacatgatatatgtattattttaaatgaagatttattttttgtatctattcattagtgtagggcagtcattaggaggcttgtatgtgactgtatgaccttaacatttcttaagatctggttgaattgatgggaaactgaatcagaacctaacctggcaggcactaaatacccattttaatttagattttcttcttttctcctttaagtcttgaactgagagtcccatttctagatcatcgattttcttcctattacttgtctctgccaccagaaatgagaattccaaaggtaggtaaatcaactcaaggtaaaactgtccattgccatcagattatatttgtaatttttacctgatgctcctttttttgtcacgtcagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggtataatgtctttaaaaacattttcaggaataagacagtttggatgcagagctgtcattgctgttcattttgtatttagtttgaatgatacatgtatttagtttgaatgatacatgtatttagtttgaatgatacatacatcagatatctctctgataggatgtccctatcagagagattcagagtctctgtaaacaattatctcttttgtaagaattacgtaagaattaagtagcatgaaggattataaagtagcatctagaatcgagagagagaggagacttactactaatcatcactgattttcatttatcagatttttgggcacctgctgggtgccagatcttgttaggcacaaatgactaaaacagagccaccaagtattaaaaatatgcatatgagtgttctttaaaaggcactgcagctatccatattatgaatactttagcattttctaagtgatgggtgattcaaagggtctcatacaagttacagtcacgtcttaacattttctgtttcgtgaaatgagactaaacacaagtatttcctgccattttaagccattttgctcttatatgcttattcttacaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaccattgctgtagtcatttatgttcatgcagtctcttcataagaggtaactagaactgttttgctgtatcacagtaaagtggagggtaagctaggaaaagggaaaatgatcagatgtctgcaagaactcacagccctctcctggcagagctgctttagatgacatttgcatcttgtgcccgtgtggcttccttccagtccttgcctcatcttagggacgtcatcaaaggactacactatttttgttctgcctacattcctaacagctgcctaggcagactcagacttgaatcttctataggagttcatcacagctctattttgcaagatagtagttcatttttttctcttttatgttgagccaaagccacttctggagacttgtcctagagcaggggtcaggctttttttgaatttttaatttgtttttaataaagagccagatagtaaatattttaggctttgtggacctcttttggaactgttcagctctgccattatagtgcaaaagcagttacataggcaatatgtaaacaaacgagcgtggccatgttctattaaaagttacttatgaaagcagatggtgggccagatacggcctgtgggccatagttagttgattgctgttctagaggaacaactaagctaactaagcatttctgatgaaagtctaaacctttgtcagatgagtagattgcaaaaattctctcccattctgtaggttgcctgttcactctgatggtagtttcttttgctgtgcagaagctcttgagt

SEQ ID NO: 126329 - DNA, 3310 bp, Homo sapiens
tgagtgttagctgttattattatttttgaaagtactgtatttagaatactgtgggcagagggcagcttgtctgtattcagtgagcgggagacctagttcccactatggaggactttcgtagcatggatgagaaaaagctagagagcagtctcagtgcaaggtaatcaatgccgagagaatccaaaatagccaaggaaagcagaatgaggggaagggccattctatataagaataacatcctggatataaaattaggcatttaagaaggaccaaaaaagaccaagcttagcgtgggaccatgttggactagagagagatgaggtgggttaggtaaaataggtagagagggaggtgccaactgggagaatggttgaagccttggcaccagaggagctgaggggagacttacttcctggtggtggagttgaagcaggcgagggaacagtgctggatggggcttgtatgtggtgggctgtaaagtcatttttctttttttcccttgtttagttttcaccattgttaattcataaagctttgtgaactcccatcatgtttgattttcaagggaagttattttctttaacaagtaaatgggtatttctttatataataaggtggcagatcatattggaagtgaacattatgaagtcctttttaactctgaggaaggcattcaggctctggatgaagtcatattttccttggaaacttatgacattacaacagttcgtgcttcagtaggtaaggtattatgatattcttaaataaaaagctttttttaatactgaaaaaaatgtaaggtttaaaaaaattatttcaagccatagttttaaaatgttatttaaggatgaatgcaaattaaatccctatgttactgattatttaagaccacttaagaattctctgaatctcttttggagtgaagggaatagtaaatacgtagttcaacctccacattgttggtgtcactgttggtgtttccccagggagcagatacatattttctgccctctacctcccatttctcttatagtttcttgggctacagtctatatacagtgaggaaataggtctttttggtaatgcatttttgataagaaatagtcattttagatatattccatcacacaacttaccagtcactagctatcattgctctgcaaacaatactaattttatcttgtagataatgtatctactgagattggaagtataccccaaatcagactgatccagtgttattgagcctttatatgctactgcctcccttgagagacttgccttggaaggcaaaaatatcttaggtattacaatggtttatggccctccaaaacatcacagtaaataagcagatagacaggatagctctggtattggaatttcatggggctggggtgaggttaggaaaataagtgtctaaaaaggctctctagctgaggtgataataaaaacaaggttgagaagaaacactggtttagagagatgtggtgcaggaccaaggaggcaagtttaataacttatatagtctccccagctttatgtgaaatctggtaaatggggagtggcagggggaaaatacccatcaaaattaacactaaaccaccaaaacggttattcttatttttgtgtcataataccactatgaaaggcatgatttttaggtatttgagtcattgttcagcttagcaaagttttgaggtggacattcttggtctaaaaacattagaattttaaaacctgtttagaaaatgacaaaatggttccgggttattttattttacagtagtacttttggattaagtacatataaatggcttataaatacaaggtcattattgtggaaactactttatattaatatgaagtccagtatagtagtaaagctttcaattatttccaaaaatcaaatcaaaggcatttttggtggaaggttatgttgacattaaagttaatttctctctctcatttaaggtatgtatttaatttccaagtatattcggaagaacacagatagcgtggtgatcttctctggagaaggatcagatgaacttacgcagggttacatatattttcacaaggtaaccactctgaagtggagggatattcatgctatattaagaaaagtatgaattgtttgactattttctatcatctttcagtatgacagtgatatttttgagtatcttgtgaggttacaaaagggaatctgatagtgtttgctttctatctcttggggaagaaagaaattttaatgtgtcagataatttttattctttaaaactagttacagctgggtatgagggctcatgctcatacccccagctgctgaggaggctgaggtgggaggatcacctgaacccaggagattgaggctgcagtgagctgtgattgcaccactgcactcctgcctggttgacagagtaagaccccgtctcttaaaaaaaaaaaaaaaaaagttaaaaataaataaataaaactacttaagcttgagaatcccctttctgccatttcttagcatcctgtggaattatgactgttgcccattgtgttcattttattctaatattagcagtttggtaggaaggaaggcatgttttgtgaagcattgcttacctctgttcagttatttactcccttccctaaatttgtttaactttttgtcttatccacctttaggattggagagggagaaagaaaaactgctttgtgtgccaaaagcaaaactcttggtgtttttgtttgtgaaataggctccttctcctgaaaaagccgaggaggagagtgagaggcttctgagggaactctatttgtttgatgttctccgcgcagatcgaactactgctgcccatgggtaatatttttagaggctattgtaaaacaaaaacaaaaaaacaccaaaaacaaaacaaaacaaaaagctcaataccctgagaaaataaaaatcaatagctgattggctatatgttacatatagttggctatatgttacaaagtgtgacttttatagagaaaatgaagctgtttcttaactttgtcccaaaaggattaggccacatttcaaagtggtgttgtggtatatggagagaagtcttcttccataggttgtttgaggtggagttttcacctttaaagggtaacaacattctgctcacatctgaacaaccaagatggaagaggcaaggctgctacagcagctaccgttaagtgttttaaagagaagtaaagatcgtaaacatcatgtgacaagtagtgagtgcccaccatgcccatgtggtgctgtagtgaccctgagggaatagagtagtgaaga

SEQ ID NO: 126330 - DNA, 3355 bp, Homo sapiens
cgggagacggagcttgcggtaagccgagatcgcgcaactgcactccagcctgagtgacagagcgagactcatctcaaaaaaaaaaaaaaaaaggatcaaatgaatcagttttgaactaatccacttaaatgtaagggctaaaactataaaatcccgagaagcaaacatagaagtaaattgtcatgaccctggatttggcaaagctttcttaaatatgagaccagcaacaataataaaaatcaatgaattggacttcatcaaaattaaacatttttgcacatcaaaggacaccatcaagaaagtgaaaagacggcccacaagttggaagaaaatacttgcaaatcatgcatagcactttttgatggtaaacttgaggaagacatttatcttttatcccttacctgtgcagcagtaacatcctaatatctctctccctgcctctttttgccattctttaaattctttctcacttaattttcagatttaatattggctgaagcagggataatgagatcaatcaaaggggtccttaggacactagtcacagtgtttgtactaatactggaactggcttattttcaggcatttctagtgtgatcagatggcaaagaacaagcatatatatatgtcagttgccaggactgctgggaaagcctggtaaagagaacactggggaaaagcagcctcctgctcccctgggccttctttgagcctgatgatcacttgatatggaacttaccctctgaaattccttaattgttcttttctatatccttgacactgtccttttccagaccaaattatctcatctggaatactgcaacaattttcttttctcagtgcttttagaataacctgtcaaaatctcatctgattatagtattgcctgcttaaaaccttttaattactccccattccctatccgggttgtgtagctcacttgagctctgctggctggtgagggaatctgggtcctttttctggtatttgaattcagtgctacacaggttactggctgggtagacaatctcaaattgtaaatcacgagtattccatgtagatagtccattacgatctacaataaaacattgatgtttgtatcaaagatcatggtgatgagaggttgggtactgtactgtctgtgagaatttattgaggaaatttaagttatatggttttattcacatatagtgtataacaactagttaagggatagatgtcttcttatctgactttaaagtaggtaaaagtggatcattgtacttgttaaaggtctgggaaccatggctgtgttctgaaaatacctcagtgatgacaaataaatgactcccagcctatcataacattaggactccagttcatccctttgcttcataagtgtgtcttttccttttgtgtatttgctttagtatagaaaataggttttcttgattagaaatctaagaagaagaaattgaacactggagatttttctatttctttgaattacgaaaagttagtgtaatttggcagtatatccctgtgccattattgtctctcaggtaagtagatggtagggcttaggaaaatagaaaattttttttcctattttgcttatttaatgggtatgtgtttgtattaaaaagggaaaataggaatgtagatgatgttaactaatcgtgaaagttattgggaagggttacctaatttgaataaaggtatcattgtgaatttctaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggtagcagacacccacccacctattccccatccttctccaagggaaaaaaattttaagttgtattctcccatcatttgaatgattttagtttcaagacctacttcctattttgtttggagggaacacattaagatttggcacactccaccattgagtaaataccatcatgatagatgttgatgattgtgtatttcatttcaataactaatccagcccaagattttctggagctgtttgatttactgctgtgtttataggttttgagatagaaactgtgaagaacaacctcaggatcctttttaataatgctgtaaagaaacgtttgatgacagacagaaggattggctgccttttatcaggtgaagtcaattaaaaaaacctaattatatttcatgtgtgtttaattgaaatgatttgtagccatccctttggtttttactataaaatatttactgtatgatttactctttccttcattataggatggaaatgattttttataagctgtatttaatagtcatagtcatactccaacttgagttacactatagctatgttattggtgttaagagtgagtcagtgaatgttctttagaattctgtgtagtgatttttaaccaattcaaatactactattatcacagtttatatatttttctcttgttgaagttgatttcagtttataaaacttggcggattttaaatagtaaaactatgatcttggtgtttatcaggaatatacatcttctgtccctgtcttatgcaaggcacataactaggacacttccacttcctcttttgcatgtagggggcttggactccagcttggttgctgccactctgttgaagcagctgaaagaagcccaagtacagtatcctctccagacatttgcaattggcatggaagacagccccgatttactggctgctagaaaggtaaggtgctgtctctgtcccttgtgtagtgtagttagagtagacttgttattagaatgaaaatggagtcaataatgggtgattctactgctgctgtattgactgggtcaattgttttaaattgattgtattaaaatagaatgaaatggctgttggatatgcactgtgttgtacactgtcctctgtgtacttttatctgttatgacccatgcaattctcacaaagaccctatgatgataagtatgctcttttgaaagtaaaggtgtctgggcatggtggcctacacctgtaatcccagcactttacgaggctgagggaggtagattacctgaggtcaggagtttgaaaccagcctgagcaacataatgaaactccatctctacaaaaaaatacaaaaactagccaggcttggtgacgcatgcctgtagtcttagccttatgggagcctgggtgacagagtgagaccttgtctcaaaaaaaaaagaaagtaaaggcataagtcaggtgcagtggcaca

SEQ ID NO: 126331 - DNA, 1386 bp, Homo sapiens
gcaggtattctggtgattctactatgctacttattactttcttactgtattaatggtatgtcatattttataagcatatgaaaatgattgctcatcagcagcataataaattcagagtcaggaatgatggtcaatgatgtcaaacagccacagattttccacatggtagctgagatagtgacccctttgctttctgatggttccatgtatgcaaactttgtttcatgcacaaaattatttgaaatattatataaaattacctttaggttttgtgtataagatatatgaaacataaatgaagttcatgtttagacttgggtctcatgcccaagatatctcacatatatgcaaatattccaaagtccaaaacacaaaacacttctggttccaaacatttcagataagggatactcaatctgtatatatataaatatatgtatgtattacatatatggtatgtatataatatacatttccatccctccacaggttactgttctggcacattcccattatgttctgtttatcagactgcaactaaaattttcatgggttcggctttatgttgaacagaatttgcagaatatgagttgaagcgaaccatagtttaataatgctgtgattctcctaaatcaccaaagtgcatgaaaggattatagagctcagaaatactgaagcatctttgcaataaaaaattattagtgaatgtacaaggagtctaacattttggttttgctttcgcttcctaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtaataataaatttttctatagattttcattattgtcttggttgtacgttttcttttaaattatatttgaaaatctcttagagagcaatccagaattttacaagtgactaagttatgagtctttacctttttttaaaaaaacagaggagttgtactctccttttcagcacttaaattctgtaatccttgaaggatgattctttagtgcagtcgtttattttttgctgtgctaatatgctctacatctagcttgatcttaagtgcagttttaagttttcctgtgtcatactataatcgtagggttgactctgcaattattgcattgtggtactttgcgcagttatagcacagcaagtgttaggatttctaaaacagctttattgataattcacatacca

SEQ ID NO: 126332 - DNA, 2063 bp, Homo sapiens
ttttatctgtgaacaatagcttttgtcattgtttgttgcctgctcataggaagactcttaataatagtcttctcatttaaaaagttttaaaatagttattcaggaaattccttttacacatttctttattcctttattaagggtctactatgcaccagacatcatttttctaggtgattggagatgaaatggtgaaaaggaaaggcaagaatggaatttcctgctagtgggaggtagaagaagagagtattaaaaattttttctaagtcaaataatgtcatatacatgagaacgctaggtggtattatggcattatcagcttggctttccccttaaatgaaataggaagtgccctgtttcacttgaacagtgttatttcttttattaaaaagttacaagaagttaaatattttgaaaataattaatttctattctaaattagccaaatgttatatttgtaaaagtagagaagtttgttccattgcttctaccaagcatctaagtttatgtagttggggcagctagcagtctgtctaatgagcagaatgtatactttaggcttatataaagtattcagaaatcccccccacacctcctttttggtaaaaataaagtttaccactacaataaaatacagccagaggtgtactgggagtagaaggagactgaatgaaagaaaggaggaatggggtaaaggctggggcaaagagcaggccctctccctgcaggggagtatcagggcctgcagccaagtcaaatgacagcatgacgtcaggaggcaagatttgagggcttttatttaaggtgcagcattggagtttggttttaggagagtaggaagtaatacatccgttacccaaaggacccttctcctttttaaataagttacctgcaaagtttaggccaaagaggtgggtaaggtagatttgggaagctgttgcttactaatatcaccgaatgctttatggtcactaacccttcaggcagttcagcccagaagagtcagcagaagactgtttacaggcccccacctgctagttacagatcatccctgatagagcagagaggggtgaccaggtagtgactttgtagtcactggaggcaaagcccatttttggacagttcagtgaggacttatagacaaaagattcacaaattatggagtgagttggatggagtgtgaagcatatttatgggtcatgcacatacataataggtttactttttgaaatttgaaagcatgttttaagcttatctaggatttccacctgatttaaacctcttctttctctaatgtcagccaaaaacccgagtacaaagaagaaagaggaatacatcaaggacttttcatcctcatagtttgccattaatggctcatagtttgccgttgatggtggagagtgtcagaattggggagtagcctaatcaaaccttcttactctgcatgcagtggcagacagtccctttgctgttcttttggggaatgcagactaataaagcgccaccgtcattttatctatcagtaaggagtagctttaatgctgctgcagtggtggaagcactgggcattgtcatccacccctggggaccagcagctttgttttggatcatgtatctgttattgtgatggagccatttatttttcagggaatgatgccaaatgatgtttgtccctttgctttacatttttatagctaggactttgaagctgaactggaggaacttcttagccaatactatcttctcaaatcaaaagtttatagttgcaaaagacacgttttttagtgtcatggcaaccaggcaacctattatcttaacttaaatttagaggttgagcatccctaatctgaaaatctgaaatttgaaatgctccaaaatctgaaactttttgagcactgacatgacattacatgtgcattttgatgtcacagtcaaaatgcaggtgtaaaacacgcagtttatttggcgttccctagggaaaaaagaccctctcagcccgcttcagctgcagtataacttttctacacatgcccggatttccccatgcaagcacgcccacaaag

SEQ ID NO: 126333 - DNA, 4261 bp, Homo sapiens
ccgccccggacaccccgcggccccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccaggtgagccgggtcctgcgccccgtgccctgcgccccgcgccagcatcctcctcgcgtgccctggggctgctccggaaggaaggggtggaggatgcggtcttcagcctggcacccggcagacgcggttcgcgggcgcctgctgatgctgcggctcctgcggtagggagggcggggcggacgcctagcgattgttacgcacctgacagctagcggaaggacctttctgtcctggttccctgaagcatcgagagggaaccgcggccggcaggccggaccgctccggagaggaggcagcggcagtttgagcccctgtaaatgttatatgtgtacttttttttactatgtggcgtcgaagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagaggtctgtttagggacacaggcgaccaagtacagaaaaaggcaaaagaactagcatgcctttttcaatggctgtcattttgcagggctggcttcagatgattgttatagctttaaataaaaaggacagttttcatctcggcccgtggcctacattatttctttactgtccattgccctgggcgcttgactaataatttaacagcagtttttttttttaaattttaaatcatgattcatagcattgctgtaagagtaattagaggtaaagtagggcttgaacctgtctgtagttggttacttactgagatcttaatataaaagtaaagggagagggtgaagttgtaagtagcactaagtggaatagaaattaaatgcactgaaactgccatgtccagttcggtaggcgctagccacctgtaactgttgagcacttgaagtgctggctagtcctaactgagatgtattgtgttaaatacactggattttgtcgttggagtaggaagaacagtgtaaaatatctgctcgataatattttatattgattacatatatgttaaaatgttactatttgggacatactgagttaagtttatttaaaattaatttcacctttttcttttaatggggctactagtatatttaaaattacatatgtggcttacatatatatttattggacagcactgttctagaagtttaggaagaaataagaaaaatattgagaacaggtagcggcagtaggaactttgccctcctataagactgattccaataaaaataataggttatagttttaattggctttttcctactagaaaaaataagtgtactttacatgcctctttgttctccctttttcccctccagtttagtggttagaatgtatttattatagcaggattaatacagggattcactaagcagcgttaagaagacttaggtaactgattccctgatgaccatacttgattttcaaagcactttcctaacccgttttaaattgatatagagtcaaaggcagatggcttattagtagtcatctcatttaaatcttatggaatttttccagtaaatctcaaataatttgttataggctatttgggctatttggtcaagtgcatggaagagacagcataggacatgtggtacttcatttccaaattgcttgagatgattttcattctaaccatatattatttggttctggttttccggaaaagccagctaaacctttggttcttttagatataaatgaaatatcatcaaagaatagctcaaagtgacttatgcaacttgaatgtatattttttccttagggtgtttatcccaaactatttgggcatttgctgcaattcgcagtttttttaaaaaaaacaccaaaatagttatttttcaagttagagatgttttaattaaaacatcttgtttttggtgtatccattgacattctcaaaacggaatgtatctggacctctgtgtacaatcttcgtagcactcagacactgaacagaaaggcagtcatcactgccaaacagggcccaaatgccacacatggtgcaatgtgtcattttgagctggcagcagccaaataaaacagccctttatttcacagttgagaatttgaaattggaaagtaattaacgtatgtaagggtgatttatttgcttccgggcttatagggatgagctaagttttttattagggatgttgttggtgtatatgtctcacctactttgcttccttactgaacaatgcaactttgagacagaaatatttgagaacatttttgtcagtgaggacattttgatagtgaatattttgtatcttctattaacttgaaatgttttatttgttataaagccaggatatctgatatcaaattaaattgttttttttttccctttagattttcttcaatcacatctgaataaatcacttgaaggtaacctagatgtaatatagtgaaatgcttgaaagagctgcgtatcttttacacttacagcagtatgattttctgttgtacccattatatggtacctgcagctagttcagataaagagggcatttaactgtcaagggaacctgagaggagactctagtaatctggaaagtctgttggatctttgagggattttgggatggtgagagtggggctaggatctctggctaggttggagccagcctgcatttgtatctgtatcttggaagcaaacttagaatgcagagacagatgtggcatggacgctgtcagctctagccaaccactaaatcctaaggtgggagagatgcaggctttggctaggtgctaagctgctgtagccggttgaatgtagaggtcactatcttttccgaatacctgtaagtaaattaaatcattctctactcccatgtgcctgccaacctaatgggaaatcgctatagaaaagatggtttaaattttagtctttgaagtggtttatgcacgtttccggaatcaagatttaatgcagagttggattggatattgaatatttttgatttgtctgcttttctctccatagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaaggtgaggagaaagaaaccagatgtctggatgcgattaaacttcagagtttgttggttacgatgatgttacatattctgtatcatgctttttcctttgcaaagcactctatgttcgttatctcatttgctctaagtatgtaaatagggaactgatgaataaaaaggtgagtgaaatgacttggtcacaaaaaaagtgataaaaatggggattacagttcagtttcattgactcttagaattttttctccttctccccagcttttcattttgaaaaaattcctaacatacagtaaagaacagaacaacaagcacctagattaaatagtcattaatgttttgccatagttgcttgatttttctttctacacacacacacacacacacacacatgtttttgctgaatcatttgagagtacagtgcagatattatgacactcctaaatatataagcatttatctcctaagaataaggacattcttctacataacatcaatgccattattaaacctaagagtccataataccacctaatatccagttaatacttaaatgaaatttccctaagtgtcccaagaatatttttatttatttatttattttgagacagagtctcattctgtcacccaggctggagt

SEQ ID NO: 126334 - DNA, 1963 bp, Homo sapiens
gagagaggcattctcttgatcaattcaagtgaaaagcccaaagctgtttgatggctgagaggatgtgtaggtcaacttaaggagaagagcctaaaacagctctgacaagtaaaaaaaaaaaaaaggcagaagacaagacaggcctatttttgcatgttataaaacaccgagaaaaaaatatcaggatgattgtcatggtcttctttacattttcctgtatttttcaatttaaaataattgttggtgttacctgctgcccacgcactcctccgtctgcagggggcgcaccggccgccaccgctcactccttcaggatgatgggcggggcctcctgggccggtgtggactgacgagtggctggccgccctgtccatcacgacatcccgcccccgcgctacgtcacatgacgcagcccatcatggcggcgggagcgcggcttcccaggcccgccgctccgcagggctgctggcgttgctgctgttgagaggcggcggcggcggcgcaggcgggcgggaaggatggtgtttctgcgactggagcggcaggtgcggaccgggagccggaccgaggtttggcagaagcaacgtgtgctcgggagcaaccggcgcgggtgccactgaggcagcggagggaggcaggatcgactgacgggcgaacggacggacggacggaaggcgactcgagggccggccccggagccgcgccgtgggcgagatgccggggccgccggcgttgcggcggaggctgctgctgctgctgctggtcctcctgatcgccggcagtgctggggccgcgccacttccgcaaacaggtgcaggtgagcgggcccgcggcggggacggggctgcggggtcttcggcgtggaggggagggggcggcagggccgggccggcctcggcgccgaggaatcggagggcctgccgggggcgggaagcccagggaggcgagtgattagggagatttctgccgcaggggcgtgggatttgggggggcgggagcgaggcgacgtcgttggggctggggagggcggcgggcgaggtagcagccaccgacccctcccgggataggctgcggtgccggccctggacctgttgccttaagatcctcagcttatatcgcttcctggcagttcagcttccctttccagatgtcacctgcctcttgtgcttttttttcgcatctcataagaaccgtttcttagccctaatcatacttaaatgcaaatgacttggcgagctgtgcggagtttgttttcgctccttgcaacttattctgaagttgtaaattgattttagacgctgtgctttttattcggaatgtatctccggggatgagaaggaaacaactataaatatttctattttaggaagccagtgattagagtagcaggcgttgaataactattgacaaactggcttaagggtgatggaagtttctattttagctaacgtcagtgtatgattttcttttctccccccccgcccattttctcaacatcgtttttatttggggtttattttcctaaataaaacttcaacccaagaaaacatcccaagttgggtcatttttctaaaaaggaaaaaaaaatctaggctaacttggcgttattgactgccgccattacctttgaaatggggaaagattgaaatttcatacattcatagaatgttagagttagaagagaccttaaagaaaatttagaccaatttcttctttacgtagtaggagatactgggcatgttgggtcaaatgacctacccagggtgacacagcttcgttgtaggcagagccccaaagccaggtcttagatacccctagttgtatgattttttttaagtcttgtaactgttttggaatactctcgaggtcaagagttattttggaataatgttaattgggtacagaatgtggatgtactgtctccagtaaagacatatttttcaaacaaatctacgatgaaagc

SEQ ID NO: 126335 - DNA, 1042 bp, Homo sapiens
tttagttgagagtaaaattcatgaaccaatcctagctggaacagagtgttgtaggaagagcttgggctttgtagtgagatctgggtgtgaagccttggctgccgctggaatagcttaaggaccctgggtcagttactcgacctctgggcttagaactccatcattaaaaagggtggcaatgacaatatttacccaaagggttgtggggggcacagtggtgtaccctctcacactagattgcttcattgtttcagatttctttgtaaatttggttatcatcaaattgactaatggcaggtggtatggcatcaaagcaggagctcaaagtggtagctgcgtaacatggcatgtctagaatttactggatttaaaaaatctttgttgctcaaaataacttttttatggtggatggagatgctttagagagaaatctggtttatttaagtctaagctggtattgttactacttgaaattcgtagtgttggagaactatgctggaaatttttaggatcatctgggttagtctgcttttatgtaataaacctgtttttaaagtggaagatgactaaagctcttgcatgtgaacagatgctgattttaatttatttaaaggaatcatgagcacttgaaagtttttcttgatcttaaacacaattgtgtattgtcatgaggcatccctgattaacccaggttgtagtagaacaagcccagagctgatgctttctcttagaaaccagagagatgaatgtgactgacgtttttctttctccctctcatttttcttttttttaagagacaggatcttgctctgctgcccaggctagagtgcagtggtgcgatcatagctcactgcaacctccaactcctggcctcaagagatcctcccatttcagcctcccaaagtgctggggttataggcatgagtcactgcaccaggcaagacttggtttatctgtaaaacggagagaatagttacagtcttgtgaaggtccaaacctgtgttgtctagtacaatagccactagctccctgtggatgctta

SEQ ID NO: 126336 - DNA, 1328 bp, Homo sapiens
aggtaggcctgcagtgggttggtgacgcctggtgggagccacctggcccatgggatcaaagtcacctcaccaggcataggtcatgcgccctgctgtgcaagcaggacagttcaccccactggaattctctaactccttcccaggtagccacaaccttggtctaatcctgagaagacattgggtggcccagattgagagacattccacaaaataactgaccagcactcttcaaaagtgtcaagagttatgaaatgcgaggaaagacgagaagctgtcagagactggaggagctgaggggcatgtggtgattaaatgcaacgttggtagtttggattgagtctgaaaagaaaaaaggactaaagtggagaaaacagtaaaatccgaataaagcctgaagttcacttcatagccttgttaccagtgttactgtcctagttttgatcagcatactgtggtaatgtacgatgttagcattagtggaagctgggtgaaggctgtatatgaactctctgtattgtctctgtaactcctctgtaaatctaaattatttcaaagaaacagcagcttcttatcctggatggatcatcagctttttctcgagcattattttattaacccttacacccatttgtatgtagaggaaaatatattgattcactaattaaagttgattttggaatgtacatgtttttaatattatttatctctctttccaggggaggcgccacctgctgcagaagtttcctcatcttttgtgatcctgtgtgtgtgcagtttaataatattaatagtgttaattgcaaactgtgtatcctgctgtaaggacccagaaatagactttaaggtgagcacagagggtaggaacatttaaaatggtcttccaatatgtttttcaatagaataactggatagcacagtcctttgggaacaggatcagcagattttttttcttcccctaatggccaaatagtaaatattttctaccttagtgaatagtaaatattgtgggccatacagtctctaaaacagcagctcaactctgccaggatagacactgttaccaaatggtcatggctttgtgccaataaaactttatttacacaaataggaggtttggatttggtgcatcagctgtagtttgctccgcctctgtcattgacaataaccacttgcctgtggtgagttgaggttcttgctgagtgaggagtgaagcgtggtgattgaattcactgttgtccgtaagggctatgaggaagagcaagatgattgttcccctccaccccgaaacttctgtagactggtgaatttgtggtcactgagattactga

SEQ ID NO: 126337 - DNA, 1024 bp, Homo sapiens
aattcaaaaaattacctgggcgtggtgatgcgtgcctgtggtcccagctactcgggaggctgaggtaggcggctcacttggttcctggaggtccaggctgcagtgagccatgatcatgccactgtgctccagtcactgtgctccagccaggcaacagagcaaaaccttgtctcaaaaaaaaaaaaaaaaagaattgcttaaactgtagtcatttgagagtaaatttttaagcctagaaaactatttttgtgtaaattccattgcatttaacttcaaactaacagtttaaaaacttacatgaaatatgtataatttattttcctgtcttatgtattctgctgtttggagtcagagaacaaaattacatatgctttttacttaacattaagtacaaactggaaaaaaataattgtggcagcaagttccaaatcattgtgcaaatatgttcctattttaaatgttagccaatggtttttaatgcttgctctctttcattttaggaatttgaagataattttgatgatgagatagatttcacaccaccagcagaagacactccctctgttcagtccccagcagaggtcttcacactttcagtaccaaatatttcactcccagctccctcgcaattccagccttctgtaggtaagaccatacagcctaatgccacgttttcatgaattgtttctgagatctgagaatgggagcctagccatcataaatattggactgcccatctcctctttggtttatttctcttccttctgctcccagtgaagctgaattctagtggtcaggcccattgtattcctgcaatagctttgtcttctgctttctggaccctgggtctggtatgagaataaaacgaatctccttgattcattgacattgaacacctggccagaactcccaggctctgttctggaggtggtttctctgctagttctggccacggctgaccttgctgagtaggactctgctggcttccactgggatgccctgcatttgggtaggagaggaaagt

SEQ ID NO: 126338 - DNA, 1042 bp, Homo sapiens
tttaaataaatcgacacaaataagtataaatacattttaaaataaatagaaaagaaatatgcataaatatgtgaatattgtaactatctggtgaatggtttaaaatggtccttttactgaagaaaaatatttgagttttccaagcttttggtgaggtggtaagtaaaagaatagaaggtcacctgcttattgcttaacttgttcacctgtgttccatttcccggtaaatgcagcagactcctttatcattttgatggaaatgacacaaaaaactgttctttgattttaggttctcttgggagagatttacacgggcactagcgtagcaagagtcatcgtgaaggagttaaaagcaagtgccaacccaaaggaacaagatacttttttgaaaaatggagaaccttactagtaagtaaaccttgtcatgtgttctgtaagactagtctgtggtctgttgaaggtcaggtgtttaaaactactgtgggatttctgcctgtaacatacatgattaagtaagttccaaggtctcataagacctaaaatgtccaggcgtcatctgaaaatcacttagcattccaagaaccaggagaactcagcctaaaccagaaaagacaacagattccaacacagatgacagagatgttagaattacctgacaagaattttaaagcactcatcataaaaatgctttgtgagcaattgcatcacgtttaaaacaaaaaaaatagtctcagcagagaaatagaagacataaagaagacataaatggaaacctcaggactaagaaatacaggaactcatcatttcagttacagcctcaggggcatggggaaatataacaaaagatccagcattattcatgtcatagatgtctcagaaggaacggagatagaggatggggctgaaaaaggattcaaagcagtagttaggctaaaattttctacatttggaaaagaaaaagcctacaaatttaagaaattgagaaaatgctaaacaggatcaacccaaggaaatccatgccaagacacatggtcaaacttct

SEQ ID NO: 126339 - DNA, 1042 bp, Homo sapiens
ttatctcctaacttaaattactaaagataaaaattcttgaggccaggcatggtggcacgtgcctgtaatgccagctatttggccagctgaggtggcaggatcacttgagcccaggagttggaggctgcagtgagctatgattgcaccactgcactccagccagggtgacagaacgagaccctgtctcttgaaaaaaaatttttaaagtttcttatgttaagatttcttttttaatttgtgaaaatattcacttgattggctttgaattacttgctagataacttagtatacaccttttaagtataatcttcgtgatctttttagcctgtcatttatgtaaatattatataaattattatgaaaaaatttggattactatttgaataattttattagtatgcttttgtttgaataatgttattatcatgcttcctgatgaacaatattatggcttttatttttcccagcattcttcagcatccaaatattcttcagtgtgttggacagtgcgtagaagcgattccctacctcctggtgtttgagttctgtgacttggtaagttccttgaaggaattcaagttcgagtattccagaggttgtattcaagtgtttttgacagatggacatgctggatgaggggttgctttcatgtctgtcccccacttgaagaactttatgatgagttacttttattccctttggtgatggtgatagtgttgactgacacttacatagtggtttgttacactgcagtccctgtgctaagctatttagttgccttaccacacttaatgataacaaactccagagttaggtaccaatatttgtccatactttccatgtgatggccatggtgtggatcaagtgtgtagcacagccagagccagagcttgggtctagatgtgccctcctaagagcgtgaaccaggcttgaaacatcttgaaacactttaaccccctgagagagcccaagaatcgctttacctagagtactcctcatccgtcagcatctgaaaatagcaaacgtatgtgacatttatatg

SEQ ID NO: 126340 - DNA, 1080 bp, Homo sapiens
aagttttctctttctcctctggagtggcttctaatttcgttggaaacaaaggagaaggcaccacgtttggaaggaaatgtatgaaggacagcaatgccaggtgcacggcaccgagggaagaccactgctcccctggcagagcagtcacatgacgcttgggagaccccagcagattgataggattgaccttcagttattttatgttcattcttataaaatacattgatgttgtctgcatactgatttaattcacttgctaaatagacctttcttgactagttggtaagccgaaaagtagaagcacagccctaccatttattagctctgtggccttgggcaaatttcttaccctccctaagcctcagttccatatctggtaaacatctcatattgtatttgcagtaacaagtgcaaaaactcctaacataacgcttggctcagggctcaaagcacaaatggtggcaactattaatatcaacattatcactcatgtaaagatcttggaaactgggaatggaaacaaatttagattcttggagtggacctagaagttacctcagaatgtactcagtattaaatgtgggtaaatgtttgtaaaggaatactgtgttttaaggttttattctgggaggtatttgataaattggctatcttcagtaacagttacaagacatgtactctttagttggtcaaggaaaatgcccttcctcaggagtcttttttttttttcttttttttcccgctccccgcctccagccgtcttttcttgactcagatttaaagaacactgaaagctattggcttgctttctaaattttattaactgattcgaggaaactttaatttggaatgaaatcatatcaataaatatttaatcatatggtaaggagaatatggaagattttattccctcagaaggtgttccccataacagatacacggtaaactcccaaaaacatagtatcctaaatgaaaatcatgaaataaagacagcgtaacacagggaagtcttggaggaggcctggggagccctgcagtgtcatggccatgtgctgggcatctgactgtaagtttgtttat

SEQ ID NO: 126341 - DNA, 1650 bp, Homo sapiens
gcaggtagctgggactatacatatgcaccatcagtggtggaccctattccagccagaggcgttttccctagggtgtaataagaatttcacaccctgtggaagaactctgtgtacccaaatcctagcaggtgcctgagatacacacagcaggcactcagtaaatgtaccattgcccagctagcaaagactgacctaataagcagggcaaacactgtcaaaactctagtataaagttgcctctgtgtgctttatcggaatcctcttgttttaatcctctcctggtacgtctccatcccatcttagagtgttaagtgcagagtcccttcggaagcttaagtctttgtggctgccagagtcagaatgacgtgacgagcagagggaggctttggaattgaagttttcattcacctctcatcagctttaccagtataagcctggttatttcatccttcggagctctatctcttctataaaatggggatcgtctttaaagccctggagtgctgttgtcaagatggagataaagtatgccaagctgctagaagaatattcagtaactttccggtattttgcttcctgtctgtgaactcttcttatcaggaatccagattactcgggaaagcataagtagttcacataatagaggtgtggattattttgaaaatgcctcctgcgtgttgagtttgcattggagaaccccgaagacgcgcaaactagtcctagcgtgagtgagcagcaagcagtggtacttccttgtgaatcggggtgggaacccttcagaaccgcgagctcccactttctgtcgatcgctctgctcatgcggccctgagtctcatggttactgtggtctcagtcacagcaagtgctgccaagctcaggcgacgctgccagagccttctgagagccgggcggggctggtgccactggtagcctcatccctggacctgtttttcaacttgaagggagagcagactggctgtgtgtttgcatttcctgacaaaagcagccattgacgtcaagagttccctctgttgttaagaagtgacacctgtgtgtttttctttagctttgcacgttattgggcttcagataatatttatttttaccaactttggcccaaattgtatcattactttgaatctgtacagcacttttatgttttcaaaacatttcatgtatttttcagtgttacccttgcaacagccttgtgagttaaccatttcaagtgcaacctgttgtttcgtgaggaaactgaggctcctctgctatgcatgtgaccagcccagcatcacatggtcttgcagcagtggaactgagatgagctcctggcctcctgactgcccagggctccctcccactgcattgtggagcctgggcacttggggaggagtggggcaggacccagtcctgccactgtttgcttcctcaccacctctgggtttcaggtcatgagaagcattgccttttcccctgggaacaccagttgcttgctttcgagttttataatgagagccaaggaccttctgcaggcgtaattgttcatcttttaccaagcctttgcatttcaagtatccaaagacctacgtggaatgttagtatggagagagaagaggagggagggactgggacagtcatcctgccatccaggaa

SEQ ID NO: 126342 - DNA, 1050 bp, Homo sapiens
ttgactgagccattgtacatcttacatgtgttgattgatgtcttatgtcttcctaaaatgtataaaattgaactgtagcctgaccaccttggacacatgtcgtcaggacctcctgaggctgtgtcacaggcacgtccttaaccttggcaaaataaacttctaaattgaatgagaaaaaaaaagaaaagaaaagaaaatacaaggaaacaagccatacatccggttttaatgtagaacgtggtacagatatggtcagtatttaacctgagctagttacttgcctaaaagtgtgatcatctttattatttaagtgattgatgacatatgtaatacttctactatgaaaaagaattttgagaggttaattcttaagcagagagctcaatatacttactcggatcccgagagaaagcccatttctgtggcatttccatacagcatgatcctggttgttgattcttcttgccatgttcacttccctctgttttcagtgatttagccctgcggaattgttttctcacctccgacttaaatgtgaaagtgggagattacggaataggattcagcaggtacaaggtaagccagaggtttaaatgttttcagtctgatttaatttgaattgtgaagttgtaatgtcaccaaatgccccactgtttgtataagaatcttagtcgctaggctttctggagagggatttgcagcagtcattttaatgtggtctaggcttctggcgtgtggcttgtgtaagtctgcggctttgcatccgaggttttgcaacagctttccaaaagtttcgtttaaaaatatttataaacactgtaaatgatgtagtctgatggtgcataataaattttagagtgaacacatgagcaacagtagttattattacctgttatgataaaatatacatatcatataaatgtttctccattacgtggtcagtaaaatttcagctcatgttcagtaacctggggatctaggtttttttaactctgtcatgaatatattctaaaggaaataagtgaagaagtcaatgaagtttccatttgt

SEQ ID NO: 126343 - DNA, 1085 bp, Homo sapiens
ctttttttgctattgtgctgttgattattggtttcagattaaagaacaatcttggctggttgtggtggctcacgcctgtaatctcagcactttggaaggccaaggcaggtggatcacctgaggtcaggactttgagagcagcctggccaacgtggtgaaaccctatctctactaaaattataaaaattggcagggcatgatggcttgtgcctgtaatcccagttacttgggaggctgaggcaggagaatcacttgaacccgggaggcagaggttgcagtgagtggagatcacaccattgcactccagcctgggcgacagtgagactctgtcttaaaacaacaacaacaacaacaaagatcctattaataatcttttcaatacacaccttgtccttaaaattactggctatgtaacaagtatgagtgttaaaaatttgacatctaaagggagagagaaacagccattttctttttccaacaggtctctgggtgtgacactttgggagctttttgacaatgccgcacagccgtattcaaacctttccaacttagatgtcctcaaccaagtcattagagagagagacacaaaactcccgaagccccagctggagcagccctactctgatagatggttggtagcctcacattccgcctgttctgtttcgtcttcactgtgaggtgtccccaaaacacaaaaaaattcgtgggccaaatattatgtttcttcatttcctctttcaccatgatgtcaccatgagctgaactacttaatgtggttggcagtgatgaaggtgtagaaatgtttcgggtgttgagttggctttagggtccttgtaaattcttttcatattgtttatttatttatttttatttaaaaaaaaatgtagagacagggtctcagtatgttgcccaggctgttcttgaactcctggctcaagtgatcctcccacttcagcctcccattgccccaggattacaagtgtgagccagggtgcctggcctcttttgatatttttaactgattcggccaggcacaatggctcatccctgtaatcccagcactttgggaggctgaggtgggcaga

SEQ ID NO: 126344 - DNA, 1919 bp, Homo sapiens
gaaaagagacccgcggctgaagatgtgcacaggctgctgacttacctgcggctgcagagccagcgggactcagaggtcgactttgaacagcagtggaacgctctgaagccgaacacaaacagcagagactcctccaacaatgctgcattcccaattctcgaccactttgccagggaccggctgggtcgtgaaatggaggaagtcctcaccgtgaccgaaaccagccagggcctgagcttcgagtatgtctgggaggccgctaagcacgaccactttgacgagcgcagccggggccacctggacgaaggcttgtcctacacgagcatcttctatccggttgaagtttttgagagttcgctttcagatcctgggcccggaaagcaagatgacagcggccaggatgtccccctgagggtccctggagtggttcctgtttttgatgcccacaacctttctgttggaagcgactattatatccagttagaagaaaaaagtggtagtaacttggagcttgattacccaccagcgctgctcacaaccgacatggataatccagaaaggactggccctgaactgtcccagctcacggcgctcaggagcgttgaacttgaggagtccagtacagatgaggacttcttccaaagcagtacagaccccaaagactctagcttaccaggggacttacacgtgaccagtggccccgagagccctttcaacaatatatttaatgatgtggacaaatcggaagatttgcccagtcaccaaaaaatattcgacttaatggaattaaacggagttcaagccgactttaaacctgccactttaagttccagtttggataaccccaaagagtcagtcataacaggccactttgagaaagaaaagccccgtaagatttttgacagtgagcctctctgcctatcagataatcttatgcaccaagataattttgatccattgaatgttcaagaattgtcagaaaactttttatttcttcaagagaaaaacttactaaaaggctcattgtccagcaaagaacacataaatgatcttcagacagaacttaagaatgctggttttactgaagctatgttagaaacgtcatgtagaaactctttagatactgagcttcagtttgctgaaaataagccaggcttgtctttgttgcaggaaaacgtaagcacaaagggtgacgatacagatgtcatgctcacaggtgacactttgagcacctcattgcagtcttccccggaagtgcaggtacctcctacctccttcgaaacagaagaaacgccccgtcgggtacccccagactcactcccaacacagggagaaacccagcccacgtgtttagatgttattgtcccggaggactgtctccaccaggacatcagtccagacgctgtgactgtcccggttgaaattctctcaactgatgccagaacccacagcctggataacaggtcccaggactctcctggcgagagtgaggagaccctgcgactcaccgaaagtgactctgttcttgctgatgacatccttgccagcagggtgagtgtagggagtagtctcccggaactgggacaggaattgcacaataaaccattttcggaagaccatcacagtcatcgccggctagagaaaaacttagaggctgtggagactttaaatcagctcaattctaaagacgcagcaaaagaagcaggcttggtgtctgccctctcctcggactcaaccagtcaggacagcctcctggaggacagcttgtcagcacccttcccagcctctgagccgtccctggaaaccccggactctctggagtcagtggatgtccacgaagcgctactggactctttaggatctcacactccccagaaactagtgccccccgataagccggcagacagtggctacgaaac

SEQ ID NO: 126345 - DNA, 1162 bp, Homo sapiens
caaagtcctgctgcccaggatagctgcctggaagccagaaagagccagccagatgaaagttgtctgtctgctttgcacaactccagtgacctggaattaagagccacgccggagccagcacagactggtgttccccagcaggtgcatcccacggaagacgaggccagcagtccctggagtgtgctgaatgcagaacttagcagcggcgatgacttcgagacacaggacgatcgcccctgcaccctcgcttccacggggaccaacacgaacgaactccttgcctacaccaattctgcgctggacaagtccctgtccagccactccgagggcccgaagttgaaggagccggacatcgaagggaagtacctggggaaactcggggtgtcagggatgctcgacctctcagaggacgggatggatgcagacgaggaggacgaaaacagcgacgactcggacgaggacctgcgggccttcaacctgcatagcctcagctccgagtcggaggacgagaccgagcaccccgtgcccatcatcctcagcaacgaggacggaaggcacctgcggagtctgttgaagcccacagcggccaatgcccccgacccactgcccgaggactggaagaaggaaaagaaggcagtcacgtttttcgatgatgtcacagtctacctgtttgaccaggtatctgttccctctaaatcattttctatacacatccatataaggattccaaaatgtgctaggaaattgagtgtggtctgttttctagttgccattttgaggcagcagattgtgattactcacaaaaagtaatttggggttggttagagttctaagaatatgcagaaatgtcatttgctcagggagttcgtattaaattaagagaaagagacccgaatgctcttcctgggtcttctaatggagtcttcctgaattagtcaccctttacacaccaaatttttactgttttacttttttatttttcttttgagacagccttgctctgtggcccaggctggaatgcagtggtacagttgcagctcactgcagccttgaactcctgggctcaagtgatcctcccaccttccataatagctgggcccacaggttcatgccaccatggctggctaaggttttggtgttttttttgttttgttttgttttt

SEQ ID NO: 126346 - DNA, 1542 bp, Homo sapiens
cagagaaaagaagaaagctggaattcccccttctctttctgagcatcagaagacccccttcctgctccgaagccagaaccaagggcttctcctggagcactgtgtccagggcagtgcccactttggattccgggctgacctgagtccaggcgggggattgtggaggagaagccgacacacttgttgctggtgggtggcaccttgagcactgccgctcgtgcccgcctgcctgctgctctgcgcttctctgcagcctcagagggctgcttcatgcctctgccgaggtcagagctgcaggcagagggagagacagggcctagtgtctgtccgtcctcccaggcctggagccgcccttgtcttgagacgcttacttctcagtcgatgagtctgatgcgcctgccagtggggaagcggtcacacggggggttcccgtgagcaggcctttgctgacaggagtttctgtttgacttttcaggagaccccaaccaaagagctggggccctgtggaggagaggcgtgcggcccggacctgagcggcccagccccagcctcaggctctccctacctgagcaggtgcatcaactccgaaagctccaccgacgaagaaggtatttcacgtcattgtctagttttaaaggaaactgaaaaattgagtaatgtaaaggttttttgagggtaacttcccatgttgctttaatgacgccccctgacatgggcacagaactgccatctgccagccgggccgggctgtgtcttccgacctgcagggcgcacctgcccagaggctccccctctccctcatcacgcagtgataaaaagggtggggttttattttttatttctaggtggtggctttgagtgggatgatgacttctccccagatccttttatgtcaaagacaacaagtaacctgctcagctccaagccttctctccaaacatccaagtacttttctccgccgccaccggcccggagcacggagcagagctggccgcactcggcgccttactcccggttctccatctctcccgccaacattgccagcttttccctcacacacctgaccgactcggacatcgagcagggcggtgagaggcgctgcgtgctggggattgggagtgcagggtcgggggtggggcgctgcagctgggagatggtggttttgcaggcctgataatctcatgtcttcttcacatttgctgagtagattacaaacttgtttttataaaactcccatcatcagctgggtgcagtgactcctgcctgtaatcccagctactcaggaggctgaggtgggaggatcagttgagcctgggagtgtgagaccagcctgggcaacatagtgagaccccatctctaaaaaaaataaaaactaaaaaattagctggatgtggtggtgtgcacctgcacttcagctactcaggaggctgaggtgggaggaatgcttgagcccaggagttcaaggctacagtgacctatgattgtgccactgccctccagcatgggtgacagagcaagaccctgcctctaaaataaataaat

SEQ ID NO: 126347 - DNA, 1275 bp, Homo sapiens
gctcccgagggcggggtggggtgaatgggcaggggccatttgaagtcgaggtatctgaacatagggagccttctttccccgtcactagattgaaagataaaggttaataggctcattttttgattggaagtttacagatcaaataataaatatggaatacaaagaggctttatttccctcggcgctaggcttcatttgtgccgattagataacacctgctatctgccagtctgtcggggcagatgtgtggatcccagctgacttcttctgcaccctgacccttagcgcccagcgggcatttgagcctagcagatgtgggagagtcaggcaggggctgcttccgaaggaaaggacaggaagggcggctcaggcggtgctgggctcaaaacacccgcttccgttcctgtggtgcagcgcacatgccatccacgccatgcctgtctgatcattttaaaaacccagctttgtcgtctcgcttcctctctcctcaacaggaagcagcgaagacggagaaaaggactaggtggctgccaacgcgcacgctcgggtccgaggctgctcccctggagcggcgcccctgcgccctcagcccgagcagcgacatccactcgccatttgctgacatgagattgggaggaagaatccagaggtgaagagggagacggctcttagctgcgttcaaggcggggccctcgggagcccaggtgcagagcgaggccgtgtccaggagccggcgtccctcagtgccccgtgcacccgcggccgcggcctcccaggcagtgctcatgcgctggccgtcgggggaggcaggggcacagcctccatgtgcgcgcgcgtgtggagctgtgtgcaccgcatgtgtgctttccacaggggcgtctctgcgtccacgcctgcacatcccggcgcacgtgtgggcaccacagaggacacgtgaggggaatggtcaccagtgagccatatttattatttctagagaaatcacgaactgctttctgtaattgcactgtggataaatgttccgagagtctccattgttgtacaggatcttcagttattcgaggggaatgaggcaggtcaagccgatgctagccactagtttgattttttttctgttttatagtttgcgctgcatggtacttgtgaagcttaaatattttgagtgttctactgtgtctaggattgttgggattgtacatatggtactctttcataaatgataaatgattctgaatgttagtgttttatgttcatataggaaatattttcattgag

SEQ ID NO: 126348 - DNA, 2804 bp, Homo sapiens
cacggaccctccgttctgcattaagccccaggttctcttctggctttgaaagggcccgagtgctcccagtgtagcttcgtcacatcgtcacgagcccctgtggtcatgggcgacctcacacctccctccctgagttctgctctgacataaggaagtcctcggtggctggtgcagcgcggctgtgctgtgctggggaggcagccgttccttcgggggtccttgggcctgcagtcccctcatactcacccttcacccaacatattttccggtgctgatatgtttccagactccagcgcaacctggggtgctctccagacccgtgcaggggccgcctggggtacacggaaggaagttgagtcctagtgcaaaatgcaggcggacgttgccagagagtgcgcagcaaatgaccttcattgccagttccaccctactcctctcattttttatactaagcaataactttccaaagcaagaagttcaggatggagagagtcccctcctgtgtaggcatggggtggatgcggtgcccacctgggctatgtggggagcaccactgtctcgggatgcgcgaattttttttttttttttaattaacagggcattagaagatgattttgccaaaattgtcatgactctgaattcttgctgtggggacttcctgagttttctcagtttttacatctaagattagtcttggctgaagagaaatgagacgtgattatactactttttcaattgcaggtttaaggagttcagatttaatgaccaaagtcatacagatcatggaatctgtcgtcgtcttatacagtgtcagcctcgagtacatttattaaccttttggggctgtcagttttccactaggattaagattttggccgggcgcggtggctcacgcctgcaatcccaacacattggggggtcgaggcggacggatcactttgagcccaggagttcaagaccagcctgggcaacatggcgaaacctcgtctctactaaaaatacaaaatatatatatatatatatatactagctggggcacatagtggtgtgcacctgtagtcccagctgcttgggaggctgaggtgggaggatggctagagcccaggagatgggtgttgcagtgagctgagaccatgccactgtactctagcctgggtaacagccagaccctgtctcaaaaaaaaaaacaatttttttcataacataattcccatttttatttattttgagtcactcataattaattgccaaaaaagcattttatacattgagttggggggtagtggatcttagtgtggtgttgcatggaggggcgagattttatatttataatcaacacgtgggttaacatgtttttttgaaatccaagcaatacacaggaaatttaagtagaataaaaattgcagcccatttttgaaatgtcagcatgtgctgtgttcagttcaggtttttgttgtttgttttgttattttttaactaataagttggttatcagtggtgggttttcaaaatgtacttgttctaataagttgtacaatgaactaaatcagtggcattctctagataatgtgggggaaggttagaatattttctggccttctatggggtagcaacccagaatcaatctgaattagtcctgttttggtggagtttgtacattttaaatcctataacaaaaataatctagttttcatttccttactagctagatgcgaatttgtctttttgaatgaccctgtcaataagccagaaagggcaacccagaaaaagtgctccccacatccttctgagacttggcctgtgtgtgtggacgagaagccattcaccgtaagggtgcagaaagctcgaccaagccgaattgcaaacaacgttcgttctatttttaaatgtacaggttcgatcgtttctatagaaatgggtttatctaagaaaagtcttggtttgtcttgctgctgtaaaaggcctttccaaacccctccttttattcctgtttcccgaaataaggtatttgtagagttaaggacctactgcatgcctgtccccagggccccggtggaaggaaggcagcgcctgctcttccttaactcagcccatcatctgaaaattcagaagtgaaccaagggttagacgccagaggttgggcttctgttagagtggcttcaaaacatgagccttatgggaagtagccttaaaaaaagaatgggtatacgcagtgacttccgatggaaatctccaaaacaatattcctaagtagcaatggggttggctcaagtctttattaacaaagaacattctctttcatctataaagaaattcttaaagatgcattgacagtgttgaattaccaacagcctgtgaagatcagtttgaccggtgtggacacgtgctggttaagcactcaggcctacgtgggccgagcgggatcttgatcatggggctggtgtatggatccaccgtcggattccgtctgcagaggaggacgtagggggccgtcacacccaccaggcctccctgctgtgctttaacacaggcagaagaggttcatggcaatataatagtcaatgaactttcagtttaaattgtgtacatttttaaattgtaagatttttactgtatattgatgcatagtgtgattcaataaattgcttgtaatttaaaaactatttaatattcaaaataaatatagttatatatttataaactctgttggccgcgtttcttctgtgttttgtccaccgtgcaagggccacctgggtgggtggcctggccctgccctgctgtgagcgcccgcagcctgtgttcca

SEQ ID NO: 126349 - DNA, 1042 bp, Homo sapiens
aggggtttccacctgccctctcccatccttccaggttttggcggcagatgggaggccacctgcggatggtggaggccaacagccggggcgtggtgtggggcatcggctatgaccacacggcctgggtatacacaggcggctatggaggcggctgcttccaaggtgagggcggcccacagcccccccggagccttcctgggcgttctttcctctagtccccgtctgggttccctgcccaaggccagggccattgtcccagtgttcacactcggctaacagctggctgacaggtgaccttcaccactgccagcctccacccaggatggtccctgccagtacccacttcgagctgagggcctcgaaggttccagagaggcagcggccagggtccaccagcatgtccagcctctcattttcagggtgttaggtgggttcctccttcagggtaggcactcgctgaacttctgtggccccccgatttctaggagccagggtccctctgttcctactggaaaacgaaggcggaaacagacactgaaacggggcgttccaggccgcagcccacatgccccacgggggagcagctaaccccagagaactgtggtcccctgataccccaggaacgcatatctgagcaggctttccagcttccctgtgtgtgaggcaggaatgacctctgtcttcattttacaagtgaggaagccggggctcacggaggttacgttgatggtcccaggtgcctttgtaacacagagtgagctgggtgggcctcatgcctccctggtgctaagtaggagggcaaggtgggaagaggcgctggaggggtgtggatgggagatttaatgcacagcaggctgtgctcatcgaggttgcacaatcccagaataatcacggtcccggaggagaaaacccaagccaggccgacccccgtgcgataagctcaacaggactgtttgctcctctccgctgacctggctccagcccgccctccccgtctctctgggaatctgtgcttcagacggaaagccagagtcccaagcgg

SEQ ID NO: 126350 - DNA, 1009 bp, Homo sapiens
gggtggaaaagaccgggggcttttttagcggggtggaggttgaggggacaggatgagtagtccccgtggcggtccgatttctcctccctgcaccctaatgacctgctttcccgcccacagggatacccacccaccatcccagggtctacaacatccacagccggaccgtcacccgctatcctgccaactctatcgtggtcgtaggaggctgtcctgtctgcaggtgagtgggtctgcagcctggggactggccctggaagctctgaggacccccgccctaacccccaggacctcacagctctgcttgtgggagtgggtccggcttgacttggatcttgaccagagccctttatgggagggacagacaggctgcccgaatgcggtgtgggagagtgcgggtccgctcacccttggctctgaacacattttgtgggggcaaaagggtggattccttttcctagatcttggggcattgcaccccaagtgattgggatgtagaaatggtaacaacgggactcgtggtcctttcgtctttgttctgggacttgcaaggaatcaggtgtctgctttttccttcactttccgcaagtttactctgcagttgatcgtcgaaggtggtggaaggtttcattttcccggaaggggcatttggaagtaagtgcaccagcaggacagacctcagtgggagaagcgacggccgtaagagctgctttatccaaagttggcttgaaacgctcttccacgagctggaccaggatggaaaccccgtgtttctttgaggcaggagttatttttttcatatcctcgcattggacctgcacacgctttttggtttttatagggccccgaggtgcagctagaggcttgttttgtggaggttttgaggattcacatttaaataaggattaattaaatataaacccttggcagctgggggtgttcagattgcttagaaagtaggggcagagttggccgggacagggttttcagctgtgtctcggaggaggaa

SEQ ID NO: 126351 - DNA, 1008 bp, Homo sapiens
gcggatgtcgctcagaggtccagggtgcggctcagtggccagcgtggaggctgccacggcccttggggggcagaggtgggctgtggagggcacggggtggtgactgtggagcccgggaggggctggaggggaaggagcctgtgacagccttgggcttccagacgatggaggtggaggggctgctccctcctaccacctgtgacctggaagccagagctcccctggttgaggaagtggctgagttagctgggatggctctgcccatatgtatggcctgtgggctgtccccgtcctgacagtcttggcctgaggtgtgggggcagcggatgggccggagcttgggcctgggctgcttgctgggcagggctgcagacctcggtgcccaagtgctccctcagtggcctcctgagtctctgaccttgggctcagcccccagctgtgggccaagtggcactgctggggtgggtgtggtggcaggcagagtctccgggcaccttctcaggcctttcttccacaggggaggcgagggctggccctggccattgggtttgctgggaatggccctgggaggtcctggtgaactgtccctaagccaggcagctcccctgtggggagtggacaccctgggacagccagagcctggctggagctgctttggggccacctcgccctgcgctgagcatggcttcaggccctcagccctctgaggaagccctgcgtctccccttttcctggcgaggcctggccttccagcggggtggtggtctggggttgttcctgggcgtggatggtgccttgaggccaccatgtgcgcagagggcagcttggtgccctagggccagccccctgtgacactgcctttgggggctacctgggagggagaactgggacctgcaggatgggtgctcgtgactggggagcccatctgggttcagatcccagccacgcctttcccggctgggagtccctggacacaccctcagcttcagcctcctgtaaagtgcctgt

SEQ ID NO: 126352 - DNA, 1050 bp, Homo sapiens
ttcataatttatattgcttaaaattatgatttgcatgctaagatgcaaacttacgtgatatcttctttagacataatgctattaagagcacatgctttataaaataaaactggtctcattcatatcaggtgcagaaagccagtcctgaaagcatagactatcccttattctggctgttattaaggaaaaaattcatttaaaaaatacagtaaagattgaaaccaagtttactgtttcttgaacagaataggaagaaaatattttaaatggctgagctggtcattagactattactcatttatcttaaaggcagaaacttgtcaacccaactacgtgaaacagagaagcatgatttgcttaagcaggcgacattagagttaggcctctccactgaagcttcccgaccgtcagcacgtggcagacaggatgcgcccatcattccgcaagggagaaccggagaggcccgggagagtccttggctgtcctctcatcgaatgatgggtgccgagcgatcattcgtcacagtcgggcggagtttcacagtggcaaaggggttttctccgctgcaggggataagaaaaatctttcagaacttctgctctacgagggaaactggattttaacagtgctaataacccgttcttgccctgtgagactgggcggctgaccacctccccagcttgtacaggtcccagcagcgttttctgagtgtgaaagttttgttcagtgatgattcctacaccataccacctgctgcagaacgatcccaggttttaagcgttctggacgtgggcacccacacctctttagtcctgcattgtgtgtgacatgggggtcactctggggtggggaagccctgctcccagcgtggtctaaagtagttggtaaagcgagcagggggctgcactcccccatggctccacaggccgaggcctttctcaggctggaccccctgggctgggcaccgaaggcccttccgggggacactacagggaagagcaatgtcacacactgaggctcacgtaggaagccacgcctacctgagaaaag

SEQ ID NO: 126353 - DNA, 1063 bp, Homo sapiens
gatcgtgggggccgggaacgtcctgctgggtatacggagtcacatcatgaaaattcattgtgtgcttttctgtctgtggtattctgtaatacaatgtttactttaaaatatgtattgggccagggacagtggctcatgcctgtaatcccagcactttgggaggctgaggtgggcgcatcacctgaggtcgggagttcgagaccagcctgaccaacatggagaaaccccgtctctactaaaaatacaaaattagctgggtgtggtggcgcacgccggtaatcccagctactcaggaggctgaggcaggagaatcgcttgaacagggaggcagaggttgtggtgagctgagattgcaccactgcactccagcctgggcaacagagtgagactccatctgtaaaaaacaaaaaaacaaaaaaccaacaaaacaaaaacagaaacaacaaaaacatattggacgtgttcaggcagatttcccgtttaacatctgcatgtttctcagggacctgaaaccccagcactccttctggatacaaggctggcaggagcctctctgcctccctctccactgcaaaggagacccacgagggcaggggcttggcacatacggtgcctcttatctggtggcccccaagggtctcacagcatcctccctgcgtccctgtctcaaccgcatacctcacactcagcccactgtggtggtcactgaacatagacctgccctcctctctgttccctttccttgcagtgggggacacctccaagccacaggcagcactgccaccggcacccagggccccgcgggcactgcctgctgcatgtcctgtgtccccaacaagacaggagaccactaaggccacgaaaccagcagccactacgagagtggttgggctgcaactggagactatagagcgaggccaccaagcggctgactgcggccagggtggacacatcttgtgatcccccatctcccgcaagaatccaagaatccaaaatgtgtgtgtggacactggctgaccacccatcactcgatgcctggtccacacccccttcccgactgtac

SEQ ID NO: 126354 - DNA, 1091 bp, Homo sapiens
tgctgtgagaattaagtgaaaaaatcaatgcaaagtcctttggacagtctctaggcaataactactgttagtatctgatctggaatacggatttgggggttttcggcatggaggtgctcagcaaagcccatcagtgtatttcaagccatgggagtggatgagatggcccagcacaggcaggaaggatggacccagggtgactcccaagaacactgatgtttaattgatgggcagaagaggggtgcaaagagctggtgaggcagaagacaaacagagcacaggtcaagcagccggggccagagaacattccagaaaaagcatacaacagcgttaagggctgtaagataagaacggtaagataagtgtaagataaggacggaaaacacatggcttgggtttagcgaccaggaggggcagggcacagggagggagtttcagagggctgcaggactgcgaggagtaggtggcctgggctgggtctcctcacagcagcaaagctcggggacaacagaaatcacggcagacagcactgtgagccgcggtctcatctctgactagtccacgagagctgaggcttagggcagggcctgcgacacagctagatggtggtgtgttacagaaacgacaaggcaggggtttctgtcaccgggagagctcagccacgttcagggctaccttggcgtgggcacggtcactgcttctgtctcattttcttccagcaacttcgtgtacgacgacgggaaccaacccctcctaccggcaaagagggagaaaagaccctatcagcagtagacatgtggacggcaacctccctgaacaacctggtgagagctcagggcagacaggtccactgctccagaaacgcccatgtgtggaggaaatgaaattaaggcttttaataggtaaatatggactttcacatacactgaacaatgtgtattgttaacaatttttttttaatagagacagggtctcgctctgttgcccaggctggagtgcagtggtgcgatcatagctcacagcagcctcgaactcatgggctcaagcaatccccctgcctcagcatccgagtagctgtgactagaagtgtg

SEQ ID NO: 126355 - DNA, 1049 bp, Homo sapiens
acatggcaaaaccctgtctctactaataatacaaaaattagccaggcatggtggtgcgccccagtaatcccagctactgaggaggctgaggcaggagaatcacttgaacccgggaggtggaggttgcagtgagccgagatcactccactgtactccagcctgggcgacagagcaagaaagactccaccttaacaacaacaaaaaacaaacatgtgcccagctaccttcgcccctaaaggtaaggggatagaggtgcgaaaaggtggtcctggaagtaataaagggggacctgtgattcccaccaacacaggcaaatttggcccagatcaagttaggaaacacacgattgaaatctggaagagaaaactggctcctaccacattgcttctctcgatcatgggtgaagcctgaggagttccagacacgggggtagaggctggggtctttatttcttcgatcatattcatgattttctctggcactttgatggcatcaacacaggtctcctgccaccgaggcagcttggaattcagtagttctgcagactgcaaagccaaaagaagaagactaaagacaaagaagattgtctgaagagctgagaaaaatgacatcacgtcatatcgctgataacagattactggcttagcaccaggagtgtgggggccctgggttaaactcggtgagcactttaagcacctagaggatcagctgtgtctcaccggctgagaggggcaaaggctctgactcaaaaggaaatttcctgatccctcagtgtgaatacagagcatgggactaatacggggatggtaaatggttaagagcaagaacagaaactcaaagggagggagggagcaatctgtatgaatcccgttttccaggtggccccagaaacgccaaccatcactttctccctcccactcctactaaaagcagcacctccaacacaggccacgggccccgtagttgactctgaccgattcagacattagagaagtgaatcagacactgtcctgagagtctgtctatggggaagagggactgggtgagtg

SEQ ID NO: 126356 - DNA, 1033 bp, Homo sapiens
agatgagcaggggaaatgcaccagagtccatggttacaagatatccaaaggcttaaaaaaaaaaacaaaacagcagaaggctgggcacagtggctcatgcctgtaatcccagcactttgggaggctgaggcgggcagatcacgaggtcaagagattgagaccagcctggcaaacatggtgaaacaataccgctcctactaaaaatacaaaaattagctgggcgtggtggtgtgcacctgtagtcgcagctactcaggaggctgaggcaggagaattgcttgaagccgggacacagaggttgcagtgagtcaagatcgcgccactgcactccagcctgggcgacagagcgagacttcgtctcaagaacaaaaacaaaaataaaaaaacaaaaccagcagaaaaaacctacagctaccctaaggccccctaccccacagcccctatttcttcctctgtgcttagatctccccttcccaaatagaaacagactggaaaggatggctgtggtcttctgggggaaaaaagtgggagggccctggaaaaacagcaattatgaagtttttgtttgtttttttttgagatggagtctcactctgttgcccaggctggactgtagtggagcgatcttggctcactgcaaactctgcctcccgggttcaagtgattctcctgtatcagcctctcaagtagctggaattacaggcatgcgccaccatgcctggctaattttttggtattttttttagtacagacaggtttcaccatgttggccaggctaggctcgaactcctgacctcgggtgatccgcccgccttggccttccaaagtgctgggattacaggcctgagccactgtacccggccacaattatgaagtctgaagtatatgcatgctggtaaaaccacacaccagcccacgagggagaaaaacatcactccactcagacacacaaaaaacgcggaagcaccatgtacacccagagcaccgctaacatttctatcagtcctgccctttcactgaaagttgttgaaaa

SEQ ID NO: 126357 - DNA, 1061 bp, Homo sapiens
gaagagtcatggacaattcatagaaaaaaaaaaagaccaaagatagattgtatttttctcatcttccaagaagattttattgtctagttactccgttttggtatttggtattcacaacttcatcatgaaactttataactctcatatgagaaaactcgaaggggtgttatcacatacatgaaaatcatgaatcatttcaaaacgttcattctgtgcgcctcgagggtcggcctctgtgacagcggtgccatttctgatgtctagcagtggatacttacacttagctctctcctggcatcggctcactcactgctgtgtgaataatgtaggatgcttttgcctaaaagtaaaaaataaaatacccaatgaacagtgagttaagcaatcagcatctttattattccacatgaggagcagcaggttgtcagtttatcatcactagggacccaggttccttctctctgtcttctcatcctcatactcatttcctcatggtgccaggatggctgccactgcctctccaaccatcacatcctctctctccccattgtctccaaaggcaggaaggggaatttcttctcaggtgtgctgacaacctttgccccaaagctccagcacacagccccttataccccacggcccaatttagatcacactcccaggacccagctgctagcaaagctccccaggcatgagccaaggaacaccaggtcagagaggatgtggctgttaggagatggcctggtgacagcccccacgtcggcatctctggtattaaaggtctgttttcaacaactttcagtgaaagggcaggactgatagaaatgttagcggtgctctgggtgtacatggtgcttccgcgttttttgtgtgtctgagtggagtgatgtttttctccctcgtgggctggtgtgtggttttaccagcatgcatatacttcagacttcataattgtggccgggtacagtggctcaggcctgtaatcccagcactttggaaggccaaggcgggcggatcacccgaggtcaggagttcgagcctagcctggccaacatggtgaa

SEQ ID NO: 126358 - DNA, 1043 bp, Homo sapiens
tctagcctggcaacagagcgagagactgtctcaaaacaaaaaaacttgtgtttattcatatggtactttggaggctaaaaagtccctaaacaatatcaattaagcactagttaactctagggcaggagtttttggttttgttttttgtttttttttgagacagagtcttgctctgtcacccaggctgtagtgcagtggcgcaatcttggctcactgcaagctctgcctcccaggttcacgccattctcctgcctcagcctcctgagtagctgggactgcaggcacccaccaccatgcctggctaattttgtttttgtatttttaatagagacggggtttcaccgtgttagccaagatggtctcgatctcctgaccttgtgatccgcccgcctcggcctcccaaagtgctgggattacaggcgtgagccactgcacccggccatatttatattttttaatgtaaattgcttacttttataatatttaatgtaaagcagataaatatatatattccgttttaatggacataatgtttttaaaactaagctaaaattcgccatctcctacctctgtttgcaaattacccatttaaagataaacctaattttaaatcttatgatttctgtcttgatttttacgtatgggaatacatgtttaacatttactaacccgagaccgggcgcagtggctcatgcctgtaatcccagcactttgggaggccgaggtgggcagatcacgaggtcaggagatagagaccatcctggctaacatggtgaaaccccatttctactaaaaatacacaaaattagccgggtgcggtggcgggtgcctgtagtcccagctactcgggaggctgaagcaggagaatggtgtgaacccgggaggcggagcttgcagtgagccaagatcccgccactgcactccagcctgggcgacagtgcgagactacctctcaaaaaaaaaaaaaaatttactaacccaagactacacgtgcaacaggcaactagctgaacaaaattgaaaatactcaaattccagttctt

SEQ ID NO: 126359 - DNA, 1038 bp, Homo sapiens
ttttataaccacccactctagtgataattgacccactcctaagatgattgcaatagtccattcatgagggctccctcctcatgacccagttaatccatacttggtcccacctcccaaaactgttgctttgggggttaagtttttaacacattaactttttaaattttaactttaagttctgatatacatgtgccagatgtgcaggtttgttacataggtaaacgtaatacaggaattttgagggacacaaaccgtagcagaaactatctatactgagttccagattataataaaccaaccgcatgttggacatctcaaagataaactacccatacttctaactcaatatgtcaggtaaatttattgttctctttattttccctctattcttcctcctgtttcctatttcttatgtcattaatgctttccaagtcattcaaattcaaaactttggagacatctgtatctcctccacccccaattttattcaaattctagtgcatttctaagtcctaattctgcttgtacaatatgccaactctattctcactgctacaatctcattacttctgttctaaactatacagttgcctctaactgaacgattcagctctacaatgtccatttcagcttgtacattctattgccaggtcagttttcctgaagtacagcactaaagcattgatctgcactgctcagaaaccttcattatttctctatgcaaatgtgtaaactctttagtctccatcatttttccccacacccacctattcattccaatttttactatatcccttgatctaccctcactccaaagtaaacttatgcttttcacaaatgacccatatttttcatcctctggcattgggactcaggttgtttcccatatctggagacagatctggaatgatctttcttgcatgtctaggaccacaagacccactctcatccttcacggctctgcttacacactaccccctccacaaagcttaccctgattttgctcagtttgaaatgacacaataacgttctttattt

SEQ ID NO: 126360 - DNA, 1070 bp, Homo sapiens
acacgaaagctcatactgggtttactcacagcacaacaactttgtctacctgaaagatcctgcatgtatgactcatgctacccatgaggatggttatgtgagtggcagagaccagggcccacagattttcctccacttgaaaagtcgtgcagatctgcagcagtgaatcagctccacctaatctcttagtgtaactgatgctgcagcatagtaaccacccactcattcactatgtcggctggtcccaggtcagctgtgagcccagtatggacttaaaccgtgtgctgggaatcctgatgagctcattccgcctccattttattgccccatctgtttggttctcttgttcttctcacatgcatttttatcttggtcttctgggaaatgtgctaatttccaccatggtgtgagaggatcccatctcatactttcttacatttccttctctctttctcagtgccacttgggaagtcaagaatgagagtgtgagctctaacagaatccaaggacagcttcctgcaaacatgattcgggaactgtcctcggtgctgaatttcaattggaagggggaaatagacgtgtgtgtgtgtgtgtgtgtgtgtgtgtgtgtaaagttcagtgcagataaaatagaatttggaagctccagaggatccctactaacacacatttatgcttaaaatgctaagacgctttcaagagtggatttttttccccactagattgaactgcatggtagtgtggaaagagcttgagctttggagtcagacagctttagtttcagtcccagttttatgacttgccactttaccttgagagaatgatttaacctctcccagcctcagttttctcatctctaaaatcaaagctaaatttactacaaaatattgttaggcttgagtgagataatgtaagtgaacatgtttggcatatagccagtgcacaatagatgataattgtccttttcttccccttttctccactgaatttagacctgtattatgtaagtccctttaaaaacaaagttgaaaaaaattcttccctttctgcaatattctttagagttaaat

SEQ ID NO: 126361 - DNA, 1037 bp, Homo sapiens
gagctgagttttggtctctacccaacatagaattctaggcgttggttagaatattgactttttagtaagaggagaaaaacggctttttgagaagggaaaattagattcacaagtttcaaatattgcagcaaagtaattcttatctgactttgaaatcttttccataccaaaaaagcatcagtgagatgctcccctgcctgccagtggcaagattcagggcttgcgttttggaagcttctccctgtgtggtcgggccatcacagccacatttcacaatttctttttaactctttctgtgcccctccctcctccccggtggctgaaagcaccagctcagagcaaacgtgtccaatgctgggctgcccggcgacttccgcgaggtgctccagcagcggctgggggagctggagaggcagcttctgcgcaaggtggcagagctggaggacgagaagtccctgctgcacaatgagacctcggctcaccggcagaagaccgagagcaccctgaacgcgctgctgcagagggtcaccgagctggagcgaggtgtgtgcctggcctgtttctctgtctggcagtggcctgattttcaccacttgtggtcagacatgcgattctggttgatggacagcagggattgtgacaccacatgggcctggttcccgagtgtgtgagcaaataataaaggcgactgaacaaggtcatctcaggaatgagctgccagccccactggcattatccagggaaaagtgaaagtgtccaggaccagcttcgataagcaaccacacgggcgtttcagtcctttgttaactagtcctggcagcggattctgtgtatctttctcttctctgctcacactgtggtgagtaagtttctcccacaggagacagagtgggagggatcaggggataattcagattgcgtcatcaacccccaaaccactgggtggcttgggtttgaagttgtaggtttgcccgtagtgggtgtttataagactggaattttcccagatgcactaagctgatgaagccacttcccca

SEQ ID NO: 126362 - DNA, 1027 bp, Homo sapiens
aagagagtattaactagaaggaaccagacagagcctctgtcacccaggtgggagtgcagtgatgcaatcatagctcactgcagcctggacctcctaggctcaagcgatccacctcagcctcctgagtaggtggaaccacaggtgtgtgccaccctacccagctaatttttatattttttgtagagatgaagtcttgctgtattgcccaggctgttcttgaactcctgggctcaagcagtcttcccacctcagcctcccaaagcactgggattacaggcatgagccactgcacttggctaattttttaaattttttgtagagacagggtcttgctatgttgcacaggctggtctcgaactcttggcctcaagcaatcctcctgcctcggcctcccaaaatgctggtattataggtgtgagccactgcacccatccaagagctttttttcttctagatttcaagaggcctcttttcctgtcctaaaagatggagctaaattctctaacgtgccccatgcagtgcccacaaaatcttccttttctttccttttctgggcgtccttggggccctgtacttgctgtcacctgtgtctggggttctcttctgcaggtctttccaggccttccctgcatcctctgccttccctcccccggccactccccgtcttagcaggagccactgcctggacttccctcgcgtacctgctgctggtttcatgtcaccttccctgcctgaatgtaagctccctaaggacaaggactccatcttgtgtcctgaatcctgccagacttcagccttttatcagtggctggtgtggagcggtctttggtcgcttgctggagggtccatcaaggctgtgtgagggaccttcttgtgggtctagcaagatgtggctctgggccgtgctggtgggtggtggggtggcctaacgcactcctggcctctcttcctcccaacccccaggcaatagcgcctttaagtcaccagatgcgttcaaggtgtccctcccactccgcacaaactacct

SEQ ID NO: 126363 - DNA, 3076 bp, Homo sapiens
ggagaacctggccccctggcaccccatcaagcccgggggcgtgctgatccttggacaagagcaggtgggtgcagggcaggtgcaggtgggcacagggtgggtgcaggatgggcacagggtggccgtgcgccctttcagggatggtgcgaggaggggccaactgagcagcacgaggccaggcctgcagctgttcctgctcccggccccagctgttggcccctcagacctggccacagtgtcctgacagccaggtcgggggagtgagaacccccgcagcctggcccttgctgtcctgtggttagaggttgggcgtggggtcacggcctgcatggcagggaccaggtgggtgtgtggttcaaacagattccaaatagaacctggcacagaggggtgtgagtgtccctgtggtcatgggtcatctcgtgacacaggctccagcttccatctgggaggaggctgtgtgagggaccctcctgggatgctcatggtaccaactcaggattgtggggctggtgtcttccaggagccccctgctcagggtcttaaccctgatacccagcaaggggcacttaggtaatccatagtgggtgctcagcctgtgggggagacagggatgaaagggtggcacctcaaagtgccctcaagaaacttaccatctaggggagggaatggctaagttggctgtctggtctaggacagataagtgttggcattccagtctgtatttgggtttttgatgatggacagtggggcgtagactccaggtgcactggggggctttgagtctggttccttcttggcccactcctccctcaatttcccctgctacatctccgctgggaggggctgggagtcatgagacctggctctgatcctggctttgggactttgagcagtgtcttcccttaccagcctcagtttcccctgtataaaatggggagatttgagcgatgccacctcccagttctgacatgcctgggagcttcagaacctacagaaacaggtagtgttggtcagagctggggggcatcagagaaatgcccaaatctcctgtctgcagcccgtgtgcagggggacttgtgaaccagccctgacgcagctctcttgttcccattccccaggacaccgtggggggtaggtttgatgccactcaggcatttgtcggggagctcagccagttcaacatatgggaccgcgtccttcgcgcacaagaaattgtcaacatcgccaactgctccacaaacatgccgggcaacatcatcccgtgggtggacaataacgtcgatgtgttcggaggggcctccaagtggcccgtggagacgtgtgaggagcgtctccttgacttgtagccgccttctcctctgtccaggaggccgggatcaggctgttgccatggaagttcagggccatagactgccccacttaaactcttgtcagtctgggctcagggttcccagagctcattccccaggaatctctaagaccagggctggggcagtgtctgtcactggcttgtttgttccctaccaatattctgttgctgtttgaagtagtgccagggtcccctgggaagatgcccccaagacacctgccccaagtgggtggatatctgccttcctgctgcaagtggaggcaggtccagcagcccctcttcagagcccctgtaaatgctatcgcagcctgagtcctgccgccttccagttccttggtgtcccgtgcaccccttctgtctgtcccctttcatggctgtgcagccgtcccgctggagtggccatgtcccttgtgcattgagtgcatccccgctggtgactaagctcgcagcaagcggctaccccccgatctgcaaaagggcctctccctttgtgttctatacattgtgaatcttcccgtctgaagaacgcccagcctgcccagacaaagccccgccttccccaaagcagaggggctgtctgtgtctccagaaaggggacatcgggggggaggggggctcagaaaggagaagggctgtgatctccggtcccttcccccatcatccttccttagactgatgctttgactgaatcatcactagctatggcattaaaaggcctctcttctcatctggtgccaaaggttccgttgcagctttttacaaccatccggtgtggtttggaggatttgttttttttttttcccaacagaaaagaacagccattagaagaaggctcccattttctgatgttccgccccactgtgaagagtgtgctcgttttaaattcatgttgattcttgtaagcactggactgtcttcatcaagtatttccctacagaactcctcaagaaaacagagatcatttggctagagattgtctgagtgactccaagctactcactgtattggacgggagtagtaatttattttaaagataaagtgactaagtggggaaatttataaagctaaatattatatattttatttttcatacatgtttgaagtgcaaatctgtggatattccatttgtaggaccaagtcgacatgcccatcctgacattgtatgctacgagaactcttctgatgatggaatttcgattaaagtgcactgaaagatgcttctgtgtttgtcttcctcatgttctggggctgaaggtgggaaggggtagggctttgcaacttctggcagaaggatgatgtctctggtttgccgcagcctgcttctggtgggtttgggggcgctgaggatggttagaggagggtgtggtccagctgtccatccttcctatttcaatgcctggctcaggctgtgggtgcctggcaggctctgcccaggctccttgtccccagctcacccctgtcttctcaaccaggagagccagcttagctagaagacctgcggccgccttccaggtgtggtacctgcttagcgtctactctgtgtaggtgttctttagacatctcattgaatcctccctgaatgagctaatcccattttacaggtgaatacacaacaattaaagctattttgggatcatgcagccgatagaggatagagctgggctcaaagccgtcctgtggctctgagggctctgtcccttccac

SEQ ID NO: 126364 - DNA, 1103 bp, Homo sapiens
tggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagaggcttcgtgcaggactttgatgcttggggtgttccgtgttgactcccaggtgggcctggctgcccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcac

SEQ ID NO: 126365 - DNA, 1092 bp, Homo sapiens
gagagagagagagaggaagaaaggaagaaagaaagaaggaagaagaaagaaaaggaaggaaggaagggagaaaaaaagaaagaagagaaagaaagaaaaaagagaggagggagggagagaggaaggaaggaaggagagagaaaagaaaagagaaaggaaggaaaggaaagaaaaagaaaggaaggaagaaaagaaagagaagcagggaaggaggaaggaaggagggaaggaggaaggagggaaggaagaaggagggagggagggagggaaggaaggaaggggaaataagactgaaaagactgtgatttggagtcagtgggacccaggtttgatgtcgaattggctgagtgacccttgggcaagtcacttgagctgcctgagcctcagtttctccacctgggaaatagaatagttgatgccagcccagaggtggctgtggggctccttgccacacaccattctgaaacacagtctttgtttctgggctcctaggcctgtatgaactcaatctcaccaccgatagccctgccaccacgggagcggtggtgaccatctcggccagcctggtggccaaggacaacggcagcctggccctgcccgctgacgcccacctctaccgcttccactggatccacaccccgctggtgcttactggcaagatggagaagggtctcagctccaccatccgtgtggtcggccacgtgcccggggaattcccggtctctgtctgggtcactgccgctgactgctggatgtgccagcctgtggccaggggctttgtggtcctccccatcacaggtgagggtcgctcccatttgctagtttgccttcaaacccttggtgcagagaaaaacatcaagcttcgctaggaatcagatcaatgcagattaggcccgtaggttctgggggattaggcccgtaggttccttccccgggtcagtcgagttagaaaggatctgaaaatggcagtgattgcccccaggaggtattgtgctaaaagggacgcctattgctgctgagggtatacattaatacaaccctgtggagagcgactggtcaataggtactgttggttagaaattattgtagtct

SEQ ID NO: 126366 - DNA, 1769 bp, Homo sapiens
tggggaaaagaggaaggatatttcatggtaaatgagagttatatgaaattcagatttcagtgtccataaataaagttttattggaacacagcctcatttatttacatgttgtctgtctgtgactgctttctggttatagcagcgctgagtagttgtgacagactgcgtggccacaaagattaaaatatctactatgtggctctttacagaaaatgtttgccaacccctgactcagagaaagagaaaataccgtaggaaggaacagtatctgcatacaaaaatcatgtttcaaaattaatagacaaaattggagttgggtaaacttcatattaaaaaaaccagaaggaatagtgttagattctggattaagatgaaagcgtatcgattatgtaggcctttaggtaagattttcacagagattgtgatcctgtgccctccataaattgactaactctatgcttcttttcataggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacgtgagttgatcctttttatcattaagaaatgcataaataaggccggatgcggtggctcacgtctgtaatcccagcactttgggaggccgaggcgggtggatcacctgatgtcaggagtttgggactagcctggccaacatggtgaaaccacgtctctactaaaatacaaaaattagccaggtgtggtggctcacgcctgtagtcccagctacttgggaggctgaggcaggaggatcgcttgaacccaggaggcagaggttgcagtgagctgagatcgcaccactgcactccagcctgggtgacagagcgagactccctctcaaaaaaaaaaaaaaaagagaaatgcataaatatgacacatttatctcagctcagatgttgtgtactttgagattaatcgtaacagtaacttttattctcattttccttttctctaccttgtagagaagcaaagtgatgagtaatactggctggagccccaaagaggcacgtgtgtgtgtttgtgtgtgtgtgtatatgcttgtcagtgcatgcacgtgtatgtctgggagtacaaatgggtgcgactggttgtagggaactagctatgtgccttctattaggccatgacagtcaaactgataagatctgattgcttctcttaaattactaaatccaagttttgcattaacataatttccttaacataatttcaattacctgatgcttgttttgccgttcacagctgatgaaacaaagttgaaaatgatgcaagaagttagtgaaaattttgaggtatgagcattatattttctatttttcattttgaggtaaatattcttattcactttcctgtcctgctttgtcagtctttttactagcaactcaaagatcattgtctttgttcaagtaatttagtatatttcgaaactgaaatctgaaactttgtacacagcgttttccatcttcacgctggtgatagcgaaccccataccatgttgaggattgtcagttttgttttggttggtttaaaaacattttttcattttaaaatatggtagctcttttaggctaccatgcctgttgggatgcactcagatttattcttgtacttttctttctttcttttctttcttttttttttttttttgagatgga

SEQ ID NO: 126367 - DNA, 1050 bp, Homo sapiens
tacagtgcccagcccttcctattctacttttaaaatcagtactaggatcaataatggattagattagattataatataattagtatacatctaattagcacataatgaatatacatctaactaatacattggtttgctcaggctctttgttttccagatcaagaaactgagacctagaagctaaataacttcatagaggtttcatacttagatcgtggcagagacaagctagtacaggttccaggttcagcatttcccaaaggattggtatttctaattttaataggaaaagttagcatttagttttcctgaattggatttcagaaatacaatcatcctaatttaaaattatgttattactaaataatacaagtagcacaaatttgcttttggctaaaatgttttatattcctttgcagttattataatgtgtaaatttgaaatgaaaatacatacacataactgaatggggtcttttatttttgcacaattagaatgtcacgtcatctcctcagtattctacattcctagaacatatcatccctcgattccttacatttctccaagatggagaagttcagtttcttcaggagaaaccagcacaggtaatgtaaaaaaataacatgagaagacaagggtgctgtgggattgtgaccagttacgaattaactcagaaaacttacggttccacttaaaaacgaaagaggttttgtcacataaggataactttgttcaagaccgctgcctcctcagttacatgtcttggtttgatttttgtctaggacgtcccttttacaatttaaattattcacatttgccaactgatgacatgtgtgtacactgtttactatagaccagtgcaaatgtatacagaagaaggaatgactaccccccatacctattgcctagctccaatcttactgtcttattaatgtcagttcttttttttttttttttttttttttaaaagacaaggtctcactctgtcacccagtctggagtgcagtggtgccaatcgtagctcactgcagccttgacttcttgggatca

SEQ ID NO: 126368 - DNA, 1076 bp, Homo sapiens
ttgttccctctttgatgtctatttagagagtgaaaaattaatcagtggggactgccagctcgtagtttcttcccagaagggatggagtgctttctttcctgcctcactgtggtaggaatgtaatagggtttgtatttaatcatttattagccagggcaaaaagagtagaaaatacttttaggcaagctttgtcttctgttgttgaagatggagaacatggtccctgtcgtgttatctttatggtcctgtgggaagagtaaacgtctagtgtgtgttggtttaggctttaaggggcattggaaaatgaatggctgagcctaaatactgtggagttggtgcagcataaaaatgtagaacatactgtttttttccaccaaagagtcaagcgtctttttgttttgttttgttttgttttgtttttgaatgaatattgggtttgactttaggaaaaaatatttttatgacttttatgtagaaccgctactttgagaaccctcaagtgatccccgagaacacagtgcctcccccagaaatggttggtatgataacaacgattgctgtgaaagtcaacccggagcgtgaggacagtgagactcgaacagtaagtgtttcgctgagttatttctacccgtggctcctgtagtttcggatactggcctgttaaaccatttttttttctcttaaatacttggaggcatttaagacaaacgtgtgtgcctggcaaagcatcactggtccttctctgcagcctgggaggggtgaaagtgaccttttgggtgtcattgatgccaggctagaaagataaggttgttgttgaaacccagaatcaccctgctgggaagagcagcagaccaggtgtggggtgtctgttctgtcccttagctttgagtcttttgacattaataaagtcccttaaactatagataaaagcatatagctcagtgactgagagtgtgggctctaggacagagagctccagtacaatgtcctggccccactggggttttctgactccaagaaagttaatgaacctgcgttctgaccttatttttcctctcattatctgaaaaacctgt

SEQ ID NO: 126369 - DNA, 1337 bp, Homo sapiens
cgaggtgaggcgtcactgtagccggctgccacagtgcctggattccaagtaaaaatacacttgctgttgtcattcttaagacatgaaaattatgagtgataaaattttggtaaaattatatgcactgttgactttctgcacctgtgtttcagggatgacagttgtagctattttcgttcttaatttggaaagatgagataatagctcgtattctggtgcgttgtaaattaaaaatgtcgtcaggcattaccgtgctcaatgacagctatggcatgtccaagccttgctcaccttcaagactttgttcttgctgattgttcagcttgagtgctagaatgttctttacaccctcagttccccatcagccttcatctccagataggctgtgttcatcctttgaagcctctcggtgaagccttttctcaaacctaaggacgttcctcctgagactgtcttcatgcaccctcctgacttggagcccgtctggctgtgtcatttgagggcagcatctgaggaggaatcttctttggccatcgccacggccctagttggggtcttgcactgagcagatgttactcgaattctttctgcggattgagtagaacggcctggcactggctttgtgggattcacattgtaactgctatggaatgggctggagaactggttggtgtgtttccttaaaacttttatgttatttggaattgcacgaaaggtgtagacacctttgctattgttgctgtgttgtttgggtctgtgtggaaatcaatcttttgggtttagtaatggttacaggcttttaattaatactaacatcactcataattgagaggtaatatttttgttctcttcttattcaggcaacataagctttacaacaaggagttgtatgctgacttcattgctgctcagattaaaacattgtcatttttagcttacattatcaggatttaccaggtaaggtcattgacttttatgtcaggtttattgagatagtttacatacaataaaattcaccttttgtgggtgtacagttctaggaattgacaaatattggtaatcattactaacacatcaaaatacggtacatttccatcaacctccaaaattccattgttatatatttgttgtcagtttcttcccaccacctccattccttggcatacacaccgatttatttggtccccatagttttgtcctttctagaatgtcatctaaatggaaatgtccagtgtctagtctctgcaaccttttgagtctggcttctttcacttagcagtaatgtggagataggaccttgttttactgattactttttattgctgtgtagttgtctt

SEQ ID NO: 126370 - DNA, 1003 bp, Homo sapiens
ttagctgtatgtgccagcatctattagtaactttatgacgtgcacaaagttaaccttttagcttggaaggtaaagatggaggtatcagtacaaaacttgagccctcttctgtcatgtatctgggagagagtaatgtggtgaaaatgggccatgtaagtgtgccgacccaggggtggtgttcctggggcagatggtgatatccttggtggcctgctgcagcaggcatggccacgtgggaatgagcactagtcgaggtctctgcccgcaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggtaccagctcttctgagagtatcatccatcctgcactctatcctgtttgtggctaaattttttttttttttttttttttgagacagatccttgttctgttgcctaggctgaagtgcagtggcgtgatctcagctcactgcaacctctgcctcctgggttcaagtgattctcatgcctcagcctcccaggtagctgggattataggcatgcaccatcatgcccaactaacattttgtattttagtagagacagggttttcccatgttgaccaggctggtctcgaactcctggcctcaagtgatcctcctgcctcagcctcccaaagtgctgggattacaggcgtgagccaccatgccggacttgtggccaaacttgaaccagtgctgtaggggcggcttgatcgctaggcttgatcccaggagttagaccacctaggttcagacccaggctccccagatgcttcacttctgtgcaccagttttttcatcttttcacttggg

SEQ ID NO: 126371 - DNA, 1265 bp, Homo sapiens
ttattttctgggggcatagtacccaagtgctagactggctgtggacctctctggggagacacccagagtgtgagggatgtgattcctgagccccaggggtggtggcggggccctgttgggacgaggcctgtagtcctggatgaaatccaggccctgcttgtcaggccagtcactcagccttcctgagccagactctgcacatgcaaaacggatatggtattgggagtaaatcggcaccttttcctttacacgtggcacaaaggaggtgcccagatgttaccagccttccaccagttttgttgggttggtgcgaaagtaactgcagtttcatcagaagtaatggcaaaaactgcaattcctttgacaccaacctcatagaaaagcagcatgacttgagcagctggtgtcagtcccatcttattttactgtgatctgagcagtatttggcctgttgaagaagaataattctgtcttccctcttgaatttctcttcccgttaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtggtaattctgctcttcagttatgtagacaaacaatagttttcataaagtgagttttattcaagttaacttaatatactttctcttttccagaagctcagttcattcccaacaagcagttacaacccaaagagacacagatttacatcaaacttgtgaaatatgcaatgcaagctttagatatttatcaggtaaggaagtgccctccagccaggctttcgcatatggaaagtacctcttagtattagaggtcatagtggtggggtggcagtgagagctgttagtatttggatggtccacagtatttgtatacccagatgtgttttgttccacaacatagcactgcgtttatgtgggaattcttatttataagagtctgtgcatttttgaggggcagatagtgt

SEQ ID NO: 126372 - DNA, 1016 bp, Homo sapiens
gcccaggaggttgaggctgcagtgagctgagatcgcaccgctgcactccagcctgggtgacagagcgagacccccatctcaaaatctcaaaaaaaaaaaaaaatgcattaaatgtatttgatgatgaggatgaaataacagattacatcattgaagtgaactgccctgctcagtgctcagtaaacccgtttcatttttttcctttggtggataattaaatttcttggaatgtgtgatacaggcttggttttatgttttttgaaagcttactactttgtcttaaaactgctttggggaagggattaatttttcacatgtgtttcttgtattgacagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaaggtaaagtccatttaatctaagtagtgcttctgttcagggttttttattgttgttagagacagggcctcacggtggtgtccaggctggtcagcgttctggactcaagcaatccacctgccttgatctccccagtttttgggactataggcactcaccactgtgagtgtgcctggctttttttttttttaattcttattttcacttttaaacaaactatagtgactctttatatttataaagtactcttcgaagtagtaaatatttgcaacaaataagggccaagtgtgaaaatcattccgtgtatgtctaagcagtaactaatttgtctatctagtaacttaaaatgaaaaatccagaactcttacggtaagcaagtgtggtggtattagtattgacaccactgattttcttttttaaacctattttctttttttggattacacaaataggagcagatggttctatttttaaaaatttcagtgatgcaaa

SEQ ID NO: 126373 - DNA, 1310 bp, Homo sapiens
tccaggctggagtgtgatggtgccatctcggctcactgcaacctctgcctcctgggctcaagcaattctcttgcctcagcctccctaatagctgggattaccagcgtgtgccaccacagctggctaattttgtatttttagtagagacggggtttcaccatgttggccaggctgatctcgtactcctaatctgaggtaatctgcctgccttggcctcccaaagtgctgggattacaggccggagccaccttgcctggcccctgtaggttatttttgcatttcatttgttacagataccaacatatactttaagataaactattttgagttaaataaagattggaatatgcttgtttggttttttccctttggagtaaacacatcagaattgccttccattgctgtcggattacagtgacactttagagtctggagggtatagaccctcctcatttagatgccactaatctgcgtcttctccaccccgcagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaaggtcagagcagtgactttggttgccttttagtcttgtgtgtcatgtagtcatgtgtctagccatcctgattgctgggtttcatcctctgtaactggtgagtgtcatggttggtgggatgggatgtggcacatccgccgcccccctgcccccctcccctggccctggtcatctactgggactttgaagggcgctgccttcagggatgggcccttcccctccctcctcagcattgaatgggatttaggtgttagttgtcctggctagggcttggttgcatttttatagtgtttggtaagcaagtctagaaaatgatttctagtggtttagtaagatcagagatccctagactgaaagagaatcagaacaaaaaaagaaaaagcaggtgacaaagttgagacagagttgacttacagttagtttatattttcatttagcttctgatttacatagccagaatcctgtaattcctgtataattaggaatgctctcaaggtacatagttaacagggatctgggttcattgaatgcttttggggtgtgtgctgattggaaacactgtcccaggaattcattacacttcttggtatggtgagctcttggcaagggattgacccttctcatgtatttccttaacttccttagagaagtgacata

SEQ ID NO: 126374 - DNA, 1074 bp, Homo sapiens
tctctttctagccagcctcagctctcagtggcactgtctcaggaatggggtcagtaaatccttaactgtcctcgtgagtggtggggagggggactttatcagaaagaggctcctcgccatttataatacaaaaaaattagttttaaaaactgtttagagaatagacctcaactgtggtttactaaagtctgatagtacaacataattaaaaaataatttatgatattaaaaggatatagtactatgattataatttaaattataatttataacagttacatacggcctactgttaccactcagaaggggtcatgagtgcaattattggacagatgtaacagggtggagtctaagggcacagaggtctccctgcagttgtgctgatgtgcacaagagaaggaggggcagttcttttgtgtgtttcacctgggcccgagtctggggagcgtcttccctctctgatagctgcacccccttccctagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggtaggattttagtgaggttgttagctggctgcttccctggaagcagtgggccgtcattgggttctctgtactcaagagtgggctctgcaagatggaccagtgcagctctctgtttaattcatcttcgtgagtcttctggtggattgaaatatgtaaagaaggccgggcacggtgtctcctgactgtgatcccagcactttgggaggccgaggagggtggatcacttgagcccaggagttggagaccagcctgggcaacatggtgaaaacccatctctacaaaaaatacaaaaattagccaagcatggtggccgacacctgtaatcccagctact

SEQ ID NO: 126375 - DNA, 1121 bp, Homo sapiens
agctttagatgatggaggctcagttactcctaggagtctctgttcaaattagattggagactgcagctaggactgagtttgaggttgggatattttccctccctgtcctgagatttagatcttgggcttcatctaggctggaagaagatggcgtaggggccaggtgtggtggctcacacctgtaatcccagcactttgggaggccgaggcaggagcattgcttgagcctaggagttccagatcagcctaggcaacatggtgaaatcccatctctactaaaaatacagaaaattagctggatgtggtggtacatgcctgtagtcccagctactcacgagtttgaggtggaagaatccgttgaactcaagaggttgaggctacagtgagacatgattgaaccactgcactgcaagctgagtgacagaacaagaccctgtttcaaaaaaaaccaaaagataaagatggcataggccgtgggtcagagtccctgctggtcacctggaggattgatgagagcctgcctttagaacagtagtattggttctacaaggcaaaccctgcggctgacccagggtgcatgagcagcttgtgggagaggaggaggaggtggttcttaggccttcttaccatccatgaggcagatagcccaaaagagacacacacaggctcaaggccacaggaaccaccacaggcctccagatgaatggcacagggtcagcctctcccagtcccatcaaccagctaaggccatgcgagcacagcaggagggcatgcttgttcccagggctgccccctcctgaggacacccaagggttgggtgggcctggtggagggtagatgaggtgagaggtcttagactacttttctgacaattattaagaagcctgtttgaatctacgggaacgtaagagaaattggaattttgcttggtttagagaaaagtaccaagattttatgttaaggagtattgctagacatgaatatttggcattgttaaatggaaggtgatttaagaaaatagatttatggccgggtgcggtggctcacgcctgtaatcccagcactttgggaggctgaggcgggtggatcactggaggtgaggagttcaagaccagcctggc

SEQ ID NO: 126376 - DNA, 1041 bp, Homo sapiens
gggcagatcacgaggtcaggagatcgagaccatcctggctaacacagtgaaaccccgactctactaaaaatacaaaaaacttagctgggcgtggtggcgggcacctgtagtcccagctacttgggaggctgaagcaggagaatggcgtgaacccgggaggcagagcttgcagtgacctgagatacgcgccactgcactccagcccaggcgacagagcgagactccgtctcaaaaaaaaaaaaagattcttctgggtgctgcagatgctttcagtgaaagcttttcacaatcatgtaatttcagcacaaactgtagtttctttgtgtcttggttgtaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaagtatgtcggccacttccttctgtgtggttgggtggatcctgttttaggaattggggctgcagagggcctcccaggtttcctggtgctaggagcaggctccttgaagtccagcagatgccatattatctacctactccttcttgttggggccttagagaaaatggaaaggagaactgggtgcttgagaattagaagggatcacagttgtcgcctgcctttattgtgtcttgtcacctcctccattagtttgtaagtgtgaagaaatcaagggtcatgtcccttctccctccctttgtctcaccattctgtccacagcagctggcgcctgaaaggcatgcagtggaccctctgcattttcatttcacagtgatctttctccagatatttctcatgtgatgtctgtatcttgctcttacctcttgagactgtgcatgaccttaatgtaatgatcttttgaggtaacacacacataccatttttctgcattgtaagtttcaggggatggatttttcctatatattttcacattcttcactgcatcagaagtgatgc

SEQ ID NO: 126377 - DNA, 1033 bp, Homo sapiens
aaaaaacgtgctgtaatcccagcactttgggaggctgaggcgggggtgggtcacctgaggtcaggagttcaagaccatcgagaccagcctggccaatatggtgaagtcccatctctactaaaaatacaaaaaaaattagctgggcgtggtggtgggcacctgtaatcccagctacttgggaggctgaggcaggagaatcgcatgaacctgggaggtagaggttgcagtgagccaggatcgcgccattgcaccccagcctgggtgacagagcgagactccatccaggtgttgctgaaattaaagcagataaattacccaggcctgtctgaataagagggaagcaagcagattaaaaatttgaaaagaagtcctagtggagtcatcagctcaggagttgggtgtcgtgacaccagatctgattttgcctttcagctttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggtgagcacgggggcacggtggggcacgggattggttctttgacttttataggtgctttaaaaacttgctcaggacattttgttgttctagaaaaagctgagtttggctgattgattttcggcttttattttccaattttccatttacgacattgataattggtatttcagtggtgggcactatatcagcttgaaagttactacctaccaagttttgtttgtaagatagacccaatttaataatacttctgtgtccaagtgctttgggacaagctgcctgtgaaacagacagtttgtgttcatactcactgctcaccttcctctgcctggctgtgttttccaaggccagtcttgccctccagaaacttctccatcacctgctccctgctctccaacccatgc

SEQ ID NO: 126378 - DNA, 1703 bp, Homo sapiens
ttgctctgtcgcccaggctggagtgcagtggtgcgatctcagctcactgcaacctctgcctcccgggttgaagtgattctcctccctcacccctcctgagtagctgggattacaggcacctaccaccacgcccgggtaatttttttggtatttttagtagagacggggtttcaccacattggtcaggctggtctcatactcctgacctcatgatccacccgcctcggcctcccaaagtgctgggataacaggtgtgagccaccacacccagcccacgcccagctaatttttaaaaaaatttttatggagatgcatctcattatgttgctcaggctggtcttgaactcctggcctcaagtgattcccctgccttggcttcccaaagtactgggcttatttaattgtaaaagattatgaaagtggcaaagtggcatgagccactgtggttctcattttgaactaatatatttttgagttatgattgagatacatgaaaataacacagtgtatcatagaaaacgttcagaaaaatacagcctaaaggcatatcagaccacttaatttacacataattgcagtttaacagaagttggcttgaaatctcagtggtggctttttatggagtttcttttttttttaatttattttttttttgagacggagtctcactctggcggccaggctggagtgcagtggtgtgatctgcaacctccgtctcctgggttcaagtgattctcccgcctcagcctcctgagtagctgggattacaggcgcctgccaccatgcctggctaatttttgtatttttagtagagatggggtttcaccatgttggactaggctggtctcaaacttctatgtcaagtgatcctcctgcctcggcctcccagagtgctgggattacgggtgtgagccgccgtgccctgctttttatggagtttctaacttcaaggaaaacattggggagttctgcagtttgagggacaagactgttctcacgtgccttcccatctctccttttaggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggtaaggaagggttgaggagtgtcttctgatttggagggtgtctgtacctgagagtggtccttctagaaactgatagtttaagaattgcggccagacgcagtggctcacgcctgtaatcccagcactttgagaggccaaggcgggcggctcacctgaggttgggagttcgagaccagcctgaccaacatggagaaaccccgtctctactaaaaataaaaaaaattagccaggcgtggtggcgcatgcctgtaatcccagctactcgggaggctaaggcaggagaatcacttgaacctgggagatggaggttgcggtgagccgagatcacaccattgcactccggcctgggcaataagagcgaaactctgtctcaaaaaaaacaagaattgcagtaacgtgttgtggtttgttcattttcctctccaggcctgccagctgcccctgttttcttacatcgtggagc

SEQ ID NO: 126379 - DNA, 1047 bp, Homo sapiens
ttttctgtacttgaaaaaaaaaagtgtgttcacttaaatatttgaattatagcccatctgtttcttgaacacttgtctgaggccctggggaggctgatctgaaccaggaagacacggccctgccatcatgggatttgcagttagataaagtaaccccctgttttgaggagaaaaaaaaacgtgatggtatcagagtgggtgagaaaaaaacatggtggtatcagagtgggtgagaaagtgtctaagaattctttccactaatgaagtaaactgagttttgccttaaagaggctcagtcatactttgatacttaaaatctttaggatttgagcttagtttgtcagttgttaattgtgttgcagtgtgtggaagattgctgtgttctgttatttgcaaggttattatgtcttcacaggaagagtgggctaaatgaaattgttttatcttttgcagctgttgaatttgtgtgaggctgaagattcagctttaacaaagctgccctgttataaaagccttccgtcactcgtacctttacgaattgcggcattaagtaagttaatgaaaatctacggggtataaaagtgaaaggagactgaccacaggaggtctatagaaaaaaaaagtggccttttgttgttgtctaatttttatgactttttgtagtctttttaagatgggatcaaaaaattatttttgtatgtttatcaaactgtgtaatgagatgccataaaattacatgtgttgttaggattgaagtaattttgtgctttatagtaaagtctgttgttgttttatgaatcagacgttctggtttaaaaggattgtcgtatcattcatatggtgccagaatcagagtgtatatatagtaagggacatgacagccttagaagcttttcaatgactcaagcatttgttaatcctgcagtctctagcttttcactgggaaacctcagttatcattgtcaagcacaggaatgatgcaaagtgtaggaaaatagactagatctgtattggctgagatagaaacaatcattttctttctagtgg

SEQ ID NO: 126380 - DNA, 1037 bp, Homo sapiens
caatagtgagctccaagaggccggagaagcctgtatgagaaaggtgagtgtgtgtgcgtgcgtgtatgcgcacgcgtgtgtgcacacacatgtgtgtgtactctgcattaagagttcttcctgtttattgctatataaacagtgtatgcctaaaaggctttatgcatgtggttattacacactaaactgtaataagaatatacctgtttcatagtcatactgagttttttaaaatattaaacagtaaagataagtctccatcatttcgtcataaatttctgaaatagtatatgattaatattccatcttcctaaaggagaacggaaacttgcagctaaggttgaagatgagttctgttctattatgaagtgtcctcagttgtctatttttctttacaacttttcttttttaatagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatggtaagccaaatgcatttaaacgctctgtaacaaactttcaaaaaattaaattattttaaaaataaataatgcagctgggcacagtggttcacgcctgtaatcccagcactttgggaggccgaggtgggtggatcgcttgcagttgggagttcgagaccagactggccaacatggtgaaacccctctctactaaaaatacacaaattagcctggtgtggcagcgtgcatctgtaatcccagctacttagggaggctgaggcaggagaatcacttgaatctgggagacagaggtcgcagtgagccaagattgtgccactgcactccagcctgggcaacgagtgaaactccatctcaaaaaaagaaaattagccaggcttagtggcacgtgcctgtggtcccagcttcttggcttggaggctgaggtgggaggatcacctgagcatgggaggca

SEQ ID NO: 126381 - DNA, 1050 bp, Homo sapiens
gtgaccacttgttatgtgtatgcacacatacatgcgtgcacacacacacccacacagagctagttttaggaagactgcttactttacatgataacccagctgtccattgggtgcggtgatggcctaaaccacctggacctcttctgactgtagccgggaaagaggtttttgttattttttattatcttagcccttcatataaaatttgttcactctacaaaagactttttaaaaatgtacttgcatacaacaaggtcttccagtttctcccctttcacaagaatcctgaaaccctattttgaaaacgtgctgtagggaagaattccactgttagacactctctgtcagatgggccgtgttttgacatcgaaggtgaaagtgtgctttttgctgttgagcatttgttaattactgtgtgctttctgataatttgtgtctttactgtcttgttaaccccaataacccttactgtgtttgagtatgtgggaagtttttatgtaaataacataaatagaaaaaagatgattttcctccccatcctcaggaaagcatttccgagtgcgggagatgtcccttgtctccattctgtcagtttgaggtgagaacaacctattaacagtcagtttctgacttgcaatgtgaagaaaagtttaccttttcttttcttttcttttctttttacctttctgttgccttttttcatgctgtaatttttgttttggttcagcctgccatggaaggggtagaggtgagaacttgagcggagctacaggagggggttgttgtcgttgctggttttgctgtgactcgttagctgtgtcgtggttctgtactggacagagtgcgttgtgcccttgagtgcagtgacctgtattgtctgtctgtggcagagttgtatcagtatcattgctgtgaactgtctgatgccaagcatgttttctattaggatgttttaagcaagactcttaagttcgtgtgagaattgcaatgtctcaattatattcaagattgaattagattttgtgttcgtaacctctatctgaatacaca

SEQ ID NO: 126382 - DNA, 1079 bp, Homo sapiens
tccccttcatctccctcttgcgtgcacacacaccacacatgcacacacaccgatgcactcacaacacgcgtgcacacagaccacacgtgcactcacaccacacatgcacacacaccacacatgcacacacaccagtgcactcacaacatacatgcactcacaccacacatgcacacacaccacacgcgcacacaccacatatgcacacaacacatatgcacacacaccacacatgcacacacaccacaatgcactgacaacacacatgcacacacaacacacatgcacacataccacacatgcacacacacactgatgcactcacaacattgtgcagcattgcacacaccccgagctttccctcttgtgtaaaatggggatgatggcatctgttactcctgcctcccagtggtgttgcaaagacccaaagaagtggtttctgtgacagtgctttgaaaatgaaaaagcagattgtaaaagtaccattttagaatgttataatttcaggatagaacttactcttcctaagtcttgcagattctggggaagagaattgtagggggcatggagctggccttgagcccattttcctcattttgtctccatctcctgctttgccttttggtgtaaagagaaattctgaaaagtctctcaggtgctgctgggagtggggcccttcctgatccgtgctatcatccccttcttaccccgaggatcgcagcgcgcacagcgcagcacggcacattggaacgtgtccctcccttgtggccatggagaattcctttgaatgacaggagcaaaactggaaagtgagaagggaaagctggagcaacagcagcccacccctgagctgtgagacagtagaacatgcagcacccttggcatttcacacatctttgatttaattcagcggagcagtttgtcagctttatttttaggcctggttgacaaatacttagtaccaggatcagttgtttatatacattgatatttaatttccagggtaaatagttaattttttgaagaactttctctgctagggttttttttgtttgtgtggttttttttttcttttcttt

SEQ ID NO: 126383 - DNA, 1077 bp, Homo sapiens
ggattacaggcatgagctaccacactggccactgctaggttttgagggcaaaagacatctgtgcccttagaacttagtgtgttgagaggacctcgtgataccttggcaaagtagggcatcctcacactgctctggccccaggtggaatcatccctgcttctgtgaggggactattatggcagcctggtaaggtcacctttaccacttgtgagcacgcatgacagcaaacagcacgatcacatcgggtgtacaccgtcggcccctccacacccctacaatggacaggaatgctgaaggccacgggcagtcagtttccttaggacacagcacagttagaacctaaggctagtaagttgtggcttttacatgtgaacccttcgcttcactgcctagccttgccaacatagttagactatagtagggtctgtagtgacgttgacctctgtcacttgcaaaattaatcgacctgtttataatttctggttttcttgatcaggaaatgaagatttgctcagcaattataaacctttttcatctgatcccggctgctcctcagacactggtgaagcctttgctagaggttgtcatgaaaacggagcgggcgatgctgatcgaggtaagggccatactgaaggctgcttctcgctctgccaccctccggtgcttatagcgtcctcacttgatcgtattttcaatggacggaacagcataaagacgttcgatgtcaacatttgcttgtgggtgttcatgcactccagtaacaagggaccttgttaggtagacagcctcaagctctgagaagaggaagttgtgagatgcagcattcccacatgttttgcaggcggggagtccattccgagagcccctgatcaagttcctgactcgacatccctcgcagacagtggagctgttcatgatggaagccacactgaacgatccccagtggagcagaatgtttatggtaagagctgtgagcagctggagtcaggggtcccttcaaatgcttgtgagctgtcgtgctctgaaatgttcagttcatatttcactattcagtgtcctggctgcttttttttcaga

SEQ ID NO: 126384 - DNA, 2387 bp, Homo sapiens
taccctcagaactggtcttctctgtgttcccatgacctcacatcggggcctcacctctcacttgagtgactgcagctgccgcttctcagcgcctctcttgttggccctgttcactttatttcccatcctgcagtcggagggagatgagccatgtacctccctaactcgctgctggttaggcgggacatgggatccctgcagggagcttggtcttacctgtctgcatgtcctggcctagttcagcacgggcacgtagtaggtgcattataaatactagaatgaatgtattcattggtcaaaacttaacagaaagcaactaagttgtttcctaataagaaagtcctaagaagtttttaaaaaattgttttggaaaagtagcatgtcttgacaccaagggattgtcttcttatttcttaaagccttccttctcatcctccataaacgtctcttccctgttttaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtgtaggagggacggtgggctgcggggcgcgcgtcttcaggcattcactttgaacctttaccttgtcttgttctgcaataatcaggtggtcgttcatcttttagtaaggctacttctggttcattgattagtttgtgtatgtgtgtatggctttatcagcatggaaattgctgtaatatagagaatatgtcacaggtgtgtgtgtctttgcgtctgaggctacatttctgttgtaagtactgtgcccagttaacccttgtatgctgctaagtttgcaccttaaggtgggagatagtcctcattgactctagatttccatcacctgccttggaaagttattcatgttgctggcacctccttctctggccaaattaccctttttgtgggatttatttatatgtaaatgtttcttgtagatttggggtagaagagaaaggattgagttgaaagcaaattcttttatagtcacctcttagaggaactttgcttttgggtatgtcttaaacttttacaatgtcaagttctgaagtttgatacatgtgattagactcaccttcctgtctgaagagaatttgatttttcaagactgaagtatactattgtaatgggatgtaatgggatgtagttggggtgggggagggtgataaacacatacataaggcagtgagaatttcctcgctcaggttaggattcagaattcttgagcatcaagttgggctgtgtgtgtatgttggggctgagaggcatgtcgggggtgtgtgtgtgcacgtgcgcacacgtgcatgcactgtgggaccaagctcccatgttccggcgtgatgctggccctgcgtccgcaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcaggtaggggtgtcagcctcaggggtgccccgatcgtcttcctttgacttctccctagaaatcagtcagtaaaaccaagcgcctgtgtgtttttaagccggattcagatatggacccaaattccagtggagaaggagtcaattctgtctcatcctccattaagagaggcctgtccgtggattctgcccaggaagtgaaacgctttaggacggccaccggagccatcagtgcagtaagatcatgtgcctctgtatgggtgctgcgcattctgctgggagttggttcgtttattccctatatttagaatgtgagctcggtgctcagctgcattcaggagaggaagctgggaacagccacggtcaccagattgaaactccaggacatgtcactcatgcaaggggttcccaggtcaccagacatgcttgcctcatgcgttcagttcataccattaaagttctgttgatgatggttgattacttgcagaaaggcatctagagaaactctttgaagtaaggagttgattaagaacatgtgcccatactgagatcagtttctgagaaggacatgtgttctgtttcacgaggcagccaccaagagggtcctgggtattgccccttgtggagtggtggccctaggagccctgagtctgaccccagctggtgtcatggacctgctggcttgtggacgcaggcctggccaccctacttctggcttcgtaggcc

SEQ ID NO: 126385 - DNA, 1028 bp, Homo sapiens
agggcaagcgttcatctaaagcgtttttgggctgatttaaaatcctgtgtcagaaagttgaatagtatatttttgtaggtgaagattcattttttcttcaaatataaaaaagtttgaattctgtctgcgtgccctagaaaataaaactgtggacttgtcaactcccattgttcttttttttttttgagacagagtcctgctctgttgcccaggttggagtgaagtggtatgatctcagctcactgcaacctctgccttccaggtttaagcaattgttgtgccccagcctccccggtagctgggattataggcccatgtaaccacacccggctgatttttgtatttttagtagagatggggtttcaccatgttgcccgggctggtcacaaactcccaagctcaagtgatctgacttcctcggcctcccaaaatgctgtgattacaggcatgaggcaccatgcctggcccccatcattccttaagcagaaagatggagcagccgggccagggcctgaccacgctgtcggttttggttccttagtgtgaggagtcgggtgctggcaacacaagcgtgtttaacatgctcagtgttatgaaagcgaggtccagacctagagtagaattgacttttcatggaaggcaagtcagatgttctttgagtttccagcaggattgtggtaagcttctagcttgctagagtttcagcctgtggctcactcatcagcttgagtttgctgtggcaggttaccagtgctgtgcaggtagttctcgtccatttacctggagtgaatgaaaccaggtcaccacgtactatgtctcctgagacagctgggacagaaggtggattagttctctttgatgagaagaagggagtgagttgtggtgctgggtctcaggagagcctgctagcatgtttcctgttcgtgccggatgggcgttctcttggcgcgtgtgcagcgtgcgtttggaattttgcctatggccacacctgggcagagttccctgctcttccatcactcgttcaggag

SEQ ID NO: 126386 - DNA, 1047 bp, Homo sapiens
tacgcagcttggaaaggattcgttgctttcctcccatggacagttcaaagcctaaatcaggatcattccacagcagtgtaactttttctgtttcttttctttttctttttgagatgggatgttgctttgtcacccagcctgcagtctagtggcgcagtcgcacctcactgcggcctcagtctcctgggccaagcgatcctcccacctcagcctcccaggtagctgggaccacagacataggctgccacacccagctaatttgttaattttttagtagatacagggtcttgatatgttgctcagactggtcttggattcctggactcaagtgatccacccaccttggcctcccaaagtgctgggattataggcgtgaagcagagatttggagtgtcacagtgtcttataggagaaaataggaaaaaagttaatttctccaccaccatctcttgaaagaaacggtaaaaccgtgtacaaaaaatgtgtgaggagacataataatgttggattatttttcaagtgcactaaaagaggagaaaatgataaatgagttaatttgctaaatcaagcccactttgtggaactgggggcctccaggtgcatctgtgtttgaatctagccaggtagaaactctctggcttctgcaaactctcaggtaaattataagtctgtttttatgtcctgaccttgaaagactggttgaagctccgtgtaccaggttgcttttgatgaggaggtatttttctgttctttcaggagctgggtgatgattctgattattctgttcatatcaggagctaggtgggaaaaaagcacaaactacttttcgcaagtgatttttacgttaaaatcttttggtgacctatgttgaacttgtgcactggatcagtctttgaacttatacccaagtgacaccattgtcatcttggataaggataaaatgcttttctgtgggatggagcgggaagcagagcagcctgatacatgtgagtgatagctctcatgttatgggccaggcacttcttttgtttgtttgtttgtttgtgt

SEQ ID NO: 126387 - DNA, 1085 bp, Homo sapiens
tctttaaaatcctgttttggaaaattgtagttttagcttttggtaagtattcataaaagaacacagtctcgaacaagtttcagaaaatgagggaaccgctggctgtcactcgagcgaattaggaaaggtattcttgcatcgagagagacagcaagacttgccgatttttgaatgaaggcctaaatgacatgtgctttggtttcaggcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggtgagggtgcgcctcagtttgttaattacctcttccctgccagtgacttcacactttaaataaatactcctcccaaatgatttcaaatgacagcacagtgaaactatttttaggggggaaaaaaagtctctgtctcaagcactcaggaaccttactttgtgttttcaggagatactggattcccttgcggagctttactccctgttacaagaggaagatatgtgggctggtctgtggcagaagcggtgcaagtactcggagacagcgactgcgattgcttacgagcagcacgggttctttgagcaggtaaacctcagaccactgacggtcttgggtgtgtaatgagaggtcatttataacggttctttaataaaatgtcctcaagtcggagttcacgttctctttttttgagatggagtcttgctctgtcgcccagcctggagtgcagtggcacaatctcggctcactgcaacctccacctcccaggttcaagcgattctcctgcctcagcctcccaagtagctgggattacaggcgcccaccaccatgcccagctaatctttgtatttttagtagagacggggttttgcca

SEQ ID NO: 126388 - DNA, 1778 bp, Homo sapiens
gtttggtttggtttggtttttttttcccccaggttttctattttggggtagggaatgacaggtcggggtggtaatggtacagggaaagatgaaggtggtagaagaagtaaagttttgttttttgtttctgtacctgttacatttttctagttggggcagaatcgtacaggccggggggatcaatgctctgagccatggcactctgcgttgaaggtcccatcccaggacgagttgtgctcaggtggctctgcgtggccttttctggttttcctggtccccctcttatcccctaaacctgtcaggcatccacgtgtttagagcagcctttgtcattttatgatttggttagccaagatggtaacactccactcaagaattagcaccttttaaaagttgcttatggcataaaatacaaagtaacgagggtttatcacagagctgcccattttcataagccatgtgtgtgtgtgtttcattttttatttaagccttgttgtgaagtgctttgaaagaggatcggtgtgggctaatgattcctttctttgccctctagcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcaggtgcggacaggacacttgaagaatgaggccaggtggagattgaggccaggtggagaatgaggcaatgtggggtctcctggttcagaatataaggaaggtggactcgaactttccacaaatacagcctcagtaagggggaaacagtccttccaaaacacaaaagggaaaggaagctacttgactgtgaattacagtctcttgtggtctctgtcctactatatacttagttaatgtgtttaaggaaagaaaaaaattacacactacagaattatgaggatctaagatagattttgactattttcagaggaatcttgataagaacaataaaaccgaccagacctataaagctttggagaaaataagacccctaagtatttaggattaaatacttaaagttagctttagtaattcagtttaaattctgaacgtcaatcaataaatattcatggtaggcaaatcttttgtcaatttaaagtacattggtcaatgactcataggacttactgcctagattagtattttatgaggttttcatattgtttagaaatttcaagaactttttttctgctcattttttttgaacagggccttgaagttattgaatctacaaatttaaaatacttcacaaaagagatgacagccgaattttatgcactgaagggaatgttcttggctcagatcaacaagtatgtatgttatattgaaaggataagagaaaaaatgcatcagattatttaaagttatttataacctgaagccaatgtgaagctcaagctagaaatgggtatgatttggtgacagtcattaggtaggattttttaggtactgcacctctgcaaaaagagtaacttgtgacaaattgataagcctatttgatgtgtagtattttaaaagcttttctcaaatgagctactggatcacagaactgctgataacatggattcatttccccatttcct

SEQ ID NO: 126389 - DNA, 1049 bp, Homo sapiens
agccccggggccagctccttactgctgtgaagtctcgtgtgtgcacagtgcacgcagacacgcggtgggaacagtacagctgcctgaaaatgcaggggttttgtggctaatcgcagacgggtgtatgatccaaaaaagtggggcttttctgttttcgctttttgaatgttcaggtcccttactccccaaggtcaaaagcgcctgctcccatgtggcatgcacaggcgtcccgtttcttgcacacgccgatttcatgcctgctgtgtgtgggtcctgccggggagtgcagagatgaccctgggctgggagggccgcactcaataggcgcttttggctgctggttctggagtggagggctgtgtttgtcagttgtctctggctcttttctaccaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacgggtgagtctccattttccttcccttccatagggagaattgtgcacgctgatttcctccggctttagtgttgaagctgattggatccttggttttctgatcactgcacggggcacactggttacactctgtttacagtgcagacttcagagtgcatagctgagaccacatgtttttctcccagggaggggtcaaggtttggagcaggagctgccaggatccaagacggggtagaaaatgcatggtttcaggccacactgccctcctgccctcctgccttcctgagacccttccttcacttgtttttggtgggaaacagggtagggtggggtggtgggagacattgttagtgtgaaccagtaggagacagagtcctggtgagccggtgggagatggg

SEQ ID NO: 126390 - DNA, 1352 bp, Homo sapiens
ggtgggcggatcatctgaggtcgggagttcaagaccagcctggccaacatggtgaaaccctgtctctactaaaaatacaaaagaaaaagaaattggccaagcctggtggcgggtgcctgtaatcccagctactcgggaggctgaggcaggagaatcactgaaacccgggaggcggacgttgcagtgagcggagatcgcaccactgcactccagccagggcaacaagagtgaaacttcatctcaaaacaaacaaacaaaacatgtaattcgtagctggtaggggcttgagcgttttttgcagtgtgttagaactggcccagatgactaaaaacgtttttaatcatgttttatttttaagattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggtgagtgggccagcctggcaggtggaactaacccacggcgcccatggacatggagccccatgggagctccagggtggaccctgtggggaattttggacacagattccctgacatgggagaacataagatgattctggaatgtaagtggtcaggcactttacaagttctgcccgcgctgactggttagctgtcctgagtgcagtctgggtttgcattcagcagaccttcttccgagtcaccatagaacttgacaaaacagtgtgtgtcccactcttgtaaatcctcgaagcacagtattgaggcagaatcagatgattgtagcatttcctagagtgtgctgcatctcatttgaaatgctgaaagggctttgaagaggtttcttttaacaaaaagtgtgtttcgtctttatttctgaaccagacacagctctgcttttctatatgtccagagtttagttgccctttcctccaaatctggctcctgtcctggccagctctccctcctccttgacttccgtccgtggctgctgaattgaaaatattgtgactcatttacaccgcatcagggtgaggcagggtacaaataaattgataaacgaccgctggcctacacagtccgttttcccgtgacagttcggacattcctagcttcttctcaagacaaggactggtagcagagatgcagggcatgtcctcatggcttctcgctctggcaggttcatgccccgggtagagattgtgcagaagcacaacaccgcagcccggcggc

SEQ ID NO: 126391 - DNA, 1083 bp, Homo sapiens
ggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtttattgtcccttgtttatgttaaaatgcttgtttccatgaggggtttcttccctctcaatgtccctagccccttgggaaccagaggccccagagacagtgtgggctcctcagcgtagcctcttggtgacagcgtgcgctgcctgggcaggcacagtgctgctgtgatcacaggggaggccatgacttggcacctgggaagccagctcagagcatattcagtcaagttgatgaggaatggcggcccgacctcagcagcaggtcggcgtgcgggactctcagaatggcggcctgatctcagcagcgggtcggcatgccagactctcggagccctcagctatcttcatgtgtttcaggactgctgccatgtaacgtgtgtgtgtggagagtgtgcggagtgtacacgaagcatgcccggaggctcagcatgaagcactctgtacccagctctacctcctcattgtccttcatccagtgt

SEQ ID NO: 126392 - DNA, 1083 bp, Homo sapiens
acttcctactattagggccttctttcatataagaaatgatatgccgtggggagcccctgttccttatcatggttataagctctgaaactgcctatttttttttttggagatggaatttcactcttgttgcccaggctggagtgcaatggcgtgatctcggctcactgcaacctccgcctcccaggttcaagcaattctcctgtctcagcctcccaagtagctgagattacaggcacccaccaccacacccaactaatttttgtattattagtagagacagggtttcatcatgttggccaggctggtctcgaattcctgacctcaggtgattcacttgcctcccagagtgctgggattacaggcgtgagctaccgcgcccagcctgaaagtttggttttaaatctctcggatgttgctgctgtttgcagcagagaggcctggactgagtagaggtttggcgtaagtagcaccacgaaggtccatcttagcagagctgggacacagacaccttgataaggaacctctgtggcttctgttgctgacttttggtctcattcctccatactcagttggacaaacctctctgtatcttccattttggtagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaagtaagactttaaaaatattttttgctgacctctttcattggtaatcgaatgctttcttggactggtatttttgtgaatttattgactgtcttgctggttggataataagcatggtcaaaatgatgttaaatatctggcggataattgcatattttaaactcttaaattagctgtgaagagcactgaagccctatgttgttgctacccttttcttacttgcagcctacataaaatttaccgagatggcagtattaggcggctgcacgaaggaagtttccgcacgcagcgctctcatgagacacgtggcccttaggttgagaagtagagatacg

SEQ ID NO: 126393 - DNA, 1036 bp, Homo sapiens
aacaagcagtaattgctaacaacatcacaaaagagagatgatccaacattaacacacctcttggaaatacagggaaccaggaatgtgtctcacggccccaagggaatataatcaacaaacatccagaatggggccttctgtaggacagacaacccagggtcttcaacaaatagactgcaagaaaagcaaagacaggagggaaggagaacctgtcaacaattcatattcaaacaaacttgagacatagctacacatgcaaggtgtggactttggatcctgatttatgagacaattggagaaatctgaacaccggtatttgatttttttaaaaaattaatgaacattttttagtcatgataatggaaatatttaaggatgaagtcataaaatgttggggttggtggggagggattggaagagtggacattggatgatggttagctgggaggggtggacacagggggttcattgtactggtctctcattttttatacatatttgaaatttttcaatctaagattttaaaagagtatttgcttctaagggacagtagcctattaaggtgaattgtcttcaaaattgctcagggggtgaagattgatgtttaaaaagtatctaaaggcattttggcattttatgtaaccaggagtttcattatagagtaaaataacaaggaaaatggagtatttggatatgattttattttattttaaagatggagtctcgctctgtcacccaggctggagtacaatggcacaatcttggctcactgcaacctctgcctcctgggttcaagcaattctcagcctcccgagtagctgggaccacaggcgtgtgccaccacacccagctaatttttgtatttttagtagagatgcggtttcatcatgttggccaggctggtcttgaactcctgacctcaagtgatctgcccacttcggcgtcccaaagttgggattacaggcgtgagccaccgcatctggcctggatttgattttaaatcaagaaaaatgagatctcatttcacaaactcctc

SEQ ID NO: 126394 - DNA, 1169 bp, Homo sapiens
ctacatttgccccttccataaggagcaaggtagttcttcttcccagcttgttgaaattaatggatacgtatttattaaatgcctgttacatgtgtaatacagaggcaacattattttataaggtttcttaaagagaaaatctcaatgagatatcataattcagaaatacaattaaaagctgggcatagtagctcatgcctgtaatcccagcactttgggaggccaaggcaggtggatcacctgaggttaggagttcaagaccaacctggccacatggcgaaaccccatctctactaaaaatacaaaaattagccaggcatggtgatgcacgcctgtagtcccagctactcgggaggctgaggcaggagaatcacttgaacttgggagttgcagtgagctgagatcacacaactgcactccagcctgggggcaacagagcaggattctatctcaaaaaaaaaaaaaaacaaaacaaaaaaaaccaaacacaattaaaaatgagttttgcactttctttccagatatgttgggaaaacggattcgataaccattagcgtgtggaaccataagaaaattcacaagaaacagggagctggcttcctgggctgtgtgcggctgctctccaatgccatcagcagattaaaagataccggatgtaagaaccaaacactttcctgcctcttaatgcaaccaaagaaagcttaggaggcatcgttttttgttttgatcgctgaatactgaattcctgccttcctccctagttcacgttccttgggttaagttttgaattgtttgtttacagaccagcgtttggatctatgcaaactaaacccctcagatactgatgcagttcgtggccagatagtgggtaagaactttcttgtctgtgtaaagagatgcttttccagaacttacattcaacccttcatcgccgagaactcacatacaggcactgacgatgctgacgggcctcagaggacagaccacgtacggggccttctcttcagtactaggaagttttgtcttgtgtagtttttattattttatctaattcccttctcctggcttttttttttttttggtttttttttttttgagatggagtgcagtggtgagatctcagctcacctcaacctccgcctcccaggttccagcgattctcctgcctc

SEQ ID NO: 126395 - DNA, 1025 bp, Homo sapiens
tctgatctaataaacctctctgattcattctctagcatttagggacttaccgaattaaggcctggtgaatacttgcttccatagataagataggcaaagatcagtaaacaaatttcggggcattattaatttttagaaagtctaaatacaattactttcagacacttttccctccacttaattagccccactttaatagaaatttgaatgtaagcctttttttttttcagtcactttcttttctaccctctaaaaatctgagtatggaggcatactaggctctcttagaaagctcaatagacataacttattttgctgattgaaattatcctgaaattagagaacacgaattgtgtgttctgtgtcacatggatggatgtgaggtctcatctaggtgtgggtctcctctctcctctagggctccctgacccttttgcaaagattgtcgtggatgggtctgggcagtgccactcaaccgacactgtgaaaaacacattggacccaaagtggaaccagcactatgatctgtgagttgaatgttctgtaagccccatgcggagcggcaggaaagcaggtgtctaccttttacgagaaacatccaagagaaaaaaaaaaaaaggatgactttttattgataacaaaagcggatggccaaatgaatgtctacattgcctaattttagaattcatgtacttggaagttcttgcattttgttactttcttttttctttttttttttttttttttgagacggagtctcactctgtcacccaggctggagtgcggtggcgtgatctcagctcactgcaacctccgcctcccgggtacaagtgattctcctacctcagcctcccaagtagctgggattatggacatatgccaccatgcccagctaatttttgtattttttagtagagatggggtttcaccatgttggccaggctggtcttgaactcctgacctcaagtgatctgcccaccttagcctcccaaagtgttgggattacaggcgtgagccactgcgcc

SEQ ID NO: 126396 - DNA, 1032 bp, Homo sapiens
gcacgatctcggctcactgcagcctccacctaagaagttcaagtgattctcctgcctcagcctcccgagtagctgggattacaggcgcctgccaccatgcttggctaattttttgtatttttagttgagatggggttttgctatgttggccaggctggtctcgaactcctgacctcaggtgatccacctgcctcggcctcccaaagtgctgggattacagatgtgagccactgctcccggccaaatactttttttttttaaagaaattttcatttagtaaataatgctgagctcagaggtttatgtgtaggagagttatacaatgaaaatgttttattcatttatccaacaaataattatttcatgattaaaaggaattagagaaaagagatgccagagcctattgtactcatccagacatgagataagagttgcctggacttgagcagtggcagcggggctggaaagaatggacctaaaagatagcacaaaagatggattgatagcgtcggaggagtcatttaatgtgcgcggcagaagcgatcagccttgcactatcgttgcttttcttgctgatgcatttttgtctatctagctaaactctaaactcttatgcccagacactaccttttatactccttttacaataggtgccattgtcgttttattcttgtttaaataatttatttaaaatgtattgttccgcagagcatggcattttaaacaccgacttaacatcctctagtaagataatgctaagacttataagaagcaaatgccacttctgtaagtcttcaaatcactcttgtgtttaattttttttgtttgttttaagacagggtctttctctgttgctcaggctggagagcagtggtgcactcatagcttattgaagctttgacctcctgggctcaagcagtcctcccacctcagcctcccaagtagctgggaccataggcatatggcaccatgactggctaatttttttaaaattaaaattttttttttttgtagagatggggtcttgctatg

SEQ ID NO: 126397 - DNA, 1001 bp, Homo sapiens
aaactgattagtgtggctgtgttccaataaaactttatttacaaacacaggcagtagcttgccaaccccctaactagagcgtagctgtcactttgagacctgagtaacttctctgtaggattacacccttgcaagaattctgcccgcagcatttccgagtttgcattataaccttgtgggcagggcagtgaaagtactgttatataggaaagttaccgtctcctaggaattttgttttaagaaaaagattctaatactaaagtatgacatttgttgaatattttttattggcagtaggaaaggaaaattgaaattacatacaggaactccaaaagcttgctcgtgctcatttttcttctattacagattgaacatttaatgataaatgtgggtggggggatttaatatttcagaacagaaggcagagattaattttattttgccccctaaaatgtaatacattttctctctcttcttgccccctgccctgccctttcccactcctcctctctgtccctttgctgggatagggaaattgactgtaaggggattatgggtctatgtgggagggagagataagagggtctcagcaaaatgccaccttccaaccctgctatcgctgtaagcagtagggaaaggaaggggtaggtttatagctcccaacccatgatcaactagttctacttccttgattgtttgatcatggtcaatctgtagaggatccatttctgaagagctttgtttaaaacggccccttctctaaacaccttagagttttgcacccagtgccccggatcacccgctggaggccacagaggacaaacgctagttgcagtgtttgtgagctgcctttgctgaacagtagtgcgcgtgggaagcatcagcaattatccacctgtttctcaccatccctttccaaactgacttttactcattcatggccatggagatatatttgccagtctttgtcaattcatcagtttttttccaggaagtccttt

SEQ ID NO: 126398 - DNA, 1007 bp, Homo sapiens
ctctgcaaacatctgtgaatgaccagggaggtgccacgagtattgatttttggggttacaaatacattttagcaagtaggtgaattcacaaatacagaatccaggaataatgagaatcagccatactcgaaagactagaattggagtctgtctcagtttccatatttataaaatgggtataaatatgacacacactggaagtttgtgaatatcaatatggaaaggttaaatgagtaaagctttcattgtattgccagacctttgagtcctcgataggtgatagtggtgttagtagtaattattaagacaagttaaaaataatagcagctatctttatttgatacctatatcattgctcgcaataaccctgaaaagtaggaagtattatctgtatggcacagatgagaacattaaggaccagagaggttgagtaatttggcccatccatcacccatctgggaaatagccaaaccggactttgaacccaggatttgatgacttcaaaatccatatcttttggtctggtgcagtgaataaagattatgtctggcttcaggtcccagatgatgaagttgggattgatattaggctggtgcaaaagtaattgcacctaatgcatccaggtgagggcagaaagtagttagggcaagaggaaagccatgtggggaaggttagacttgctgcccagagctggagacattagggcagagtaatccaactgactaatcttgggatgaaaagacgtttaaaaaaaaattataagactagggtagaagccagagggggctagaacgagaataaagctttagctaggaaccatctggaaagagggtctgggcaaggaacattttgtttgtgagggaggtggtgaattagaggctccttggtttcagatactcccgtccaccatctttctagctgtccacaccttcccttttcccctcttaactgttgtgtagagattattctgagctaaggcagagcagtcttgtgaatgcccagaccct

SEQ ID NO: 126399 - DNA, 1019 bp, Homo sapiens
gtttaattttttatagagacagggtctcacaatgttgcccaggctggtctcgaactcctggtctctagtgatcctctcagcctcccaaagtgctggaattacaggcgtaagccaccacgccctggccataatatttatttttttattgccatttataacttggcttacactgctactggctatttactaaaaatcagagcaaactttgccttattattatgtattgcatatatatttttgaaaggtcactcttgcagttttactaaaaaaaaaataaataaaagtttcagtgaattccggaagtttgggaattctcggtttacgctagccctgtcctgtgtttctgtttggctctgtcctcaggccttgccaccattttctctcggtgaaagaacttggcttcacattctgttcagtttcatgaacctgcctgtcactttgaggcagcgtttgggattctgcttcattagcctttgaactcatgaaccaagttgagaggatttgctactatagacaattatttgatcttcgagatattttgaacagttcccaagtgcaacaccagtggttgtccaaaagacacagagaagtgatgtgaaattttaattatgtaaaaaaaaaaaaaaaaaaaaaaaagaaagaaagaaaaaagccctgtggcatggttgatgtcagtgctatggagtgagccttttagtagtgcggtcaaggacactacttttttttttttttttttttgacacggaatctcgctctgtcacccaggctggagtgcaatggtgccatcttgactcactgcaacatctgcctcccaggttcaagcaattcttctgcctcagcctcccaagtagctgggattacaggcgcccgccaccacacctggctaattttgtattttttagtagagatgaggtttcatcatgttggccaggctggtcttgaactcctgaccttgggtgatccacctgccttggcctcccaaagtgctgagattacaggtgtgagccactgcgcccggc

SEQ ID NO: 126400 - DNA, 1012 bp, Homo sapiens
acagatgggagcattgtgtgtgcattgttgtatacttgctttttgcacatacggatcagggatttctctgtttccttacctcctgatctgcctgcgtggcaggaacattcactatgcaatgactatccctgtgctcgtcaacgttcccgtgtgaccttgcagttaggtgggaccatgtaactacttctggctagcaaactgtgagaagtgagttgtcccacttcggggctgaagcactaggaacctccagctctgccacagaagctgtgtgtcatgtggtggagcctctatcagcctagatccctgagtgattacgtgaagccgaagctggcccttccccccggcccctgctcagacccaacctatgctgaacacgtagttgagcaagaaataaacttctgttatgttaatttgtttctacatcacacagctcctcttgatatagctgatttctttttaatagctgtgaaattcataacactttgaatgaacccagttcagatgatcaaatgcttaagaacaaaaaagcatctaattaaagaataataactttaaatatacaaatatcagatcaatgcatcttatcccaatgtgttgccacgcaaatatctgtatacataatttctaattaaactttttaatttttttaaatttatttttctgagatggcgtctcgctctgtcgcccaggctggagtgcaatggcgcaatctcagctcactgcaacctccatctcctgggttcaagcaattctcctgcctcaacctccgagtagctgggactacaggcacatgccaccacgcccggctgatctttacatttttaatagagacagggtttcaccatgttggccaggctggtctcgaacatctgacctcgtgatccgcctgcctcagccaaccaaagtgctgggattacaggcgtgaaccactgcacccagcccagcccataattaaaaaaaaaaaaaaaggaatatatgcttattgaaaagtataaagaagaaataagtactt

SEQ ID NO: 126401 - DNA, 1037 bp, Homo sapiens
attttagtaggaaaatagtttttaaatggtttcagtaggtttaggggcataatatatccagaatcaagtgatcttttgttaaagagcattatcttgtagtcattggagttcactggcaaatcaaacactttagaaacattttgattgaaaaatcaagcaggatttgcaaaaactttgttcttatctggtacacaaatgaatcccagacacattgtttaggccactttgggtaaaagaatggaattcagggttctacaatgctcttcaagaaaattaaattttattgtaatgtcaaccaattagttgaaatacaagtgcctaaacttttttgtgcttttatgcattgaaatactctcagatatcctggtgtttttatatcttttggagcatgactgcatattgtgaagtaagaaaaactctaattccaaacagagaggaacaaagagactttccttgatagcatgtggaaatatgaggttgtttttaaaattgtagcttgtgggatgtaagggtgacttgtgttttggcattcagatggtgcaactgtgagtgaaatagttgtggtaatagctgttgatgatgttggttgatgaattacaggtgtctcaattgattcaaaatagttaagtctctcaagaaagattaagaaaattgttaagactgttgactttgtcaatttgtaccagctaagaacctcacttatgtgaggcaggcaaaacttttgtttcaaaaaccatataacacagttgctgtgataagatggaataagtggtcagtttttagctccctttgcatttacattttccttagggtctgcctcaagtttaggaagatacagttaaggcagttctttgagatgaattattggaaggtgtaggatgggttagaacaaatgctgttgcaaaacttgaattgcaattatactttaagaagaatcacattctgccaaatagaggtttttgtcattgattttgtgatttgatcacatttgtgttgccttttagaacaactttcttttttcaaatccattttttttt

SEQ ID NO: 126402 - DNA, 1146 bp, Homo sapiens
caatgtagatacatttttatttatgtggtaagataaaagtaacatttttgagattgtaatacttgtaaagcttttaacttggttctgatttacagctcagtctgtaattgacatcagattggtttcagttatcttgttaaaagcgaaagcaactgattttgtgttagaaatatgatgaatgttttagaaggaataggttttaattgaaatgtttatgtctggtgtatgtatattaatcaatcctatttgccaagcctgagccttgaaagggaggacttggtttctcctcctaccaaattatttttggatttaggaatttagattatcgaagcaagaatgctttgaggaatttttggatgacatttgatagggaaggatcaggtgatgagtgttgtttctgaaacaccttttccctttccctttccctttcagtagatgttatgaatggtttgagaggatttgtgagtgtgatcatccttacaataggattgcggtttagcggtaatggtacacatgcaatgccagtacgtggaaccttagtttacctcgaaaggtttgaactagaagtttgttgacggtggaataggttttagtctcatctttctggttaagggaagtttgaattctcacttctgggatgttgagaagcaatctttcaaaatttgaatacttttgttacaggtttcagagtttatttccatgtttgttatttggaaaaaaaaaaaagactgttaaaaatgagggatatttcaaccagtcaatgaatagacacagagcgaaattcagtgcaaagatagtgaagatggcctggcgccgtggctcacgcctgaatcccagcactttgggaggctgaggcagatcacgaggtcaggaggttgagaccatcctggctaacacggtgaaaccccgtctctactagaaatacaaaaaattagctgggcgcggtggctcacacctgtaatctcagcactttgggaggctgaggtggggcggatcacgaggtcaggagattgagaccatcctgactaacacagtgaaacctcgtctctagtagaaatacaaaaaattagctgggtgtggtggcgggcgcctgtagtcccagctactgggtaggctgaggcaggagaatggcttgaacctgggagg

SEQ ID NO: 126403 - DNA, 1009 bp, Homo sapiens
accctcttctcactcccccatcctctttcgtttctccctcacccccccacaccgtcctcctcccttcttcccctagccccgcccctcactttcaagccccgccctcattcctgcctagccccgccccctcgctgctgtctggcgaggcctccaccctttctttccttcagcctgaaattcctcaatcctatcttgtagctgctcccagtcctgctctcttcacttccccctggtccagccctcttcagtctcagtctgggccacttcctgtctcttaggccagaccgctagctacttttaactctgcttcttcaatttttaccttttctgcattttgtttcaccatcacccccacactcagcaacccagagcgccgtgaggctctgatccctactcccacactcactggaggctttggaagctgcccacacgcaggctccttgattcattttgtcttcaatgaaaagtccgtgtttcctgggtggctctgtagtgccaccttcaagggtgagcgcaacgctctgccgcgggcctgcgacttggtggcgcggatgtgatgccaacctgtttccccccgggctccagaggttctggaccaggctgcatcctcgtcttccctttctcactctcattggtactactctctttccagtttcaattcatccctaaagcaggatggccgtgttgcaaatgcggctctgctccgggactttccaaactcgaatatttccagctctggaaggaaactaaaaagttcattctaatccccgtcagggattttcccctggatttttctgttcagtggctcagtcgggtgagaactccaaagtcctggtttggtcaggtcctttcaaagagagaatgagcgttttgaacactttatggcagatgcgcagccataaagtcatcggtaaaatccatgcaaacaataggtaatttttttaaactaaaatttactttgagagcccatagttgttgcatggcccaacttttgtcttaagagaaggtt

SEQ ID NO: 126404 - DNA, 1026 bp, Homo sapiens
cggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacaggtacggccggcgggaggcccacccgcgccccggcgccccctcgcccgccccggaattccccgcagggcgcccttggaagcggccctcccccacgccggccgttgtcccaggacctcgtcacccccttcggcgtgcgcccctcgcttctccctcctggccccgccccctcgccgttgcccggccccgccccctggccgctcgcgccccctcggtctcgcgttccctcccgttcccccgcacctgccccctcgcatctccgtcctggccccgcccctctcatttccattcatggccacgccccttgcatctccttccctggccccgcccctcgcttctcttttcctggccccgccccttgcatctccttccaggccctttcccctcacctctccccggctcggccccttgcctctcgcttcccttcctctccctagcacctgacccctcgcttctccccccaggccccgcccccttgcctttcacctccatccctgtggtcctttctcttccccacctttcctccccaaacctgaccccgcccatctctctggccccaccccctcgctcctctctgctcccgcctcctaactttctgtccccgccccctcgcttctccctgcgtccagctccctcgcttctctctggtcccgcctcctcacttctttcctagcctgggccctcacttcttcctggtcccgcctcctcacttctttcctagcatcggccctcacttcttcctggtcccgcccccttgcttctctcctttttttctcctccgccgtttttaccccctccctccttctcctcgcttcccatcctctccgcccacctgccccctcgcttttccctcctggccttgcct

SEQ ID NO: 126405 - DNA, 1045 bp, Homo sapiens
ccagactggagtgcagtggtgtgatcttggctcactgcaacctccacctcctgggttcaagcgattctcctgcctcagcctcccgagtagctgtgactacaggcatgagccactgcgcctggctaattttttttttttttttgtattttttgtaaagacagggtctccatatgtggcccaagctggtctggagctcctaagctcaagctatcctcccacctcgacctcccaaagtgctgggattttgggtgtgagacaccacacccagcttatatggctattttctcccacaaagtattcagagatcttctggagttcatctgttaatcacagttaaaggaagggaccatttcggaaaactcctattttggacgcggagtggtgatactttgatctagttgtctcatccaatgctgaaacaaatcctatataaagaagtttaaaatggtctgctggtgaggctggtgcctggactggagcctgtctgaatgttgaggagggtgtggtgaccttgttggagtacttgatgttgctagattggctaatgagagtgattaggaactaggtgaatcacggtcttgaaaactgaccctaaacaggggacagaaatgcccacttttgtgggcattttcaagctccaaaggagtagggccaagaatttatagcatatgtcaacgtttccaagctcagaggaaactaactggtgggttctatggttggtttaaaagccttgagttggccaggtgcagtggctcacgcctgtaatcccaacactttgagaggctgaggcgggtggatcaccaaggtcaggagtttgagaccagcctgaccaacatggagaaaccccgtctctactaaaaatacaaaattagccaggcatggtggcacgtgcctgtaatcccagctactcaggaggctgaggctggagaatcgcttgaacccgggagacggaggttgcggtgagctgagatcacaccatttcactccagcctaggcaacaagagcaaaactccatttaaaaaatagaaaagccttgggtcaaagg

SEQ ID NO: 126406 - DNA, 1050 bp, Homo sapiens
gtggattatgggccaggcacagtggctcacacctgtaatctcagcactttgggaggctgaggagggcgggtcacttgaggccaggtgttcaagaccagcctggccaacatggtgaaagtccatctctactaaaaatacaaaaattagctgggcctggtggtgcacacttgtaatcccagctactcaggaggctgaggcaggaggatcacctgagtccaggaagtggaggttgcagtgagctgagatggtgccactgtactccagtctgggcaacagagtgagactctgtctcaaaaaaaagaaattatattataatcaactttcacttatcaaatttggttttcatagctctctagaacagttctcatcctgcctccatattgcctttttggaatagtccaggccagttcttctatagaatggcacacaccctggctttaactgtttatttcctccttgtgttgcttgactagttcctttatcctttatttcttgtaaactgaaaattagatctgaatcttgattggatttagagtaaatatgtttggcatagagacttcattggtaggttgaccatattcccaggtttctccaggatagccctgtgacctgttgtgttggcataattattatttatttttgctctcagaagtgttctggtttggatggtacgttaagtcactatttataagtgacgatgtgtacttcatgtggactgccatcaggaggcccatccagttagattgatccactatttataacatggtgattacgtggtgattgccagatttcttcaacgtaaaggcatctttttctctttgtagttaataagcaatctgtgggatgataatttgagactaggaatatcctgtacccatggtttaagagtccattgacgaccctgaacagaataaattccacattagttgttacaatgctagatttattcagatggttaagttttgacaatgagatagatttttttttttttttttgagacagaatctcactgtgtcgcccaggctggagtgcagtagcgcgatgtcggct

SEQ ID NO: 126407 - DNA, 1024 bp, Homo sapiens
gaggccaaggcgggtggttcacttgaggtcaggagttcaagaccagcctggccaacatggtgaaaccccgtctctactaaaaacacaaaaattagccaggcatggtggcagacgcctgtaatcccagctacttgggaggctgaggcaggagaattacttgaacccgggaagcagaggttgtggtgacctgagattgtgccactgcactctagccagggcaacagagcaagactcggtctcaaaaaaaaaaaaaaaaaagagtaagagaggcctgtcgtggtgaacactctgccaaggaggtgggcggtgggcagtgcatcctccagggactgactgagtcttgtttcagggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcacgtaggtgccgtctgtagagaggtggtcaggtgacaaggtgccttcctgcccctcgctgtttccttactgggttcctacaaaagctctatgcccctcaggcccagacattctttcagggacaagtgcagcaagaagtctgtatcttcccgaccgccaggctctcatttccagctcgtggtagggagggagtcgccaccacctggtcattctgtccttcaaggtgcagattacaaggcagcagccagcaggagcagtgcagaccttgttgcaatctgaggtggtggggcctcagggcagctgcttcctagggtaccctttctcagctactcgagaacaaaaggagacattcctgaatgctgcgttcccacagtagtgcacacataacagaaagcgaagttacagcctgttggaaaaggtaactgtagctgtcgtttcaagtaatggatacaaataagaagattatttaattaaaggaacagaa

SEQ ID NO: 126408 - DNA, 1210 bp, Homo sapiens
gtaagttctagacatctcaaaggagaaagaaaaatattgtctgagcaatggatgattgtcttgaaagcttccagataattaggctaagacaagttgtttcatttatctgttcccctgcttagcttggtcggaatctagtggtgtgtctgctgctaacatttatgatgattcacttcagactcaaggagggctgttggcttatctgcactggctgtcttggaggctgatttgagaggttttgtttggagctatggaattcagtcatgcttcatcatgcctctggtttatttaaaaacaaacaaaaatactgttttcgccatggctgtggtcctacccacaacctgctcccagcatttgagtgctgtgtgggctgggtcattcctgcttccccaggtcacgctaaccaaggcaagttcttaacttctccccttgccagttttgtctttcctggacatctggtaataatatgctttggggtattttctgagccagattgttgcagcctaatgttcatggataagttcataatcaggagttaaaagataattcatttcctggtggagcgtggtggcttatgcctgtaatcccagcattttgggagactgaggcaggaggatcacttgagcccaggagttcaagaccagcttgggcaacataatgagacccgcatcccagctctatttaaaaaataaagaagaagataattcatttccttaagctgcccttacactattagtcaggaatgtttgtgttcacttccactacataccttacgatctcttttgctttgctttttttcagtcaagtctctatttatgaggtggacaagcaagattgtcgcaaattttgcactactggcatcgatggagccatgacaatttgggatttcaaggtattttctacctaacagaacaaattttgtttgtgttaaaacttttttttttttttttaagagataggctccttctctgtcacccaggttggagtaagtggcacaatcatggctcactgcagccaccaactccttgcctccagcagccctcccacctcagcctcccaagctgctgggacagcaggcatgcaccaccatgctccgtgaatatttttacaaaactcttatgagaagaatgtttctcatttcttgaaacaaaatgttaaatctagtatacagtttaatgtcctaatgtaagacattaaactggaaatctct

SEQ ID NO: 126409 - DNA, 1053 bp, Homo sapiens
agtggggaaaaggcacacctggcctggaggagccagcagggggagccccggcctggagtgtctctgcggggtgagtcctgggagatcctgtttcaggtggggcagggccaggttcagggtggggacaggcagaaccttccctgaggaagagggagtggtgtcatacctacctcggggtagacactcctcagtgacatcagtgctcttcccaccttttccaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtggttttggttttgtttccttgtagtatttcaatttttagtagaaaaatatgagcgaattcttcattcgattcagttttttttaggcaaaatcttagatccttggtttcttaaattgtaccattctatacaaccttgaaccaaaaagcaccatttagtgaggggtgagagagaaccgtttctgaacattgcaatacttctgcaaagtaggttgtgtcggtctgttttgtgttgcaataaaggaatacctgaggctgggtaatttgtttaagaaaaaagatttatttggcacacggttctgccggttggacaagaagcatggtgcctgcgtctgcttttggggaagcctcaggaaggttttactcatggcagaaggcgaaggggaagcaggcgtgtcccatggcgggagaggatgcaagagagagtggggaggaccaggctccttgaaacaaccaggtcatag

SEQ ID NO: 126410 - DNA, 1052 bp, Homo sapiens
tacattttatttatttattttaatagagaaagggtctcgcaatgctgtccatgctggcctccaactcctggcctcaagcgatcctcccgcctgggcctctcaaaatgctaggattctatgtgtgagccaccgcgcccggccgggatgggtggtggtagcctccgggctgcattggcagaggaggcagggggaggtctgactccccaggcttgcactcctgatcccttcactgcccgcgggtgcagcccggccccgccccgccctaggcggcctggctgctctcccagcgcctccggaaagggaggggctgctcggatctgccctggccgcggagccctgcagctgagggggtgcgttccgggaccccgccagccaggcccgccccgtacgggacccctcggacctggcccgggggaggcgggtgggagcagcgggagcggccaggagggcaggggcggggcggcaggagacgccagctcatttcccggcggctgcaacccggaaggctccggggatggaggggaagtgactgggtgtggggccccgccggcccgaagtaacggggctacaccgaccgaccgcggggcaaggctggggatgggggccggggagcaggggcggaaggcacgaggcggaagcttggggccgggggctggggacgccccgagggcgcccggtgcgctgggagcccgcgtttccacagtctggccctgcggccacccccgcgccccctccaatcccagggctccctctcctttccgtgagcccctcgtccccgcgccccctcctctccatgtgcccccactcatccccgtgcccctattgggcggcgccccacatctatgcgtcctcacttccaggcgccccccggtcccctccttgcaccccctctcatccctccagtcccgctcactcccaggcggcgccccacatctacgcgcccccccacctccaggtggctcccctgacccccacctccgggcgcccccacggccctcacctcccgcgccccggccgcggactctgggcagtcgacgcgccgaaccggctct

SEQ ID NO: 126411 - DNA, 1027 bp, Homo sapiens
ggcgacagaatgagactacatctcaaaaataaaaaagaaaaagaaagaaaaatgtgttgctgttttcttaggaccaaatgggtgtatgtgaccaaagaatgttaattttctttttcttttttttttttttttttttgagatggagtcttgctctgtcctccaggctggagtgcagtggcgcaatctcggctcactgcaagctccgccttccgggttcacgccattctcttgcctcagcctcccgagtagctgggactacaggcgcccgccaccacgcccggcttaattttttgtatttttagtagagacggggtttcaccgttttagccaggatggtctcgatctcctgacctcgtgatccacccacctcggcctcccaaagtgctgggagtataggcgtgagccaccacacctggccagaatgctaattttcaagttcctgttagtgttattctgttctattaatatttggtcccacccacttgttgaattgagtgcccttcagaagaattaaaccaattagcaacaaatgacaatttctccacagctctgctagcattgaattttgtgtgtttttgttttgtttggatgactaaccggtgctttaatggtaccttacgattgttttcatgtgtgtttcttgacttcactctgcgtggttggtaagacttcaagagcagagctggagagggaaggataggggtaggaagggctctgacccagcataggaagttgagtaaccgcttagcacggtgcaaattagcctgctggctgctctatccaagaactgcctgagctgggtggggacttcccagagcgcctgtaatgctgagatctttcctccaggcaactcctccttggtttagcctctgatacagccaaacctctggattcagggaaacctaaggaagccaggcaagaagggtcccgcagcctgtgcctagtctagccccagcctcatctggattaagatgggagggaaatattggctgagggcacccagccagtatgaagacagctagaatgt

SEQ ID NO: 126412 - DNA, 1050 bp, Homo sapiens
agcctttcagacctaaagttctagggttctggcacgtgtgttgggagggggtggggggttgctttgttttaacccctgcccttctcccacccctcagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgtttgggggatggggggggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaatctttgttttggcaatccatcctttggcttccgtgctcgagccgtttttacccagctgggtacggtgccacgttcaggcacgtgcacccggcaaggttcagggcacatacctacctggggcatgacatctgtcaggtggcaccgagcaggatgcggggatggaccctagataccacagcctgccccctcccctcctt

SEQ ID NO: 126413 - DNA, 1050 bp, Homo sapiens
tgtcttggcctcccagagtgctgggattacaggcctgagccaccatgcccagcccttccttccttgtaggatgtggtccccactgctttcatcctcctggtcatcttctctggaacactcttggcctggtcccccttctctccatggccgccagagcctgatcatgaagccctcaggcatcttcccctccctgctgtagctggacattgtcccctttccctctgaggctttctggacatcgcagatgttttctccctgggcctctccctcctgctcacttgcttggtgaacgtccaccaagcagggggttcatggaggcagggactcacagccagggcaccccttccacctcggccctaggccgaatccttggcctttattctgactcccgtccagtttggcaaacagtggtaggaaagatgtccccatgacaccattttatccacacagagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaaggtaagggctgggctgcgcacgcagggacaggccccaactctggtcctgggccagccacaaagcactgaactcgtgtccctgtccgcgaggtgacaatgaggtgaggagtgactgctgcctaggaggtcgttcaggagagggccaccctccctgtgcctgccactccctcggggaccaggagggtccagcgacatcatggggtcggatgtaggttgaagtctcagcagagcaccgtccacagtaggtggacagtcactcctgctcccaacagcgggaggtcacaggaaaccatgcccctagtacagaccttgcctgaggctcacaggtcccactaaggtctctggtgccttgggaacccaggagagatgcctgaggtcaccgctgtccatctgcagggcttgggagggtgagctggatacacagcagtgcagactggcttgacatccag

SEQ ID NO: 126414 - DNA, 1090 bp, Homo sapiens
gtagcttattcttgggttacaagtccagtccatcagctaaggtgggtgggaattggaattagtcatgacagcacacacttggcccaccctgccctggggattccagcccagcgctttttgcaagaagaatcaggcatgggattccatggaaaactgcttttggaagccgagcttgaagtaggggagtagtgctgtgtgagtgcttgcaagtcggggtagggcgcacctctcatctaccacctacttcctggttgacttgggcaagttattcgaccccgagcagccgttctgtgggctcttcccaggctgatgaagatgctccagagagctatacccactgtgagacttgggctgagcactacgtgggctggggtggagcaggagtttgtcctcatccagatgggctgttgagagatggcaggagtggccctcaggggctccacaggacctgaactccaacaaccagcttcttgccctgttctagcaaaagcgcaaaggcgttgaagggctcatcgacatcgagaaccccaaccgggtggcacagacaaccaaaaaggtcacacaactggatctggacgggccaaaggagctttcgaggagagaacggtaacatcactggctgggccttgtgtcacggggaatacaggccagcagttggcctgtgggatgctaaggtccccagctggctgggagctgtggctgtttatttctgtctcattccccaatggccctccagtagcctttaaaaagccacacagaatttgttttcaccaattgatacatgatatcaggggaaataggacaacaggctcagacctgagcataacacttgaggtaatggtgcaggatacagagggttgccctccattcccctcttccagagcaccacaccctggggagacttcccttaccccactgatctgaccattcctgacctgcatccatctgtaatgtcgtggccatggggactggaagggggctgcgagcctgtgccggccagaaggcagtccagcccagcgcagctcagccagctgtcccaggcctctgcaagtcctgtgtgaaaatgaagctgtaaatatcttcctcaaga

SEQ ID NO: 126415 - DNA, 1124 bp, Homo sapiens
gttctggggagctggtgcaggaggtcacctgtgtgggtgggtcggggggatgacttgccatggagtgggagtggagtgcggagaggactcgcctgggaatgccagcatgatttggcagctgcatgtggcaggtgggagctgagtaggatggtggttttcagcctggtggctgagtccttctgaccccaggaaacaagcttctcaccctggctgctgaggtggctgcgttaggaaggggagcagggccttctgtggctgtgtgaggggcttcctggactatgggaatggcctctaagctgtggtgctaagtgcataggctgcctgtgtctggcccaggtcccattccctgggggccagggtcacagtaggacccttgtcatccttggttccagccttccagaggcttgatttctcaagatccacagtctggggggtgatagggtcacagtcttggggatttgttttgcatttttgattctgcaggttgtccatttctgaaacaggaagaagaggagcaaaaagaaggtggagatggggctgcaggtgaccccaaaaaggagaagaaatctctagactcagatgagagtgaggatgaagaagatgactaccaggtactgagttcttttgagggcctagagcctggactcattcattcaacaaacaaacgttgagtgaccgtttagtactagtcccaaaggtagatgcagacaacgtccttgctcttgagggtttacactacgggagatacaacaaagaagtaaacagacagtgtcatttcaagtaatgagaagtgttactaacaaaacagactgtgattgaggggacttggaaaagtgttgtggtggtgaagcaacttataaactgagatctgaaaaaacaagatgcagccagctatgtgaaaattggcgtgcagagcaattgagaaactggattagcaagtgcaaaggtcctgtggtgggaataagcttggcatgttcaaggaccagaagggggccagtgtagctgtgagttagtgggtaaggagcggagtggtccagatgcaggaggagaattggcaagggcacctcctgtgtagctgttgaaggggttggcatttcttttcttttcttttctttttttttttt

SEQ ID NO: 126416 - DNA, 1021 bp, Homo sapiens
gtctcaaaaaaaaaaaaaaaaaagtgcccctggctgtgacagaacatcgtgtaaaaagcccttatagtgacggcagggatgtaagtggtacatgtttctgtggttgcatctgagtccactatgcttggattgtaagggaccaggggatgtagcaagtcattgcagtgcaccgtccgccatgttctcccctccggtcttctgtgtaggagccagcatttagtacacagtttggtgatgcatcagatggtcacgagttgcttcctgcgtgcctttgaacacatgagggtggcggaggtgtcggtttgggtggtgctgggtgaggggtaggtgaggcctccgatgagagtactccaagcaggacacagccctctgggggtcagagcagtcaaggcagctgcttccgctcacctaaactgcgggtctctgcaggaagaaagggaggccacaaaggccgggcgaggcagtatacaagccctgaggagatcgacgcgcagctgcaggctgagaagcagaaggccagggtgagtacgtgcctgtccaggccacgccagtggcccagggtggcgctttgccaatttggttcatagagaggccaggcaaggactacccattcgcagggacaagccagcacgtgggggtcgggcgggcagtgagccccaggtgtgagtctcagaacaaccaatgacagtcagggcgtgggcatcctctgcctggatgggttagaaagaactgtggctgctctgcagcagctgctttagtggggccctgttcttggtcttgtgcacctactttcaggaggatctccctcctgcaggacctgtccattcacagctcgagctcccagcacccctgcttgtctgctgcagccacacaggatgatttgccacactgcacatgacatatgccctgccttcccacacccccagcatcagcatgctctccatccctggagacgttgtttagcctctcctcctctgtgactcatgcctcacctccagccagagctgatttagtagttccc

SEQ ID NO: 126417 - DNA, 1042 bp, Homo sapiens
cgcaatgcctaaaggaggtgaggggcgggcgccggtggcccgcaggcctggaggggcggcccaggtccggcttccgctgtcccctcagcccgtgcgcgtctctgagagcagcgcagagggaggctgtccgcaccggctgagagccaggcctgggcctcgacgcccaattgtcccgatggggaaactgaggactgtggtgtcccagagtcactccgtcagtggtctgaggagtttcggaagctctgggtcctcgccggcctagaaagccggatctaggatgcgcttctccgggtctaggggttctggaatttatcccactctttggctggctaggaactgagtcaccgcgtcccgcgcttgtgccgggcccgcctgcctctcgcgtaaaacgtgggctttttctggcttcggttcagccaggcctgcctaggaggacttaaggagatgcccatgagccttccagacctggtttcgactcccccgttcggtagcggctcggtgtgttcctttgagccagtcgctccacctcctgtgtctccgttttctcatttgccaatgggaataacgattgtacctacctcttagtactgttgggaggcttcaactaggtaatccacgtggagtgcgcagtacagtgccaggcagtcgttaaaagtgcccagtgaagcagtaactattcttatttttaaggctttgccagctcttgatcttgtaagtaggttcatgactgcccagtccattgtagcccgtcctctatcttctagcccgttctctatcctgtttccccctttagaatcgatagtccccagtttgaatcccagctatgtcacgtctaattctgtggccctgaacaagttaacctcttcctcatctgaaacactgggctaatccttagcttgttgaattggggccggggtggtaaaattatagcgctcataaagtgcctggccacctcctggcacagaacaaatatatttgtgttggtagctcatgtgttatattggttaatgcactcaacccacagaaacatctgcctgtagcg

SEQ ID NO: 126418 - DNA, 1003 bp, Homo sapiens
gagaccagaattcacctatttttagcttcagcgtaggggagactagtgcgaagaccactgatttgggagtcaggagccctccagagtcaggttttgcaaattctcagctgtgtgaccctgattctaccttatagagtttgattcctcctctatatggttgttttagagagttcatgagaggaggctctgtgggcggggggggggtgggtctttgtaaagtgtcagtacagaagggagtgactgaatgaatttgagagagatgaatctgttatgctgaaaggtaaatacttaacctgggttctctctggcagcaaggaaatgctgtgtggtttgaaaaacgctttgctatttagattgggatcggcctcttgtatgggaactacctgactttatgtaatatgttgtttggtgtgaaagagaccttggcaatcagccaatccactgccctcattttacagaagaaacaggaccagagagggaaggtgacctgaaagtcacagaataattttttagagctgaacaagaatccaagcctgcaactgcagagacgagagatctttctgctgtctatactcttggaaagcacatcctaaggtactttgattttacagtcatctttccctttttattttatgttttgttttgttttgtttgttattgagacatggtctcactccgtcacttaggctggagtgcagtagtgtgaacatggctaactgaagactttcaacctcctgggctcaagtgatcctcttgcctcagccttccgtgtagctcagaccacaggcacccaccaccatgctcagttaatttttttgatttttttttttttttggtagagatagggtttcacctcattgctcagactggtctcaaattcctgggctcaagtgatcctcccatctcagcctcccaaggtgctggccaagaccagaattacaggcatgagccaccgtgcctgaccttccatctttgcctttttaaatactcacccccatggctc

SEQ ID NO: 126419 - DNA, 1020 bp, Homo sapiens
cttctaaggggcaaaggcttaacttttgttctgtgttcccaacatccagtatagggttaagcttttagttgaagttagctaatgacaacagcaaatgtctcttaggcacacattatacaccaggcatgatagatacaattctaatgaagtctttgcaatgaccacataaggtagcttccattatccccattttacagatgaggaaacagaggcttaggaaggttaagtacctttctgaagatcacagcgggtaagtagcagagccaggatttgaacacagtctgggtgctgagccctgtcccatagctgtgaccctatgctgactcaaggaagtcagcctgtaccgaaataatggctggcaaaggcctttggggatttgagactcagaaaccaattcatttttttcccccagatctttgcagattatcctgtggaaggaaaatgcctaaagtcaaaagaagccggaaagcacccccagatggctgggagttgattgagccaacactggatgaattagatcaaaagatgagagaaggtgagtaggggagttcctgtctgggtgggctgggtccaagggtcacaggcttagatgcccccaggggacaggcataaatgcaaatataaaaagagagtggtctactaacactgacatgttgtgtttgcttatgaacttggggaaatactgtaagtgcccgaaaataagataacattaatgaaaaggtcctcagaaaaggtgtttttttttgtttttgtttttgccaactcgaatataaaaggttatgaaatatagatcaaatagtctacctatagttatttactattttggttagatatatatttaaaatcatacaaaatatatttacttggaagtgctattccttttcagtatcatcgattagtctttgccgcatctgttttctgtcacttccttgtaaatggcgtgtgatcctgctttgtgaacccgtgtcctatgctgtctttggaaattttatctgaagccacaagcatctgttggcctta

SEQ ID NO: 126420 - DNA, 1049 bp, Homo sapiens
gactgaaagggacaggaactcactggttgtccttccctgatgtcaccctgccaccaccttgggattagggctccccaccaccatttcctaagtgaggaaaggggttcagtaatttgcccaaaagtggagttgagattgaccccagacctaacaaacacacagccacacgctgcctcacatggattcctgaatacagggacccactcccacgagggagagccagcaggacatccagggacaaaacgacattccagcccaaccaaataacataagatcccttgcagtcgactaaggcagaattttgagctgaaaacaacaccaagcttgagtgtcagacattaccacttccagcttgcttttgggcacgcggcagatgcagttcgtcccgaagttggtgtcccgtgtctgaatgcaccgcaggcagcacaagttctcatatccttgctttttccattttgcaatcaggtttttgtctgcatagccttctttaatacaatattcatagagttctgtcaaaaagatggggaaagagcatcaggccatggtctaaaaaccttccccacccttgatcaaaaaaagcattcaggccgggtgcagtggctcacacctgtaatcccagcactttgggaggccgaggcaggcggatcacctgaggtcaggagttcaggaccagcccggccaacatggtaaaaccccgtctctactaaaaatacaaaaattactcgggcgtggtagcagctgtaatcccagctacttaggaggctgaggcaggagaatcacttgaacccaggaggcggaggttgtagtgacctgaggtcgtgccactggactccagcctgggtgacagcgaaactccatctcaaaaaaaaaaaggcattcagtattgcaacgggacagtccttggaggaggaacaaaaaaaaaaagtacttaggccaggcaaggtgcctcacacctgtaatcccagcacttttggaagccaacgccagaggatcatttgagttaagaaaccagcctgggccaagggcccatctccacaaaaaatttaaaa

SEQ ID NO: 126421 - DNA, 1037 bp, Homo sapiens
tacaggtgtgaggcaccttgcctggcctaagtactttttttttttgttcctcctccaaggactgtcccgttgcaatactgaatgcctttttttttttgagatggagtttcgctgtcacccaggctggagtccagtggcacgacctcaggtcactacaacctccgcctcctgggttcaagtgattctcctgcctcagcctcctaagtagctgggattacagctgctaccacgcccgagtaatttttgtatttttagtagagacggggttttaccatgttggccgggctggtcctgaactcctgacctcaggtgatccgcctgcctcggcctcccaaagtgctgggattacaggtgtgagccactgcacccggcctgaatgctttttttgatcaagggtggggaaggtttttagaccatggcctgatgctctttccccatctttttgacagaactctatgaatattgtattaaagaaggctatgcagacaaaaacctgattgcaaaatggaaaaagcaaggatatgagaacttgtgctgcctgcggtgcattcagacacgggacaccaacttcgggacgaactgcatctgccgcgtgcccaaaagcaagctggaagtggtaatgtctgacactcaagcttggtgttgttttcagctcaaaattctgccttagtcgactgcaagggatcttatgttatttggttgggctggaatgtcgttttgtccctggatgtcctgctggctctccctcgtgggagtgggtccctgtattcaggaatccatgtgaggcagcgtgtggctgtgtgtttgttaggtctggggtcaatctcaactccacttttgggcaaattactgaacccctttcctcacttaggaaatggtggtggggagccctaatcccaaggtggtggcagggtgacatcagggaaggacaaccagtgagttcctgtccctttcagtcctcacagtgatactttaacattaccatcactatctttcccgcccccccaagacggagtcttgctttgtcgcccaggctg

SEQ ID NO: 126422 - DNA, 1753 bp, Homo sapiens
tttctggctggccaagtgttgggccgcaccaggcctgggggacaagacccttctttctggggggctctgggccagaagggtgtgactcaagtgcatagtctcctgccctcttcccccaccagagtgtaccagcccagaggcccccctgaagtccccaaacagtagcagagccacgtctgctcatcgcagggtctgtcatgctcacttagcagaataacgagactcattcacaccgatttctttttcttgattggcaaacgtgtgttggatttgcagaacatattataaatagacatacagatgtaacctcggtgtcaacagcagctggttctaccttcatgagggagccaaattttccctgtccagagctgtcaaggaagggtttctgaggtgtgtccctatatggcatggtggcaggtccttcgtgggagggttgccacatatgtgagtgtgcaggggcgagcgtggcgcagtggcatcgtctcactgtcctcctccgttgcagggccgcatcatcgagtgcacacactgtggctgtcgtggctgctctggctgaggctggcgcgctccaccctggactctggacttcgcaggttcctgcctgtcacgccacccccttcctgggagcagcgagcagtgccccaggcccgagttggagcacggtctctatggggaaggcttcgctgtctatcagctgtgatttgtaaaaataaaatctttaaatctctcgagccccacgtctcttctttcagagcatcggcctatggaacccggcggggcggcccaggccccagggaccagatgccccagcccccttgtggtgtgtgaggtgacacacaaaggtagctggagctggaagtcccgtgaaggtgacacgcaaaggtggctggagctgcacttggacctgctgggagcacaggcaccttgggcctagtgtgtgtcctcaccaacacctgtgacacgctgcggctgttcctcagggcctggctcttcccccaggcaggaggtgacaccagctcacttgtcctggggctcccacagagcactgggggccgagcacattgttccagctgtgctcccatcacctgcccccaagggcacatccgtcatcagcctccttgccggtgtcctggtccccctggggcttggtccggaacttctgccaggggtgcggggtttcctctgcgggcatcactgtcagccactgcttgtaataggctcggaagccgtcaatcttctccaggtaggtgttcttcccttggtactagaattagaaaagtgaggctagaatcactcctgttacctacagctaatcccaaacctcggcagctggctcaggcctcagggaagctggtggctgccattttcccttccaggtggctgcagaggacagggcagaaaagctgtgaacacgcactatgggactagcttacttcagagaaacaggtccccgctgggtaccctggggcaggcccagagccatctgcccaatggcgttcttcccaaataggcaccactgtgctcctccatccgcagttgccaccccaggcccccaagccagaatcactgggtcccaccagctctgcctccacagcctgccgagcccctccccatcaaagccacctccctctgaccattatctcaacactgccaagataggctccatgagatatggggaaaaaagcaaagacacaccagacacaaactgagagctggtaggggaatataccaaaaaagccaaaaagtgctatcc

SEQ ID NO: 126423 - DNA, 1560 bp, Homo sapiens
atgcaacatccgtacacaattttttttttctatttttttgagacagagtctcgctctgtcgcccaggctagagtgtggtggtgcgatcttggctcaccgtaacctctgcctccttggttcaagagattctcctgcctcagcttcctgagtagctggaattataggtgtaccatcatgcctgcccaatttttttgtatttttagtagagatagggttttgccatgttggccaggctggtcccaaactactggcttcaagtgatccacctaccttggcctcccaaagtgctgggattatagacgtgagccaccacacctggcccacatacaattattacaggctggtctcgaactcctgacctcgtgatccgcctgccttggcttcccaaagtgctaggattgagccaccgcaccccaccccacatacaattattaaaagagcacacccggaggggtaacaagatggtaactgagatggtggagctccataagctgaagcttgctaaactaaagcaagaatgtcttcttgtggtttggagaccaagggaataaagcaagatcttatccacagactccaggcatatcttgaagaacatgctgaagaggaggcaaatgaagatgtactaggagatgaaacagaagaagaaaaaaaccccttgtcaaataggaagaaccccctgaaaaaaactgttgatgtggcagcagagaagaaagtggtgaaaattacatctgaaataccacaggctgagagaatgcagaagagggccgaacaattcagtgtacctgtgagcttggagagtaagaaagctgctcaggcagctaggtttgggatttcttcagttccaacaaaagtctgtcatctgaacacacctatggttaacttggataagccgaaggaaagagctcaaagatttggtttgaatgtctcttcaatttccagaaagtctgaagatgataagaaactgaaaaagaggaaggagcgatttgggattgtcacaagttcagctggaactggaaccacagaggatacagaggcaaagaagaggaaaagagcagagcgctttggcattgcctgatgaaaggttcttgatactttctgttctccagtgttttccacttctctcattcttcttggtcacatatatactaaatgcagtcttgccttgcaatgagggagcaggtaccccaggtaaaactgtgaactgccgcggcagtttgacttattgctgtttcagctttaaggttgttgtgtttttgtttttgattatattgcttgttttttgttttttttttttttttttttgagacggagtctcgctgttgcccaggctggagtgcagtggtgtgatctcggctcactgcaggctctgccccaccggggttcacaccattctcctgcctcagcctcccgagtagctgggactacaggcacccgccaccttgcccagctaattttttgtatttttagtagagacggggtttcaccgtgttagccaggatggtctcgatctcctgacctcgtgatccgcccgcctcggcctcccaaagtgctgggattaca

SEQ ID NO: 126424 - DNA, 1035 bp, Homo sapiens
atgtgggccaggtgtggtggctcacgtctataatcccagcactttgggaggccaaggtaggtggatcacttgaagccagtagtttgggaccagcctggccaacatggcaaaaccctatctctactaaaaatacaaaaaaattgggcaggcatgatggtacacctataattccagctactcaggaagctgaggcaggagaatctcttgaaccaaggaggcagaggttacggtgagccaagatcgcaccaccacactctagcctgggcgacagagcgagactctgtctcaaaaaaatagaaaaaaaaaattgtgtacggatgttgcatattaaaagcagtcctctgtttctgcacttaatgtgcttccccctggactagcatctcagaggcactgcctcttccttgaagcctgaccctcctcagaggccctgattgtctgtacgtctgtgagatcattccttccctctgcctcatgttaaggtatctgtgaattcgccctcctggaggaaggtgtgagctaggggccgttaatttattcctgtgtgtcaggcactttggctcaacgcctgtaatcccagcactttgggaggccgaggtgggtggatcacctgaagtcaagagttcgagaccagcctggccaacatggtgaaaccccgtctctactaaaaatacaaaaattagccaagcgtggtggcaggcacctgtaatcccagctacttgggaggctgaggcaagagaattgcttgaacctgggaggcagagattgcagtgagccaagatcgcgtcattgcactccagcccaggcaactagagcgaaaccccatctcaaaaaaaaaaaaattatttctgtgatctcgtactccagccttcctttccccacccactcttaactccttgaaaggatcttatatacaggaggctctcaaagcactgggtaatgactgttctcaatgtatgtgtctcattttgtagggcgtgactaacttaagcagcttcttccttgcttggttgggctttgcaaatttttgctacttta

SEQ ID NO: 126425 - DNA, 1050 bp, Homo sapiens
cgggttcacgctgttgtcctgcctcagcctcccgagtagctgggactataggcgccagccaccatgcgcggctaattttttgtatttttagaagagacaggatttcaccgtgacagccaggatggtctccgtgccagccaggatggtctcgatctcctgaccttgtgatccgcccacctcggccttccaaagtgctgggattaccagcgtgatccactgcgcccggccatgagtaactattaaaatgtaaaatgtctgtcagtgtagtacctcaaatcatgttgccttctgtgagggggacctctgcccctttccaggacgtgatgccttcaggtggctccaggagttaggaagtgaaggtacctcagcttcttcaggccgtgtcccccaggctcagggtggcctctctgctgacaccctgtccctatcttgccggcagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggtaaggcgcctggagccctggaggctctgctgagaaccagggtgcagaggggtccgctggctgctcagtgcccacactgtctctgcctgcttttcccatctttctattctcagaggagaactctggcagaacctgccagcctcagccagcttttaggggacagtgtggctattttctgctcatctctttttttttttttttttttttaaagacatagggtctcgctatgtttcacatactggtcttgaactcctgggctcgagtgatctgcctgcctcagcctcccaaagtgctgggattacaggcgtgagccaccacgcctggccccgcgcatcactttggagtgcttcagtgtttggagctctttcaatcactcggatttgaggctaacgagggtgacccggaagcagcgagttgtgcagctggctgcattatgtccgtggttggtttctgtccac

SEQ ID NO: 126426 - DNA, 1050 bp, Homo sapiens
tacagggggacccatgtggctggggggtggcagaggctgagcctgcggaggggcctggggaaggagtttgcatttcctctggattttgagcacagttgtaaacatggattggagaaggtgagcctggaagcgggcaactactcaggaaggcggttcttggtgctggtggtccctggggtccgctgctttggagagggccaggtccacaagtgcttcccctacccttgtcccagctcttagatgtgaagagccaatcagaatggaacttcctggtctcaatgggtgcatttccatcacagctccgctgcacaggaagctggggctcagaaacactcttccctggctctcagggctcgtcaggccaaaactggacaccagaacctcttttccttggatgaagccaaggtgggcctggccccggccttcccagtggtctcacgtctgagtttccctgcaggggagtgcagcaacaaggaatgtcccttcctgcacatcgaccccgagtccaagatcaaggactgtccttggtatgaccgtggcttctgcaagcacggtaggtgccagggtgggctgggccccgggcaagaagccagtcctcccttctctgcccacgaccctggaggctgccagctggtctacctgtcccagcaaaacctgacattctgcagctagcggctttctcacactcctcatctcccttgcctctcccaagaatgctgggtgggtggtggtccacccgcttttttgataaggaggccagtgttgggaggtgaggtccctgccccgtctcccatgaatgggggacagccagcatttgaaaccatgctccagctctctaactggtagaggggacatctaagtgaccggacacttggctctgcaggtcccctctgcaggcaccggcacacacggagagtcatctgtgtgaattacctcgtgggattctgcccggaggggccctcgtgtaaattcatgcagtgagtagccagctgctccgccctctaccccagctcccggcccaggccctgctgccctccgtatcttccctgg

SEQ ID NO: 126427 - DNA, 1079 bp, Homo sapiens
agcctctcaatgccaagggcaccctgagtttggttatgggagtcgggagttgagccaagaggaagggctggcgtcaaggcagggcgggcatcaggcagggttcccaacaggcccatcaagcccaaccacctcctgagcccaatgcctcacctcctaccctgctgggctctggactggctgccaaagccccaccagccccgctcagtgctagaggctgaacagccaggagaggatgcggaggatgtagctgcgtggaggcgccaatcacattgaactcttgatggggaaagccgggaattccaggtgtaggtgcagccgtgccaacctgggggttttctagctcgggttctgcacttacgggccagagccaggagcccacctggtggggaggaggccctgctgtggaatccctaccccaggagccctggccctcctcctggtggggctccctagaggagggtcctctcagcccgagaacgcagctcagtgtgtcaggctccaactgtttttctgtgacttgctcgccgtgtaggctgctaaacatctggctgaaccaagcgttcatcctgacctgaagccagaacctcagaaaccaaagtaaggcctgatcatgccctcgccccactgccccagagacctcctcttgtctctttgatgttttgttttctattttatttttcgtttttgtgtgtctgcatggtgtttttcgggcagtggcttctgccatcatcaccacatgtttctctgctgcccactgtcctgaggtgggccgtcgtggaagccctgcttcctgccgtttgcgggacgagtcccgccctcttttttcctgtccccatcggtagtctgcgtgcacgtgttttccacagtaaaaccgtgttgtgtaactctttccagcaaagtaacaatccgccattacaaaggtcgtcctccttgatccagttaacgagtcagaactcttctcccaatcagcagagaaccccgcaggtcatcggggtcatgcagagtcaaaacagcagcgcgggcaaccggggaccccggccactggagcaggtcacctgttacaaggtgagtccctgggc

SEQ ID NO: 126428 - DNA, 2062 bp, Homo sapiens
aacattcatttttgctgattgtaagcataaagttacagtctagttaccatccactgtggtgggctagagactgtcctatttcctaccacactgcactgaggcacggtaaaggatggtgagaacgcctgcctagtgaatggacggggcctgcaggcaggtgagggaagcccccaagaggccgggaacaaaatagaaacactgatccagggaagggtgagcccttggagccgctggctgtcctgggggcatccttggatcctgcagggcacacccgagaaaacaggacactgggttacagcacccctgtccccatcccctcccccagtacataaaatgggactcaggaagggtgagcttcaagaaacctcctcgaaaactgtcctgttcactcctggctctgtgggaagcggggaaaggggaggaaaatctcttgatagtttgacgttattaatgggcccttatgtgagtctaggcctgtattcatgtccttggttaaggctggaaagttacaaactaagttttctaatctaaaatcgccccaggattggtgtgtccctggcacgtggcaggagtaacccccagtactctttgaagagtatgttctcaacccaaggcgcacacaattcctacagctggagttctgaagaatgagtccagattaaaaatcacaaaacaggctgggtgtggtggtgcacgcctgtagtcccagctactggggaggcttagatgggaggattgcttgggcccaggaggtcaagcctgcagtgagctatgactgcaccactgcactccagcctgggcaacagactgagactctttgtctccaaaaaaataaaagagcatggaagtggggcactgtgtagagcagacttagctgttatcttgccaccctccaggcctgttaagcggggccacttctgtgcagcaagcgcccttaagtcctggagccttagaaaggtagggctgaccgcccctgtccacagcctgtcaccccattaatgtcagagacacttcatgtaagtcctggattccccagagtcagctgtggggtccgacagacatgccagatgccgtgagcagggtgtgtggtccctcccccagccatcatgttagccctacagcccatcggcagcctctccatacagagtcacacctgcagatcagacaaagttgaaaacacagggacagctgggtgcggtggctcacgcctgtaatcccagcactttgggaggccgaggggagcaggtcacaaggtcaggagttcgagaccatcctggccaacatagaagaaagaaaacaggaattgcagagccagggaatagagctggcaagagtgttgggtgccaactgggcagagcccctcagggcagcagggactcaggggtgggtgtcagtacagagtcagtgcccccagctgcctcctgacccttttgttcagtgcttgaggctgccgttttaggagtcatagagtaaagagaagctatggaagggcctggataatcaggactgggatgaggcagggtcagggctggatttgtcatgtggctctgcaggctccccttacccaagtctaagcatcgtcccatctctctgatcctgtaatcaaaacctgtccccaaggtagcttaggtgtgtcacagccacgagggaaaacgttgggtacagcccaccctctgtccccagcagtggctccccaagggaggggaggctgggacacttctgatgctgttccctcccatctcctgccagggaaccccagaccttggctcagaggtaagtgactggcctgtggtgcagaagggcttggtccccagacggggtggcggagctcaggtgccacgggcttctctttgtcctgctacccacttgggagtccctccctgggcaggccatgtgtccaggtgggagagttgtgggcctgaaagagcaggtcgctagcaggtcgccttctggcggccttgttctcccttgcatctgcggagttgctggctagtttctgcaccactgcactttccatcctgagctccctcaccctctaatttgaaagaaactctgtaccact

SEQ ID NO: 126429 - DNA, 1290 bp, Homo sapiens
gtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaagccatgtctcattaattaagggtctcatgccaacccttttacactggctgcaatcacggcgtagctttcttgtccctttcaacaaatgtcagcctcacaaagggaagtgcagctgcccagaaggcctgcaagcagctggtcaagtctgggagtctgatctgtggagccagcaggcaggtcctccacctcagctcagatgtctggtggcacctatttctggggcacagtatcccacccccaatgaggctctgatgaagaggaagcagggaggggccgccatagcccctcacttttccccatcacccccaacccactaagcctcctgttagagaagccgcctcagccgg

SEQ ID NO: 126430 - DNA, 2956 bp, Homo sapiens
ataggagggccagtcctgaccccacgttgtgtgtgtgactttggtcacgtggcccaacctctctgagtctatcccccctcccctcctttaaggtaaagacatgaagtgcttgttgtgaagattaaataagctaataatgtcaagtaaatgttagctttgcagtaatctttcctgtccgccacgttactgcttttttcgagacccttttctggagttactcccagcaagctgttactcagacgtcctgttggttaataaagctgtccctgcagcagttctgctattgtatagactcagtcttaaaatagtgggcttgatgtgacatatttcttcataatattgtgtatgtgcagcctctgtgtaattgcattatgcacctttattgcatagttgaagcagtggcaggaaaggatgccatatgtgttactgggagattattcagtgggtattttttctcactcttccgtttcagtaccagtgaaggacaagaaacttctggaggtcaaactgggggagctgccaagctggatcttgatgcgggacttcagtcctagtggcattttcggagcgtttcaaagaggtcagagccttgtggatgtctgtaaatgaaagcaaatctctgggtcttcagatctcttttttgccatgaattaatttgggcaatgaaggccttgttgtctgaaagcagtaagttatgtagaggatgacagggagggatgctaggccttggacttctgtggttgattggccctttcaaaggctggctctgagatattacagccaagaacatgtttcctgttgcttggaatcagtatgtctgcctctgtcttagagaaatcctaagacttctttaagaggaaaatgaattggaaccgtagtgggcattagtctataatatgatgctctcctccctgccagaacttcaggacaaatatttgaaatggcctatcttggcctggtgtggtggcttatgcctgtaatcccggcacttcgggaggccaaggctggaggattgcttgagccgagtttagaccagcctaggcaatatggagagaccccatctctataaaaaaaaccacacaagaaaaattagctggctgtggtggtgcatgcctgtagtcccagctactcaggaggctataagctcacagccaaaggggagaggtggaatccaggtaggcctagttcaggagctggtatgtgcttatagttcaggctatggggatgagagaccttactggcatttgtgcttgtcatctttatcagccagtgaatgcagggcgaggggcttaaacagccagagcaggactaggtccctgaatgtcagccagactcaactgtgtgctcaacttcactcaaatgtgaagcccagcagggcagtgagcgcctcttgcgtttgcaggttactaccggtactacaacaagtacatcaatgtgaagaaggggagcatctcggggattaccatggtgctggcatgctacgtgctctttagctactccttttcctacaagcatctcagtgagtgcctctgcggcgtcttgcctttagttcccatgagagggtggtggtgactgatttcattagatacagcagcccaccttcttctgaggctgagggacctttagttaaagttccttatgtttccacctaaaagaattggagggacctatcagagtacagtatgtgggatattgtttgaaatgagaaaattgtgacaaagagaacacaggaaaatcaagatgaagccagggtaaagagagtacttagaagcattctttaaaatacagcacactgtgaaaatttggctcgattttcctagtagccaatgcagaaagagaaatgagttgagtgggataatctggtaccccagaaaagcatggctgttccggctctgaggcttgagaggagcttgtctggtgggagattggcgggaggtgtcggtggcagcctctgactaggctgtttctgacagtgtagtgtacaccccctacccccacctcactcccattctgtggcaccagggcggtcctgcctctgaaggacgggttctctggggctgtttgtctgagcgtgtgttccctctgttccttctggaaagaaagtggttggccaggtggcaggttggctcctgaggtgtctttgtgccccccgggtctgctgattctgcagagacaccggcaggcgggtcatgggtcatctctgaagggaattctcaggaaggctttgtgtgatctcagcctgcttcctgccatgctgtgccttcactgtaaccttttaagatacttaccatcttgccttcctgacttcagagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgtgctgattgcctgcctgtctgccgtagccattatcccatgttccaggggctcctgtggcacaaggtggggggaggtcgtctttccaggccgttgaccggtgaaggcctttgtggacttcccagaccaccactctggtcgtgtcccagctccctggagggcagggtgtcatccagaccttcccgaagcagcagtgccgaagtccgtcccttgccatgagtgctgtgggcaggtgcatttgcagacattctggcctttagttggctggccctttatggtgtaacacaaaggcttgcgtacctgagagcgccagatcccaccccggctgtcctgtggctccaggcagggatggcccgcatcctgtgtttctgcatcaccctggggcatcaagggctacagggtgaggtgacccggcactgtctggagagacctcaggcagcactcacgcccaggctgcagggattgtggccctccggctgaggc

SEQ ID NO: 126431 - DNA, 1046 bp, Homo sapiens
cagaactttgggaggccgaggcggggggatcacgtgaggaaaggagttcaaggccagcctggccaacatggtgaaaccctgtctctactaaaaatacaaaaattagcttgctgtgctggtgcacgcttgtagtcccagcgcggcctcttcccaccttttaaggtagagagcccaggctgaggcgcccctctctctaactgcaggaccctcggatttttgctgtccaggcacctcgcccttcgcttcatggccttctagtagttccagggtgttcgcagttgtgacctgcttcccgtgagcctctgctctacgcccctggatggggcgtgcattccctacccagcagccctcgcgcggtccggcacagcggacaccaggactccaaaatggcgtcagttggtgagtgtccggccccaggtaaggctgtttggactccgtggtggaagcaggagccagggtccagggtccagagccacactgggagagaaggaagctgcggagctgcctgccctttgctcaggcacttcgccacgacctcacttgaggcgcgccagaccccgctccgcctgcccaggcgcgccttcctgctgcccagggcctgcgccaaccgggttaggcgtggagggtgaaggcatctggggcacgcgcttctgggcctgggaatgcgccgccttgggccactgttcctctttccgctaagaaatagccgcttccctctcccgctgcgacccagttgctttgcacttgaatgttaggcgcagcttttgcccttttttcccaaggcttaagctcagatgaagctccaggaggagctcaggactaggactgtacctgataccatgtaaggttcgatgcatatatgttgaatcagagaggcgaggtgacctgttcaaggtcacaactcgtgcgagggctgagctggtattcaaacctgaggattcgtggtaaatgaactttattctctaggacggccttatgactagcaggcttttccgagacacccatgtgtaaatcgctacattcatcccgctgtgcacactgatgat

SEQ ID NO: 126432 - DNA, 1034 bp, Homo sapiens
gagtgtgagaggatccagaaattagagggtcttgacagccaggcagaagaatttggcctcggcgcagtaggggccattatggattcctgagcataagaggaacatgatggcaatgagaaccgggcaaagatgttctcacttaaacctctttttctcctcccttagcccttcctgttctccaagttccttcccttcccctgaaggacagccaggagctgacagcttcacttctctcaactgggtcccaggtgagctggtgcccctttgccctcagagaggacccatcctgaaccttcaccaagagttctgtttctttagccagtgactaggcccatcttgggttggtaccttcattcctttggcctttttcctttctgcctagtccttccccatcctctttgaggcacagttcctccccctgtttcttttcttaatgagcccagttcttcccctcactccaaatttggacatagggaatgagaatttagtggagatctcctgtttcagaagttggtgaaaattgaagaggtggctgatgtggctgtatccttcatcctggaggaatgggggcatttggaccagtcccagaagtccctttatagggatgacaggaaggagaactatgggagtattacttccatgggtaaggattatttcatctgcatggattaggacatgtttattttgttatcttgtaaagagtatttctggctcatcttataatggcatttatgttttatgtgctatgactttgcttttttttattttttgtaaaagaataaatcagccttcattttttttttcttattcagtttattctgatcatttccatcttaataagagtatgattaaacactgatagtacttggggggactgtttttgcaatccagcagatgctaactttttactgctttaaaataagagtgggttggctgtggtggctcacacctgtgatcctagcactttgggaggccgaggtgggagaatcacttgagtcctttggactttaacaaatttttggtagttactatac

SEQ ID NO: 126433 - DNA, 1354 bp, Homo sapiens
actgtgttgcccaggttggagtgcagtggtgcaatcttggctcactgccacgtatgccttctgtattcaagcaattctcctgcctcagcctcccgaatagctgggattacagacccgcaccaccacgctggctaatttttgtatttttagtagagaagaagttgcaccatgttgatcaggctggtcttgaactcctgacctcaagtgatcttcccgcctcagcctcccaaagtgctgggattacaggccactgcgcctggccccatttttctgttacttatttagggtggttaatcattatcaactaatttttattgaatatccatagtgtgtaagatcctttgcaaagtcctgacgatataaaatgatgaaatgctttaacttattacagtaatttctcttaatcttaccttgcagtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggtaaggcagagaaagcacttccgtctgggagagtgggagtgcggaggggctcccgagggggctcctgggcctggtttgagagaggccaagaactggaataagaacatggtccctagagggaggaatgaaagagggggcagatgtgactcagttcagtcctagtctgagcccctttattaaggatagctcatctttctcaaataagcagagtgatggctgcttactcgctgtggtggtttttccttcaggcaaccttcacttcatcccagttctcacatccagaataatttctaagatatgctgcttttgccacatctcacagtcctttcctggctctcacttcctcttaggttcaggacctttctttcccctgttcccttcacttagtttttctttgctttgtcacctgccatccattctgttgtaactgcagtgttttgtgactagactaaatttggtcaaggaagcaaccatttaattccttggttgaacacaatgcctgtatgaatgtatatatactgtattttgactacgcagtcacactttgctgtatcgtataggtaggttggtctttttcttcctttgttttataagagctgtgtcttagattgcctgtggttaactctagtgcctgaaataacttgtgtgtcacccacacagatcaagtgccacaatgtgtagagtgctgtgggggattgtgggactgtggaaaagatttcgaggaaacagatgaccctttcttgttcttgggggccttacacactggttgagaca

SEQ ID NO: 126434 - DNA, 1785 bp, Homo sapiens
aacgctgatcaagtgtctagaacagtgcctggaaagggtcagaagtctgctaaataaccctagcccaggacaagtccccacaagtctttatgctttgctttgcccatctgcaaaacaggtatagtcttactcttctgtaagaggactgtcatgtgatgaagataaagtgaaatacaagctttcctaagaaaatcctgtatcacaggtcaaaacacgcataaggcatgcaagtactgagacgaagcagagtagacacacccaatacctgaaaaatgttcattggttttactagagtattgaggagggtcctgctgacaccccttgggctggagaggcctcctctgaaagggagccctgggaaagggctgctctcactcttcactcctttctcctccctcagctccacctgttcctcaggtgcctgctcttccccgtgagggaagcccaggagaccaggcagctgcgctcttgacagccaggtaccaggtgagctgaggaaccctctgcttttcctcagggactattgctactgatggagtgtggcctctctctcatcccatctgtagaccttgcctggaatttttttcaatagcagactccagtttgggaattgatcctcttcggagacctggacttcacataaaccaacttcccatctccccagtgccatgagcaaactctgttttctctttgtccatggttgtgtgatgggtgcttattagatgtttaagggttatgggctttattccgtaggttctaatctgttctccctcctcctcaacgtaagtacacagtggataccctctctatgatcttcattctctggccatggtgctacagtgttctcattcctcagagcagccaggatgtgttatttcaggagtttgtgacattcgaggatgtggctgtgcaccttactcgagaggaatggggatacctggaccctgttcagagggacctctacagagaagtgatgttagagaattatgggaacgtggtctcactgggtaaggacttccttattattcggtttatctatttgaatttctttactttcttgtttcttcctaagtataaggtctctgagaaggtctgtagagtgtggcttagattccaggacttagaacctctgaatccttatctttcacatcgtcttctccgggaggggtaattaacgtttgtttgggggtgccaagaagagacattctcctccttatccccagttcatgtttatggccattgtggggcatcttttcccttttagcaaagggaaactttcttgtgctttgcttgatttctcaccgttcttttcttttccatttttgtaggagagaccccagggtggcctcccaacctccaaccagacactttcctctttgttatctcagtgtccctgtattagagaattgaagaatttcccatttttctaggaaaaagaaatgccgtttatttaaaaagacaggctaaattccttcttgttgagtagtccctcaccccttaagatccccagatgtatctccaagcaggcagaacttgagatgtcatttgaaggcatgactcactgtgagtacatttcagtgagtcacccagaatggtaatcccacgtaaccacacccagggcagcagaaatctcagatgtttaccccatgctgaggtggggtcaatgcttaactcatgtctctcccttgtcattttgaaaggtacagtgggaagctgggattagccaagctgtagtgctgctgggaagcatcagtggggtttgtcggcagctcccttggtgtgagc

SEQ ID NO: 126435 - DNA, 2141 bp, Homo sapiens
tttagatggagtttcactcttgttgcccaggctggagtgcagtggtgcaatctcaactcactacaacctctgccttccaggttcaagcgattctcctgcctcagcctcccaagtagctgggattacaggcatgggccaccacgcccgcctaattttgtatttttagtagagacggggtttcaccatgctggtcaggctgatctcgaactcttgacctcaagtgatccaccttccttggcctcccaaagtgctggaattacaggcatgagccaccgcacccagcctcctttttctttagtttcttgcttgcttctgcactcttctttttgtgtgtgtaaatactgaatcatgcattttcttttcttttttttttttccgttggctttgtctatgctggtggcatccagggcattgctttgtctccctgattatgctcaggattcaaggtcttcttatttgtggggaggcaggctgcccactgggacggtttttagtgtgttttccattcctggctctttaatctttgtaggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaacctgtctactttttggagtaaagaaactttgtagcagtttaatgcagtctaatagcatagtatgctatagactgaactttatcccatttcctctcttatctctgcactgcacactcgacatgcagtcgacatgcatacacacttttacacatacaagagacacgcacagtgcaagaaagccttctactcatcttgcttttgtgatcaagttagcagcatctccttagcagttatttttacaatccttgggaaatcattttcatatttttgggttcagcagacttcatctgaaaattaacccatttatgcctagtgttccattattggaacactaagcttgcgggaattatttatgtcccgctgctcaaggtcatcgccaaggtctgatttttaacaaaaattgcaacctccagcataactgggttaagtttatacatttattaatttaactttttagggttgtaagactttttttttttttgagacggagtcttgctctgttgcccaggctggagtgcagtggcaccatctctgctcaccgcaagctccacctcccggcttcatgccattctcctgcctcagcctcccaagtagctgggactacagatgctcgccaccatgcctggctaatcttttcgtatttttagtagagatggggttttgccatcttagccaggatggtctcgatctcctgacctcgtgatccgcctgtctcggcctcccaaagtgctgggattacaggttgtgagccactgcgcctggcctccag

SEQ ID NO: 126436 - DNA, 5970 bp, Homo sapiens
tctgggctggacacatttaaaaactgccctttgatactaatagtattaaaattctgtctccttggaagcagactgcctgttgctttagctttaaaagagatttatatccaagcattgcattatgcaagccatagaaagactgttttatgtgaagatgcactgattgcacttccctctctatattttattgtagttagttgtttagagctgtctctgtgtagagtgtgaggtccttgagggaagggaccttcttggcctcttatcccctgcatactttgcatagaggaggcacttcataaatgtttgttgaataaatgctacactcctaatgggtaagaatgtgtcatattactctttgttttcttatgtgtactgaaacaaattgtttcttgagattggtccttagaatatttattcagttttcactgattctcttgctacaggttagctaaccatgcagcaggtgcttgagtttcacctttctccagtccagcagaattacattttgatgacctccattttgatacttgtagaccagatctaatccgaagattaatctttaggtaacagatggagagtgataatgataacttctgtgaagacaaacccatgcacacattctgttgtctgaataatatttaaatgaatccttctgctcccaagtcatcaacttgccccttaacacacatccctctagagcacaaatctgagctccttgtagatctttgccctcttcactctccagaccttcctaattaatgtcttctcagaatcgaccttctgtctctcttaatcattagttaaaagaaaaagtggcagatgtaggacctggggatacattgccacatcccatttccttctctatgagcaggatttccaatttccaagcctgatgggatctcccagctggaacaggatctacaggtctttgatctggaaactaagactagagaagtcttaagagatgactgctcaggtgagtaaggcagaatcagatagaattagtagggaagtaaagttcaattgttgagccaagttgtagctgctttggcactcagaatgaagagctctgtgtgtgtcctagcatggagagttccttccttttcccttcagttaggttgaccctttccatttgtttagtatccgtgcacatgtcgtactagaccccaatcaagttgcttatctaaaattctttcagctgtttccctattatttccttactctgctgaacatgtccgctgttttacctcactgctcctgtttatgcccttaacttctgctgttgagattttgtgcctgtttttcagagtaaataaacttttcttgtccttgtagatactacattgtttagttttctcatctgagttttcttttcctaagcacagggtacagattacatttgcattttctatttatatattgtatcagatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacacctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctgagaatttgtttcaaacaaaatctgaaggtctcagacagaagcgtttgggaatgttggaatcacatctctggctgcaactcctttcctccctggaacttgcttcacagcaagaatggatcactttcctttgcattgataacaaagcttgcttttccacagacctctggaacaaaagctgaatgtttgggacttaaaggggatttgattgggaagttgttggtatataaaataagactaaatagttcgaggtttcagtagaactaggaataactttttgtttgtttgtttgttttttgagacagtctcgttctgtcacccaggctggagtgcagtagcg

SEQ ID NO: 126437 - DNA, 1084 bp, Homo sapiens
tctgagtttatcaggaaaccccttatcacgaacaatttgtctccttaatcttttttcttccttttctgcttcaatacatctcatgcctctggcaaacccatactcctggccggctaggtggttggctcttggccccttctctaaggcttttcttgcccgttccccctgcctatttataggtggtgcaaaagtaattgcggttttgccatttaaaaaattgcaaaacagcaattacttttgcaccaacctaatacacgctccaggccaagctgggagatgttggggtgcacacagggagaggaggacaggctggcctgtgggtgaagagcgcgggccccgcagggtcaacccggccagtggtcacgaaaggaggtggagtggggggaggcgacatagggcaggaagaggggaggacaaacggggttcacatggggaccgtggcgatgacacggaagggacagccagttagagtctaggcccacttaggcgatgaagggcaggtgaagaaatcccgttccatcttcctgcagtcctcccttggggagtccacatcctatccttctctggaccggggcggctcctggagggaccgcgatcgaaatgaggcctccgagccgcccagagactccgaagtgcgcgcagcggaccacgcggtttccatgcgccccctagggtgggtgggctagctgtgcgccccagtgcggagaacggaggaggggtcggccccgtagcggctggaaacgcagttggcggcggggcccagcttgcggggcttctgatcgcaggggcggggcccgccgccggtttctaagggcctggcagagttcctgcagtcacggtcaggggtctttgctttcgtccatcccctcctggagaaagaacgcagcttctaacgccttctcggttgggcacccttcttgggaaagctccgcctaccattgcccttgtacctgccctctctctccctttcctgaagtgactgcccgtctctagcatcgtgttgtgaatgtgtcgagattttggcgctgcagcagcatcggagattggatccagcccacggagaggtccccagactccatttgtc

SEQ ID NO: 126438 - DNA, 1041 bp, Homo sapiens
tgtctccacttgcagtttttaaaagagttgcttccatttgactttttctgtctgctgtaccagcatatgagtttcaggagggtaagctcccagtgtgtcttgttttctattttatttgttgtttctgcctgcctcttgtgtgtgtatatgtgtgtgtttgtgtgttgcatgtatgtttcctttagtattggaagagtaggccctggtgactcacccagttataacccattatatattattctctgattgtagtgttattctccagtgagatcctaagttatttgtgggtataaaagcaaaatcttagacattttctgtttagtctctgtacctaatagttgcttagcaaatgattactatgttgaattgacctgacttttgggatctgtgttcagtcttttgaaaatgccttgtaaaaggtaattactgtgttctccagtggaatattccttgatgtagagacagaactgggatgggctgacctttcatgtgtctcttgttctcaaaagggtcattgatgcagtcattctcagtctcctcggagggagtctgaagatgcttaaagagcatccagagatggcggaagctcctcagcagcagttgggtattcctgtggtgaaactggagaaagagttgccatggggcagaggaagggaggaccctagtccagagacttttcggctgaggtttcggcagttccgctaccaggaggcagctggaccccaggaagctcttagggagctccaggagctctgtcgtcggtggctgaggcccgagttgcacaccaaggagcagatcctggagctgctggtgctggagcagttcctcactatcctgccccgcgagttctacgcctggatccgggagcatggcccagagagtggcaaggccctggccgccatggtggaggacctgacagaaagagcactggaggccaaggcggtgggtgaggaggggatccaggtctggcgcccttggcgtgggcagggaatgttaaagaatccaaagatttgaggaagcagtaggagtggacgaggtgtg

SEQ ID NO: 126439 - DNA, 1520 bp, Homo sapiens
tgacaccgtcttgctcacaagcccccgtccttctgtagttcagcctcccgtgcacactctcgtcaccctgacttcctgtcttcagaatcctaagagaattttttcctactcaactcaggagcttaaaagtggacccagaaatgccttgtttttgtgagtacttctcagtgagagagtcctcctgatttttcttgctctttttaatttattatttttgagacagggtcagtcaacagcctaggctggagtgcagtggcacaatcctagcttactgcagccttgagctcctggctcagttgatcctcccacctcagcctcctgagtagctgagaccacaggcatgcatgcctggctaatttttttattttttgtagagatggagtctcgccatgttgcccaggcttcctggctctctttaaagcaactatttctcactggcctgttcactgcagggtctaggctttgcattttttattttcagctttttcaattaggaatttttttttctagtagtgagtatattgtgttaaaatcctcagcaggataatatttgggcttggtgatggcaggtagaggggacccttgtcaaatggcgtggacagataaaagttgctcagggcctgatgcatgagtttagcttccttttcacttcctcactaatgtcctggggaagagctcagctgatttttccttcctctcccctgaagctggaatggttcttttcttggttctctttttagattttagttcaactcccttcataacagccttgcccaggcctcattctaatcggtgttgggaactgttcttaggttccatgccacaggcagggagagcaggaggaaacagcactttgcagaggcgcttgggagccaggcatccagctggggccagtggaggtcaagcctgaatgggggatgccccctggggaaggagttcaaggtccagacccaggtaccgaggagcagctcagtcaggaccctggagatgagacacgggccttccaggagcaaggtgagtaagacgcagatagtggggatgtcaggtcataggaaacagtgctgtgcagccaactctcttcagaaacccagcaatggagcaactaagttacccacgaggtgtaattgtgaattttcttggctacttcctccaccttaggaaatagatgaagtgaaattgtttcttctccctttaccctctggtgtctggaggggatatctgggatcatgctttcttattatttctcttttctttccctcagatcccttctagaaactaccaagaaatattcagctgacttgcaggaatactttttcagtaggcagataaaccatatcccccaaagtaatatgtagctttctttctttctttctttcttttttgagatggggtctcactctgtcacccaggttggagtgcagtggcgcgatctcagctcactgcaacctttgcctcctgggttgaagcaattctcctgcttcagcctcccaagtagctgggcctacaggcatgtgccacca

SEQ ID NO: 126440 - DNA, 1261 bp, Homo sapiens
gaagcctgcttcattcattcagccagcagttagcaagcatcttccctgagtcagtcccctgccaggctcctaggagacccagatgaatgaacctggttaggcagagggagcatgtgggcaggacaggggactgagcaggcacctggaaggtctggagagctgtgtgctgccctgtgctacagcaggtgtagaatcgtttggggaaggcgcaggacatctggatgaatggaaacagcatttccaacaaagtcacatgtaaataggtacagaataataaagtgctagttaggtgcacagtgctgaagaggcccagagtaagagaataatcgtggtgagtgtcttagaggaaattattgagctacattttgtaagaagtaaaggtctagattagcagcaagataagtgggcgggcactggaatttggcagactattctgtaaaaagacatggaggtggaaataaggaaaaagaagtaaggaaagcctgagttgaggttgttggtcaaaggaaaaaagagaaggaaccatgaatgggacccctgtgaagcagagttctaacatgtaaatgtcctgcggctaccacagaatcaatctttatctcctcctgtcctgtaggcggtgggagcaaggaaaaggaggcaaaacccccacaggaagacctgaaaggggcgctggtggcactgacatcagagaggtttggggaagcctctctccagggccctgggctcggaagggtctgtgagcaggagcctggtggccctgcaggcagtgcgcctgggcttcctcctccccagcacggtgccatccccctgcctgacgaagtcaaaacccacagctccttctggaagcctttccagtgccctgagtgtgggaaaggattcagtcggagctccaatctcgtcaggcaccagcgaacccacgaagagaagtcttatggctgtgtggagtgtgggaagggctttaccctgagagaatacctgatgaagcaccagagaacccacctgggaaagaggccctacgtgtgcagcgagtgctggaaaaccttcagccagagacaccacctggaggtgcaccagcgcagccacactggggagaagccctacaagtgcggggactgctggaagagcttcagccgcaggcagcacctgcaggtgcaccggaggacgcacaccggggagaagccctacacctgcgagtgtggcaagagcttcagcaggaatgccaatctggcggtgcaccggcgtgcccacactggcgagaagc

SEQ ID NO: 126441 - DNA, 1350 bp, Homo sapiens
caggctataacattctatcctcatctgtaaaacttccccgtccattattccttgcactataacaactgtcaacacaccaactattaggaagttagtattttgctattgatcactgaataaacatcagagtattttaaaaaacagttctctagaaagaactgttataattaaaatgagtctgaaagatgaactctagtattaatgccctatatttgatggcactttatagttcataaaattaatttcaccccattctcattggacccatttcccaagtatttattgaggccctgtaacaaacatgtcaggaactcttctgggtgcttgagacacatccatgaataaaatagggggagaagctgttgacctcgtagagcttatgtctcgtggatgtacctgatcttcagaacccgtggatattcctgcaaatcctctgggcctgtattcattgctttgtcagcatcttgccctgaaatgcatttgtcacctacctcttgttactaaatggtctctgccctccagacccttgtcatccaaggcactaggggtcctggacacccactggggatgatgagctggtagcgacctgttttgcatgagtgccaagtcaggaaaaataaagatatttgtaggcattaaaaaaaaatacatttctttaaaaatgagaagatgcaatatttgtaaactgttgaagcttccttattgtgccatcacttaagggtttcatttctgtttaaagttctggaagctgcataactagcgtggactgactgctgtgtcattgtgctgtgcctttgaaccctggctgagtgagtgagtttgtcctttgttgatagtgtcctataattgcaaaatgtggtttgtcttctgatgcctcttaataccagattcttttactgagatttttttttttcattttccattgtaaataaggtaaatggtaatgactaacacaaagctgtattactcagcccactttgaaacgtggttttatcacctgttcttgttaggcagcatggtgtctaattttggcttagcaaatgacgctccttggtcttcctggctcattagctgtgcccacgaggctgcactgactgggtcgtaaatgtatctgagatgtccacacggggctgctgctgctcctctgtaatactgaggtccacatgcaaaatcagctttttttcccccgtaattatcagagcagctaggcagggctgacagccaggcagactcagtgggaggcttctggcctgagtgtggccttccccagagggtggttttccaaaggcaggtggggactggggaggcctcggggggctgcttgtcattacctgaatcacagatgctctt

SEQ ID NO: 126442 - DNA, 1048 bp, Homo sapiens
tatctgaaaatacaagaaaaacataatatcatttacaatcactccaacaaaaatgaaatactttagctgtaaatccaacaaaacatgcacaggatctctatgctgaaaactacaaattgctaaaagcaatcagagaaaatctaaggaaatggagaggcatactatgttcatgaattgaaagaccaaacatagtgaagataaagactttccctaaattgatctatacatttaattcaattcttgttaaaataacagcatgtttatttatagacactgagagactcattctgaatttttatggaaaagcagaggaccaggaagagctaaaacaaatctaaaaaaatacatccataaaagtgggaagaatcactctacatgatgctaagagttactgtacaggtattagagtcaccagtttgttgttgatggaggaataaacacagtgatcaatgggacagaatagcaaatgaaagatgcaaagaaacatgcccaattaatttttaacaatatgcccacatttccaaaaatggctttggaacaactggacaactacaagccacaaaaaatgaacgttgatctaaatctcataccttatacaaaaaataacacaaaatagatagtagagttacatttagtaaagcattaaactttatgacttttagaaaaattggcaatataggaaggagggctaggcaaagaactttcagacttgacaccaaaagcacaatccataaaaaaatattaatacattggcctcctcaaaataaaaaaagttttccctgataaagaccctctcagagaaaaacactcgtgactgtaggatagtagcagggagccatacggagatggaatgggtctgcatcttgatcatgctggtcattgcacaaatctacaaatgtgataaatttgcatagaactacccacacactcaagaccagcctggccaataaggtgaaacctcgtctctactaaaaatacaaaaattagtagggcgtggtggtgcaacttgtagtcccagctactcgggaggtggaggcagaagaatcac

SEQ ID NO: 126443 - DNA, 1057 bp, Homo sapiens
cacacctggctaatttttgtatttttagtagagatggggttttgccatgttatccaggctggtctcgaactcctgacctcaggttatctatctgccttggcctcccaaagtgctgggatgacaggcatgagccgctgcgctcagcctctcagttctttatacagtgagatgataagtgtagctacctgctaagattgttatgtggtcaagtgaaaatgcttaaatacccggtacctagaaagcactcagtaaacattggctcttactgttatagttatgagagggttcttgaacagtgataagaggcaagtcgcgttttagctagctttaaaggttaagtaggatttgaaaaggcagagaggactgcggggggaagtcccaggcatggagtgtgatgtgaggaaaggatggcagtcaaaatacaaggcatatataggaaatactgatgagagggcttttgttgcatagggaaggtttatggggggattgatgggaaaagaagcttgagggaaaattgggaccaggcactggaaagtattaactgcaaggctgtagagttttagaaagaataatctgaaaggtggattgtgggagagaagggagaaaatgaaggcagggaaccaaagaaaggaagctggacttcatggaactagattaaaaaaaataagtatggcctgtaatcccagctactcaggaggctgaggcaggagaattacttgaacccgagaggcggatgttgcagtgagctgagatcatgccattgcactccagcctgggcgatagagcaagactccgtttcaatatatatgtatatataatttttgtgctgttatatgtacatgatccctttttcaccaaaattaagaatatgtttagtgagagccataaaactaaaaatgcttttgctagtttaaaactcggtttaacccatcatgataaagcagtttaatggtctgtttctaaaacttcaatttgatgcttagttttgatggctgtagaggtgaaaagaataaattcagaaagatttgtagcttcagatggaagaatcacagtgtca

SEQ ID NO: 126444 - DNA, 1013 bp, Homo sapiens
ctacaacctccacctcctgggttcaagcgtttctcctgcctcagctttccgagtagctgggattacaggcgcctgccaccatgccctgctgacttttgtatttttagtagagacggggtttcaccatgttggccaggctggtcttgaactcctgaccgcaggcgattggcctgcctcggcctcccaaagtgctgagattacaggcgtgagccaccacccccggcctcaggagcgttctgatagtgcctcgatgtgctgcctcctataaagtgttagcagcacagatcactttttgtaaaggtacgtactaatgactttttttttatacttcaggaatagtaaagaaacacatcataaaacctcccaggacataaaggtgagcacagaccctgtttggatcaagtcagttcctggagcctgaatgatgactgctgaatcacgggaagccacgggtctgtccccacaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagaggaggccgtgacccttctagaagacttggagcttgatttatcaggacaacaggtaaaaagaggtgaaacctattatgtgtgagcagggcacagacgttgaaactggagccaggagaagtattggcaggctttaggttattaggtggttactctgtcttaaaaatgttctggctttcttcctgcatccactggcatactcatggtctgtttttaaatat

SEQ ID NO: 126445 - DNA, 1015 bp, Homo sapiens
gtcctctccttttagcatctttctaccacaaactcccctccacccccaggttctggccacccttttcttcccagcgtcctgtagctttgcagccacctctcttcctgactccaggtttgagcaatgggattgtccctgagtttggggggaaatgactgtttgtctcgtgttattttaggcaatggtgaagatcgaggacatggctgtgtccctcattctggaggaatggggatgtcagaatctggctcggaggaatctcagtagggacaacaggcaggagaattatgggagcgcatttccccagggtaagacggatgcaggcttactgtctgataagatggttttgtctctctgtgtgttagctgtgggatctctgatgtgttcaattgagtgttgaggagttagagactacctatccccttttgtagaccagatggaaagtgagaatgtttgtgttcatttaactccagaagcatggtactgtgaccctgattccaggtgggttttttattgctaagtagtttttgctctttaaaatcagaaataattgagttccaagtcctcacctcttcagccactcagttgcctgggaggcagttctgctccgttcccatggattacaatttaggtgcctctgtcgggggaatatctttcctagcagagatgaccaggcgaactgatcatccgtctaatcccaacccattgtcccggtaccacattcccgaaactaccaagcatccttctgttggctttctgtcttcttccatcctgtgtgattagtgtgattccaatacactgctttgtgtaattccacgaacttgcacctggactgtccttgtgatgaggattcccagcttccaaacttaatggtgattttctatgaagagctctgggtcctggatgtgtagtaagaacgaggaagttcaagaggcatcagccagataagacaaggtgacactgttggcagacatttccatttgtctctgctggatcttaacccctcaggacagtgctg

SEQ ID NO: 126446 - DNA, 1122 bp, Homo sapiens
caaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaa

SEQ ID NO: 126447 - DNA, 1954 bp, Homo sapiens
ttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgccgtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctg

SEQ ID NO: 126448 - DNA, 1049 bp, Homo sapiens
gagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctctaggtggcagtgcttgtgctggtttgttttttgttctttgtttttctcatccttggttgcataaatacacattgggggtgaagaaaaaaaagtattccaaagttaaaagactggagctgcaacccacaaacaaaattctcatgcaaaactatctgt

SEQ ID NO: 126449 - DNA, 1010 bp, Homo sapiens
ttcctgattgtctctaggtctcaactcctccaaacgaacagaaaccggtgtgggagaagatatcctcctcaggaactgcaaaggaatccccgagcagcatgcagccacagcccttggagaccagtcacaaatacgagtcttgggggcccctgtacatccaagagtctggtgaggagcaggagttcgctcaagatccaagaaaggtccgaggtgaggaccacccattagactcctattcagtgccccaggcccctgtggttggagaagcagaataattagtaattcttggttgtgaggtgatttcatagattgacttgattagttgggctgactgggtggaaatagtcccctttcctcccccaagtaaggctgtcttaacctgggccctagcatgggaatggatcactcttaaaggatcagtttctctttgaagtctgagtattacaaataattttttttaaagggtcaattgaaatgagtttaaaaaagaaactgttaacagaggtgtagagacttcaaatgaaccaataaggaatagtgttgcaccagacaacagtgaaaagctgttactccctgtgagcctaaagggacagagggggaccctcttaccagaatcaggtaagagctatagtcatggaggagggggtcacttgatagaagttgtggctgtaggccctgctgtgggatgaggagaaaacggaataaataccccaactgcaccctcctcctgcccttaaatctcctgcttttgttccccaatgacaaactcagttggcagccagagggcaggaaagacaagacagtgcagcccttagggtcagcttcctggggcacagggcgggtcagagaatggatctgagaagggcaaatgggaaataattggcaacctcctttctgaagctatggaaagaggtggggcatttttcacaagtcaaagctgtattaggtgactactcctgagctcaaatctccatatattatggtttatagaataatctcaggccataaat

SEQ ID NO: 126450 - DNA, 1046 bp, Homo sapiens
ttggtggaccggccctatgactgtaagtgtggaaaagcttttgggcagagctcagaccttcttaaacatcagagaatgcacacagaagaggcgccatatcagtgcaaagattgtggcaaggctttcagcgggaaaggcagcctcattcgtcactatcggatccacactggggagaagccttatcagtgtaacgaatgtgggaagagcttcagtcagcatgcgggcctcagctcccaccagagactccacaccggagagaagccatataagtgtaaggagtgtgggaaagccttcaaccacagctccaacttcaataaacaccacagaatccacaccggggaaaagccctactggtgtcatcactgtggaaagaccttctgtagcaagtccaatctttccaaacatcagcgagtccacactggagagggagaagcaccgtaactttcaagcgctcctgttgttgtcgttgttttaaactttagaatctgaaaaccagaaagaagtcttgtcattgcagcagcatcgattccggtgatagagtttgtatcactcaacatcaggggatgcctgaggagtgcgagctccacagcaacatggcaggcaggaggtcctcagaaggtgtcaggaggttccacactcgccagttcactggagcagagtcccttcgccacacttagggtcccagtaagccatgccagcattaccttttgcgtagttaaacagacgtgtatccagtctagttaaggaagaaacattaagattgtttaatttttaacatatattcaagaattttaatttgtaaagaattgagccacattgaacacaattgaatgagattcagaataaacttataacatcttgtaatgcctcaggactattattataacaaatgatgtgttggttattgaatacttacagatggagaaaactattcctactggtttagcttttagaaaatttggatttgggggtcaggcacggtggcttacgcctgtaatcccagcaccttggaagcctgaggcggtcgatcacctcaggtcaggagt

SEQ ID NO: 126451 - DNA, 1079 bp, Homo sapiens
cttgcagtggctgaacacctgatagcacagcacagcgccatcaagatgctgcacagccgcgtcaagctcatcttggagtacgtcaaggcctctgaagcgggtaggacaggggcttccctggcattcttcctctccctcctggggaagtgacagcatccaaactaatgtagtctctttttgtgcctttaggagaggtcccctttaatcatgagatcctgcgggaggcctatgctctgtgtcactgtctcccggtgctcagcacagacaagttcaagacagatttttatgatgtgagtgtaaaacccggatggggaggcggggcttatgctgtcactttcacgtgcaggactggggactgttgttccccgggcatgccacgagggatcccgaggaactggtcctttctgttccctcccagcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcacccctgctggtggctctgtcctctgttaggcaccacactggttggtcaacttggatgttcatcgaggctcattctggccttgctcagaagcccttctgatgctcttcagtgagggaggcactaccatttgaagtgaccccatgtcagtcacatggactggtctttagcaaagtccaaggctgcctgcttccacctaagtggtctctgttctacactttaatgtcaccctctacatcatcttacctagcccacccaaccttataaacatgataattgactactttcctgagctaaattaacttgtttttcacatacgcaaaaaagaagggatagtaagcagatttttattagaaagaagtccaagccttgatcctgtgggcactgtgaattaccaggagggagag

SEQ ID NO: 126452 - DNA, 2248 bp, Homo sapiens
caaaatttaaagtttaaaacacctgctcccaggcattctggatgataatctctatcgctattttcccatgagcctccagtgttctttccggtttttactcccttttaaatattctgtaaacagttctctttaaataaaatatatgttttgccatgtcatgcgctcagaggaggggtctggatcctctcttaatgacagacggatttgtcttacaaaggccattttcccgaaaaaaataggaaataacttggaggatactggtgggggctatacgtttggtgaaatccatcagtgatattcaagccaagcaaataatcacccactaatttgtgttttccacttaaaattcttggaggggaccatgttaaatggggagccctggtacagaaaacaacatgggctcatattcactcccttccccatctccctcttctgcttccccatgaaccttcccccacaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggtaagtgcccaaattgctggagggccatctgttttgacccttaaaggggtagctccttaccgtgctctcattgccgcctccccacctcccgctccagccctgccggggctaaagtgctgacagtgcagatagtggtcctctccgtgctaccgcactgtgggtacttgctgctccagcagggcacgcacagcgtccgtggagggaaaggccttttccccacttcttaaccttcactgagagggtggttggggtctgtttcactccatgtgtcctagatcctgtgctacagaccttcctttctgtcctcccgtcttggacctcagtcctgggggctccaaagtgctgttcgtgcaggtagtgtgattacccaacctactgctgagctagcacttcccgagcccccgggacacgttctctctgccaattgtcttcttggctgagctccccaagctccatctgtcatgctggggagcccagtggcgttcaaaagggtctggtctccctcacaggacagctgaactccgggactggccagtgttgagaggcggagacttgggcaattgctggacgctgccctgggcattgcacttgtctcggtctgacagtgccggcccaacactgcggatgctggggggaggggggattccactcctgttttgtgagtaggcgacccatgggctgcccagccttaaagccagaacaagggtgtcccctgacctcgttccactgccctcctcccgttcccatctttcccccctaccttccccttaggcacgtctgagaatggtggatgtggtggagaaagaagatgtgaatgaagccatcaggctaatggagatgtcaaaggactctcttctaggagacaaggggcagacagctaggtgagtggtttagtgaaggacaaagctgtgtcactttgtcttctgtggccatgtgtctgaggttggcctcaattctaacactggccaccattgttctctgttgatgtcgagcattcctgtttgtatcctgaccttacacacccactcatttccttcaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtcatcttctagcctgggcctgacttccattaaaacagggttttgtgcgttttttagattcctgttcgtttttatgctatttcatccactcagtaaattacctgagtaaagtgcatctccctgccaggcccccagtatagacactggggatgcggcaaggactaagcggtccctgctgtttggagatacttaagatggggctccactttttgagccccccgactccctta

SEQ ID NO: 126453 - DNA, 1314 bp, Homo sapiens
cttggccactttttgtatttttagtagagacagggtttactgtgttgggcaggctggtctcgaactcctgacctcgtgatctgcccgccttgttatcggcctccgaaagtgctgggattagaggagttagccactgcgcccggcctctactaaaaagttttaaaaattggttgggtgtggtagtgagtgcctatagtctcagttacttgggaggctgaggccggaggatggcttgagcccaggagccaaggtttcagtgagccacagttgtgttctgaagagaaccagtgggaggggaagggggacattgccagtgccccacagatcctcgggcatctcaagaaggcctggtggagggagtggaatgatcccagcgcaggcctcgcctccctggcccgtttgttgtcttttgcttgttctctttcttgttctttctctctcatggttccttatttcttctcttccaggccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggtgaatgaagctcaacacccaaagagaggtcccctgtaatgatctgtgtagggaggaggagaggtgaatcagaaaacaaattccacgctcctggaaaccccagagcctcccctttgcagcaggggctggtccatggttctcagggaaatggtgggttggggctgaaatgctgatgaggatttcccgggaaagcttgtccctcctacactgtgaggaagtggcagagccaaaggagggacacctaagaggacatgggtgcgtagccctaaaaagggtgttccttctaaccttccctctgtccaggttggcccagcacatcacctatgtgcaccagcacagccggcagcccccctcccagtttgaacctctggacatgaagctcatgaggtaggagagctgggtgcgggtgggcaaacgttggcgtgggccgtgcgagcctcctgaaaaagtgct

SEQ ID NO: 126454 - DNA, 3634 bp, Homo sapiens
gggcggaggaatcccgagctgtgaagcggctggaatccgggcccatgtgcttctttgtttactaagagcggaagcgatggcgggagcgggggtggggtgcggtggcggggtgcggtggcggaggtcccggtgaaatcaggggctaaggggacccaaagaaggcgggggatcataggggtggaaagaaagctgagaaccttgagaccggagtgtgaggggccaacggggaagggcgctagaattttaaactaaagtagggaccggaattcccctggggagatgttggatggccctgtgcactgccacgggctctttattcttcgctggttagaaacagacttgtgaaaaagagttatgcccactttggggagacttcggtaggtttatttaaatgctcatattattaattagttcataggtcgtgttttaagcgaaaatgggtatctaagatttgtcttaaagtttgtgtcttacggttttacatttcatgttacagaaaaggttaagaagttcttacaagagttctaccaggatgatgaactcgggaagaagcagttcaagtatgggaaccagttggtaagtctaagattgggtaaagggaatggggagcggggtgcttaaggagccataagcagcagcttggcttgttttattaaagacataacaattagagggtttgagggctgaaaagcgagtatcgctctgtgtggcgctgcgttctcccctgtggatgcccagagcctgtgctgagttctcagtgatgcattttcacatatgaacactggtgagcaaagtgaatgtggctctgaggtgtttctgtctcttccccacttgaggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtgagtggttagagaacaatggcaaacaaagggcgaggcgtttaagcttctgtagagaggctgctcagatactgatgttttctgagcaggcagaaaggaggggcacttctgcctggtgttctctgtgctctcctttccccatcctgttgctcttttttttttttttttttgttcttctcctttaggtggtaaataaagatgtcctggacgtttacattgagcatcggctaatgatggagcagcggagtcgggaccctgggatggtccgaagcccccagaaccagtaccctgctgaactcatgcgcagattgtgagtggtctctgtcgggaaagatgtagggattggttctccaggatcttgtttgtgactgttttctccccttagtgagctgtattttcaaggccctagcagcaacaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccggtacgtgtggagcaagaagcaggaaagcacttacccattagttgttttgtagagattaatttgatcctgtgatgcctattgttttatttggttgtaaaagttgcctgtgtgttcgcctttcattcttgggtatgtagtggtctttctacctattttctgggtgtttgttgttgacccagagtaagttcagagggttcttgacacttacaagatgtctgccatgaagagaaaatgtgattcaaaggaccgacccaatggggctcttttccttctgagttcctttggtgtttctgttctcacatcctagatccagtctcccactttcatgcctctgatcatgtgcccaagccaggagtgccaaaccaaccgctcaggagggcggctgtatctgcagacacggggctccagattcatcaaattccaggagatgaagatgcaagaacatgtgagtttggggtacgtggccctgggcaggtggatcgggagtccacttgaatcctgtagtcacttgtggaatggcaggaagaaagaagaacaaaagagggaagtgcaggagggaggtggaactagaatttcctgggagccttgggaaggggaaaggaggtctcagcacccctgctgtgggcttgtctgtggctgggtagcctgggagcctttgagtgggatgcctagggagggaaggttgggtccttgtccatttctcctagtcttatgtgcctttccctcccctagagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacaggtaaggaagagtttgacatgaggaatggatcatccccttttccctcacctactcattctacccacacagagaaaagagcagcaaaaccccaaacaaaacagaacccagggatttgtcaagaaattgttagggaatccagtgatgggcaagttgaagggattacatctgtatcctggcattttcctgcccaagggtttactctcagaaacctacctggaagcccatcggattgtgaagatgaacaagagtgaggatgatgagtctggggctggagagctcaccagggaggagctgaggcaaattgcaggtgaggggcaggggagagagaggaaattccgtttacatcctagctcccttttcccccagaaaataaaacaaccttaacttctctacagaggaggatttctacgaaaagctggcagcttcaatcgccccagaaatatacgggcatgaagatgtgaagaaggcactgctgctcctgctagtcgggggtgtggaccagtctcctcgaggcatgaaaatccggggtaagaagaaacaagggagaggctcagggtggatgaagtcatttaggaggaaaaaaggatgacaagtgtccctgtaggtcacagtatgagtggacatcttgccttcgtggacacagggagggcttagaaatagtgctgggtgttaggggtaggcagaactcaaaattgctctgttgttggccaagcactgggagaagagtcattccagggctgccttcccttcctccaggcaacatcaacatctgtctgatgggggatcctggtgtggccaagtctcagctcctgtcatacattgatcgactggcgcctcgcagtaagtagttgggctttgcgggaggtgaatatagtgacagacaggaccacagtgtttattcaaaaagtaggggtgcatgtttgctcacgcctgtaatcccaatgctctgagaggctgaggcaggagaatcatttgaggcgaggattttgagaccgcttccatgtctactaaaaagttttgtttttgtttttgttttttttgagatagaggcttgctctttcgcccaggccggagtgcagtggcgctatctcggttcactgcaagctccacctcctggggtcacgccattctcctgcctcagcctcccgagtagctgggactacaggcgcccgccaccacgcctgg

SEQ ID NO: 126455 - DNA, 1019 bp, Homo sapiens
gagcgggtcccccttggaggacagaatgaagaattgggaaatcatggccgttctggagagtagacaagaagacggcgaaagtcgggcctgccccgccctgcggccccggaacaaaagaacgcgtgtgcgctggccctttaagagcgattctcctccgcccgcgccagctcggaccgcgggaaacccggcgcctgcactaccccgcccggagattcccttccgacgcccgcaccgcctccccgtcactcattctaggcccgcacggtgattggcttgcggctagcgggaggtgaagaaggccgccttgtccgattggcccgcacgcagtggcgccggtcacgtggggggcgacgtttcgcgccaatttcggttggccggccacagtccaccgcgcggagattctcagcttccccaggagcaagacctctgagcccgccaagcgcggccgcacggccctcggcagcgatggcactgaaggactacgcgctagagaagggtacgggtctacgagcccgggagggcgtcctgcgcggggagcctcccggggaacacctgttggtgtgagctggggtcttgggggaccggggtcggcgggttctggggtgcgcgaggccagaggcagggtcgagctgcggcctggctaaggcccacggggcctgggaagcgtgcggggggccatcgatgttgaagaaaagctagtaatcccacctggtaaaggtgttagggtcgtggggttgggggcttgggggcgcgctaacccggctgggggctgcacagggaaaagtcgcgcccaggacctcaggagagtcttaagggctctgggctcccgtgcccgctttccttcgcgcttttgggcattcccaggttcccgcgccctccccaggcgcgcgtaggccccgggggcgggcaggccggggccgctgcgcgccgggattggccgtttgaggccgccctccgagcggaagtggagccgggcggaagtggcgcgaggaggctggagggagtgtcgtgtaaacagt

SEQ ID NO: 126456 - DNA, 1077 bp, Homo sapiens
cccacgtgaccggcgccactgcgtgcgggccaatcggacaaggcggccttcttcacctcccgctagccgcaagccaatcaccgtgcgggcctagaatgagtgacggggaggcggtgcgggcgtcggaagggaatctccgggcggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagactgtatcctagacccttggggctgggaaggggcggaggggccgggcgggaggggcgcccagggccagcctgtgtcgcaggatccttcactgagtccttccacccgccagtccgcggggacagtggcggccgggatgtggccgagctcttctaccggaagctgacgggactgccaggagacgagtccccggttgtcatggtaaccagtggcgggaggcgggtgaggagcggggtcccgtcgggccgggtgggcgccagctccctcccaggactggttcattggtagattccacttggggggtgcattccgccaaataaagctaacgtgaggcccggcgcggtggctcacgcctgtaatcccagcactttgggagaccgaggcgggcggatcacctgaggtcaggagttcgaaatcagcctggccaacatggtgaaactccgcctctactaaaaatacaaaaaaaaaaaaaacatagctgggcgtggtggcgggcgcctgtaatcccatctactcgggaagctgaggcttgagaatcgcttgaatccaagaggcagaggttgcagtgagccgagatccggacaccgcactccagcctgggagacagagcgagactccctctcggggtaggtgggggtggggaaaaaaaaaaaaagagtcaatgggcgccagcaacacaccaggcccagctccctgcgtgactccatcctcagcaactcggggt

SEQ ID NO: 126457 - DNA, 1035 bp, Homo sapiens
ggctcaagagcttccttcctagcggctctggtgaggcatctgcaggcaggaccaagggttggggttagggcgggttccttggtgtcttaaaccatggcattgctgagctctcctgatggtctctcctccgacagagatgcgcattggcttgacggaagagttttgtgtggggaagtcagagctgagaggtgaggagaaagtgggtctttctccccttggagtaggtcattgccagagttcatggagagaagtcagacagagcctcccctctccttgctcctctcccaaaacaggagtcaggagagaagtctctctctctctctttccaggttatgggccaggaatccgggtcgatgaagtctcgtttcacagctctgtgaatctggacgaatttgagtctcatcgaatcctccgcttgcaaccacctcagggcgaggtcagggttggggtggcctcataaattccgtccaccatggggaagggggcagtggggtcgtgagaccaaactaaccttgttgctctctggtctctcagctgactgtgatgcggtaccaactctccgatgacctcccctcaccgctccccttccggctcttcccctctgtgcagtgggaccgaggctcaggccggtgagacaatttcctgggttctagaactaccttggaacccaagccaagacctgtatgttcccaagactcactgcagagtgggggtggtggtagtggtgatggagtgcaaattggaaaaaggcttgggttgcggccggtggctcacacctgtaatcctagcactttgggaggctgaggcgggaggatcacttgagcccaggagttccagaccagcctgggcaacatagtgagaccccatctctctgaaaaaaaaaaaaaggaaaaagctttggctaatggagttgggctgggcttcagcccttttccctcttgggagtacagcccacacccacacagccccacatggaggtccctggtggggaatggtgagatgccagtagaagatggcctgagtcgtggtgtttta

SEQ ID NO: 126458 - DNA, 1018 bp, Homo sapiens
gggtggtcaggtgagtgtgtgcacccaccacggggagattcctggggagagagtgagctcagcatgacgggtctgcctcaagaaggtgccaagcccagcaccttccctttccaaactccagcctgtctcaggagctgagcagcccagagcagaaggctgagctggcagagggagcccttcgctgggacctgcctcgggtgcaaggaggctctcaactctcaggccttttccaggtattcgctgtggacccccagcccctctcctcccacattcacttgcagcccccaccccaccctcccgaagcagctgctgcctggttcccccagcgtggtcagcttcttgccctccttcctctccctgcctctgcccctcacagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaaggaagcaatctacaacttccttccgcttagcgagcatgcatgtgtgtacgtgcacgtgtgtacatgtctgcatgtgtgggaatccgggggctggcaggtggagcatcacggagcaggctgaggggagccggagttgggctgggagccattggcttttgg

SEQ ID NO: 126459 - DNA, 1017 bp, Homo sapiens
gtgtcaccagccctccctctacctggcttttttccccagccctccctctacctggctttttttctgttctgcagaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcaggtccgtggccgggtggggaggaggaataggaggaagcagaggagaacccctgtgtgggacaggcacttgcacacagccacatgtgccctcagtcagtagtctcagggcaaccaggccctgagtgaggatgccccagccctagtgagagccactgaggaagagcgaggggagcccaggcctctcccttcagactcctcttcttagtagatggtgccacttccccctttcctcttctccccgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtatgcagagctgtgggacagggagcatctggagggcctgggttacctcagagcaccctggggaggcccaggagtagagcacagtcccctctgggccccaagtcaagagctggaagaggcgcccaccagggtcctgcagggctgtagctgccctgcatgaacaaggtctccagccatagctgtctacagggtgaactacaggaacaacttgttcaggcagggagcgagtgaagcgtcctcgccaggcctctggggggcagggagggcacagggcaagcggcctgcctttcctttctatccaggtcctgtccctcagcacctcggcccc

SEQ ID NO: 126460 - DNA, 1475 bp, Homo sapiens
cctccggggtaccactcagacccgcccccgccacccgagcgcggggagcaggaaaactctagcggcagccgagacgctgctcacccggcgctcggcgccatcttggccccgccccctcgtgggagcaggtcctggcagagcctaagagcaagtcactgccccttccccgtaccagaataagtcctctaggctcgcagaatgaaattatattttaaaagtttgtttctacatctatatataaggagcactccctcttggtgtaattactgcaatttattccttcactacccggctgccaggaccttcaagaggcgccacaaaacggaggcagggaaacccgtagcaacgaggccccacccttgttgggctgatcctgcgcatgcgccgaccttcctcggctggatttaaggttgccgctagccgcctgggaatttaagggacccacactaccttcccgaagttgaaggcaagcggtgattgtttgtagacggcgctttgtcatgggacctgtgcggttgggaatattgcttttcctttttttggccgtgcacgaggcttgggctgggatgttgaaggaggaggacgatgacacagaacgcttgcccagcaaatgcgaaggtatttgaagggggtagcccctataggcatcgcccggccacacctccttcttctaggccggacatcctagcctgtattgggtgggtcacccgacctccttgaaggcttgagggaggttctggtggagcttggctgaatttggatggggtcaaggaagcgaacgtgtagtgccacctcaaactgcatccagagagagcctgcatttttttggctggcttggaaccccccgcccgccaatggattgtgggaattgtagttcagggaccatcggcccgggactgccaacttttagagcatcttcagtgagtgtttacctcatgtcaccagaccttaatctgcagaggctgcaggagccgggtgtgaggctcaggccttgtggacatccgctgccctaccctagcatagacgctcccaaattacaggccccacaccccgctgagggggtttgagggtgagtaattcagcctttgaagctcataaacaaaaggaagccacacaactaggagagtgtccccatccggtgagactttgcagacggtgcgtactatatggatttttcagcaagcagcgccttccatagctgcactagcgtggggcccagttgagaaagggggctggccctgatgccctagtttgctgccctcctgactttacgtttcttccctggattccttttctcttcgcttcaccccctcaactgtattccagtatcatgaaaggcagtcatgacagtctcatgacttggtcctcatctctgtctcctttcacctccgtgtgccgctcttctcccctgacctgtcaatctttttaaacagacttaatcacctaattgtatcagtccttgctttaacacctct

SEQ ID NO: 126461 - DNA, 1033 bp, Homo sapiens
tctttgacccttgcctttgagcccccaggaggggaagggatcatggagagccctctaaagcctgcactctccctgctccacagctttcagggtgtgtttatgagtgactccacccaagcttgtagctgttctctcccatctaacctcaggcaagatcctggtgaaacagcatgacatggcttctggggtggagggtgggggtggaggtcctgctcctagagatgaactctatccagccccttaattggcaggtgtatgtgctgacagtactgaaagctttcctctttaactgatcccacccccacccaaaagtcagcagtggcactggagctgtgggctttggggaagtcacttagctccttaaggtctgtttttagacccttccaaggaagaggccagaacggacattctctgcgatctatatacattgcctgtatccaggaggctacacaccagcaaaccgtgaaggagaatgggacactgggtcatggcctggagttgctgataatttaggtgggatagatacttggtctacttaagctcaatgtaacccagagcccaccatatagttttataggtgctcaattttctatatcgctattaaacttttttctttttttctaaaaactagctgggcccaaagtttcaaacaacagccgggcacacatagctagctggtcgatgaggcagcacccagaatggccgctgtcttgttaagctcaagctccagcctgagcaacatagtgaaaccccaattctacacacacacacacacacaaagaagactgcagggctggtggtgcagcgcctgtagtcccagttactgcagaggtggagatgggaggatcacttgagtccaaaaggtcaagaccagcctggaggctgggcgcagtgactcacacctgtaatcctagcactttgggaggccgaggcaggcggatcacctgagtgtaggagttcgagagcagcctggccaacatggagaaacctcgtctctaccaaaaatacaaaaattagccgggcggctgggcgc

SEQ ID NO: 126462 - DNA, 2990 bp, Homo sapiens
tacctcggcctcccaaagtgctgggattacaggtgtgagccacagcaccccgtcctgtttttttgtttgtttgtttttttttaagatagagtctcgccgtcactcaggctggagtgcagtggtaacgatcacatctcattgtagccttgaactcctgggcccaagcaatcctcccgcctcagcatcccaagtaactagaactacaggcaagcaccaccacgcccagccattaaaaaaaaaaaaaaaatgtgtggagacaggggccttgctatgttgcccaggctggtctcaaactcctggcctccagcattcctcctgccttggcctcccagagtgctgagattacaggcatgagctcctgtgcttggctggaagaagttattttaaaggaggaatcagtatatcttgctaatgactagaaataggtaatagaggaaatatttctgtagccagaactctaaagcctggaagagtgatgatgccttaagaaacatgtccctgcgtggtggctcacgcctttaatcccagcactttgggaggctgaggtgggtggatcacttgaggttgggagttcgagagcaccctagccaacatggtgaaacctcatctctacaaaaaattagcctggcatggaagcacatgcatgtaatcccagcttcttgggaggttgaggcaggagaattgcttgaacccaggaggcagaggttgcagtgagccaagattgcaccactgtactccagcctgggtgatagagtgagactctgtctcaaaaaacaaacaaacaaacaggaaatcaaaaaaagaagtggattgggaaggaggtggataaggataaggtgaaatttgatggcccaactttagacattgagtttgatataaaatagcagttaatatatattgctagttcagcaaaaggaactaaatctagtggaggcccatatcaaggaagagggaagaggaagttgagacagtcaccagaaaagaggaagcccaagccactgtcccatcacttactctaggggtcaacagagggaggtattcaaggacaaagggaatgtttatgtttgagattctgcaaacagggcagcaagtgtgaagacagaaaaagatggagccattaacaggtaagtggtgggcaggcattcattttggagaatgtggctttatcaaataggcagggacatgggagaaatccagttttatggggttagaaaagcatggtcaataaagagatggatggccaggcacggtggctcacgtctgtaatcccagcattttgggaggctgaggcgggcagatcatttgaggtcaagagtttgagaccagctgattaatatggtaaaaccccgtctctactaaaaatataaaaaattagctagatgtggtggtgctggtacgtgcctgtaatctcagctatttgggaggctgaggcaggagaatcacttgaacccgagaggccgagattgcaccactgcactacagcctgggtgacagaacgagattccgtctcaaaaaagaaaaaaaaaaaaaagatggataagttactgctcatccggggaaggccagtattatgggaaacaggatggcatccggagggtgacaacattatagggggagatttcaggttgtttttttccaaagctgagggtactggcaagccaagggggagagggtctaagtgtgagaaccaaggggactgtgcctggaattccttcctgagcctgtgccgtaatgcccgcccctctccctcctccgtctgcatgcagtcatctggggacctggagaatgatgagcaggcagccagtgccatctctgagctggtcagcacagcctgcggtttccggctgcaccgcggcatgaatgtgcccttcaagcgcctgtctggtgagcccctgcccctgcccttggtggtggtactgggagcggggggctacttccaggggcttctcggcttctcttcttccagcctcctaccatctcctggggtctctggtctggccactttcctccctttgggactccctggtatcagaattgtgaatgagaaggcaagagaaaggagatctagcagaggccactcatcttcaaatctctgagcctggaactatagaacttctttggctttgatcccagccaatgtgcgtgtggccccgccccatggagtctgttgcacccactaactctgtgctcccttccctctcctggggcgggggaaggtgtgtctctcctccagtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctccagcccagggacatgtgtgtttagtgttggaatggttacaccccatgtctgtcttccaccttctggggagaaagtcatgcaccttagcccaagttgggtgcggcagggccacctctgtgtgctataaaactgggaagcagaaaaagctggaggggaagggagtcaccctgagccctggcgacctctgctcttcccatcagtacacaaactagtcatccttctccctcctgaacaggcatttaatagtcttatttcagttggaagcaatagttggaaaataagttacaggaacagaccaaaaaaaaaaaaattaaagtgcttcaggctgcaaacgtaaacataaggggcaggaggctacctggccctgtccccaacccctgagacaggaaggtcactgtcaggggcccttagccatcaccacc

SEQ ID NO: 126463 - DNA, 1049 bp, Homo sapiens
gagccatcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggctgggactaagccaccagtattccccgagttcctgtggggggggctggccccacccctaggccagggcaagggttcccagagctcccttgtccccggccctttaccctggttctgagtttacaaagtctcttcctcattcccgttgagttctttcccacctctgacattccctccctccctcccgcagggctgagattagagggtggtgatggctaagggcccctgacagtgaccttcctgtctcaggggttggggacagggccaggtagcctcctgccccttatgtttacgtttgcagcctgaagcactttaatttttttttttttggtctgttcctgtaacttattttccaactattgcttccaactgaaataagactattaaatgcctgttcaggagggagaaggatgactagtttgtgtactgatgggaagagcagaggtcgccagggctcagggtgactcccttcccctccagctttttctgcttcccagttttatagcacacagaggtggccctgccgcacccaacttgggctaaggtgcatgactttctccccagaaggtggaagacagacatggggtgtaaccattccaacactaaacacacatgtccctgggctggagaacatcagactcatgtttattagggagtgagggagcacaaagggaggtctccttgcccttgttctccttaacacagctcagagtccccaagcctgggcccgtccag

SEQ ID NO: 126464 - DNA, 1131 bp, Homo sapiens
cagggtggagtttgccaaacagagaagcaaggcacagacactcattgttttcttctctccttctatctgtctgtctctgtctctctttgtcactcttcccgcacccctcttcctggctgctttctgcttctgtgtacttctgatttttctgttttttcctgttatcctctctccccatctgcctgttttgtttttttttctctctgtctcactgtctcccatcatgatctctccccccatgtctgctgtcggatctctctccttccttctctccctgccttcctgtcactcatggtctttctcccttccccaacccggcatccacctgtgtctccctccctttcctctctctttctgtttttatctcaatttcttttcctccctctgtctccctctgcttctccctcccatcctgctctgtccctcttcttccttgcagatgaggatgccagcggctctggagggggacagcagtatgcagatgactggatggctggggctgtggctcccccagcccggcctcctcggcctccataccctcctagaagggatggttctgggggcaaaggaggaggtggcagtgcccgctacaaccagggccggagcaggagtgggggggcatctattggttttcacacccaaaccatcctcattctctccctctcagccctggccctgcttggacctcgataacgggggaggggtgccctagcatcagaagggttcatggccctttcccctcctcccccctcagctgggcctggggaggagtcgaagggggctgcagagagggtagagaagggactttgcaggtgaatggctggggccccaaatccaggagattttcatcagaggtgggtgggtgttcacaatatttattttttcatttggtaatgggaggggggcctgggggtatttatttaggagggagtgtggtttccttagaaggtatagtctctagccctctaaggctggggctggtgatcagccccaacagagaaaatgaggagtttagagttgcagctggggaaggggtttgaaggaagttggaagtggggaggggtgggggcatctggtctcagaaatggaccagctggatgcagggcaggggactgagggtgcttgagtagg

SEQ ID NO: 126465 - DNA, 1568 bp, Homo sapiens
cacgtatatatatatacacacacacacacatatatatatatacacacacacatatatatatatacaaaaattagccggcatggtggcaggcgcctgtagtctcagctactccggaggctgaggcagaagaatcgcttgaacccaggaggcagaggttgcagtgacccgagatcgcgccactgcactccatccagcctgggcgacagagtgagactatgtctcaaaaaaaaaaaaaatcctaaaatcctaaaatttaaatttaaattttaaaaaagtctgggatggaggagggtcctgagtaaggctgggggtgaaatggagaggggctttaaagccaaattggggggatacatgagagggagctcatgtgagtttcccccaaacactttgctgcttctctaaggcccgagtgaggattttcaggaacatcctagttcagtatcaccactcatcccatcctttctctttctctccctcccttaagatggtctcctgatcctggctgataagctccagggccccttttcctttgagctgacggccgagtccattggggtgaagatctcggagggtttgatgtacctgcaggaaaacagtgcgaaggtgtccgcccaggtacaggggagagaagggtggaggtgaggcccggggcggggacggtgtgggtgtcagagaggcagtataggggatctgggaagagactctggggtcagagtggggacgcagtgtggtttccccccagggtgactgtgtgaggtctcttcccggtgccgcaggtgtttcaggagtgcggcccccccgacccggtgcctgcccgcaaccgtcgagccccgccgccccgggaagaggcgggccggctgtggtcgatggtgaccgaggaggagcggcccacgacggccgcaggcaccaacctgcaccggctggtgcgtgggatgaccaagagttgggggcgggggggcccggggccggggatggttgtgggggtcgcgctccagctcgccccgccccctctcgcccgcccaggtgtgggagctccgcgagcgtctggcccggatgcggggcttctgggcccggctgtccctgacggtgtgcggagactctcgcatggcagcggacgcctcgctggaggcggcgccctgctggaccggagccgggcggggccggtgagcctcgggggcgtcggggggcagcagggggcgggaccgcggccgggaggggcggggccgcgcgcgctagctggcgcttcggggctgctctgctcgcaggtacttgccgccagtggtcgggggctccccggccgagcaggtcaacaaccccgagctcaaggtggacgcctcgggccccgatgtcccgacacggcggcgtcggctacagctccgggcggccacggccagaatgaaaacggccgcactgggacacgacctggacgggcaggacgcgggtgagacccctgcatccctgagcctgagccccgcccactgccctgaagcctctcccctctcctggtagttcccgcccgtgcctctgctcttagcgttcattgattaattcactaattcattcaacga

SEQ ID NO: 126466 - DNA, 1091 bp, Homo sapiens
cacagctcctctcggtgcttaggaccccagcaaggctcctgtccccactccttactccatctgtgaagactccatcccctcccagcccgcccaccccccagactctgtctccagggccctgccctcccccattccctgtctgccccatctctgagagttactcagtttctgattcacttgtcttttctcttctctcccatctcctcctgcctctgcctgttcacttttctccccattctttggcctgacctgccttccacctgttccctgcatttgctgcagagttttttctggagatgctctcagtagcccagcactctctgacccagctcttctcccactcctacggccgcctgtatgcccagcacgccctcatattcaatggcctgttctctcggctgcgagacttctatggggaatctggtgaggggttggatgacaccctggcggatttctgggcacagctcctggagagagtgttcccgctgctgcacccacagtacagcttcccccctgactacctgctctgcctctcacgcttggcctcatctaccgatggctctctgcagccctttggggactcaccccgccgcctccgcctgcaggtgagggatcctgaggcctgagcttcaaccacttctgacctagtgacccctgaactgtgcaccactcacctccaaactggcgtgctccagtcacctctgacctggtgatcccccatcctgcattgaagccatttctgacctggtgatccctatcctgagctttactcaccactgcccgacccagtgccccttggtcttcttgaagcagatgcccccacccctgccacctcccattctgagccctagtttcacacaaacactcacctgcccttagcctccagccacctttgtgccaaccccttcctaatcgtaacaccttgacttcctctggttcaactaaacaggaattgtgcattcaatacgcaaaaggcattttcttttatagtatcacatttagttgtcatcataaccctgtgaggtagacagtcatgcccttattttacagatgagaaaactgaggctcccagagattaagcttttcagcca

SEQ ID NO: 126467 - DNA, 1054 bp, Homo sapiens
tggccctgggcgagccgttgggattgcgcttgcgcacagcgtgtcttgtacgttcccgcgcttttctggaatctttcgcccccggaagggcagcggcgggcgcctgtgtggaaggtggggtggccagagacacccgagggacctgaggtggggaccttccctgaaccctgctcggccagaagtcactcttccaggctctgacaggtttctccttgacccaagaataggccctctcgcgaccctcccggccctgacactaggagccttcccgggccgtgccccaatggcctccgccacagagctggagaatcctctccccaggcctccatagactgagagtccattctcttaagcgcttggaaggctctttatcctggagccgcttaccccaggggcagtcgtagatatttttaccttctggaaaaataggaaacgcgcacctgcctttcctccttttgcgtttccagccctattctcatggcgcctccacccccaaatccttaagagcctcctgttccattccaggtggaatcaggtgctagtcctctggaaacgaaagcctggggtcttcttgtattttttttcttatttctttctttattttttttatttcattttaaaaaacctgtaagttcccttgcagagggcggtttatacttccgaagcctccagagaggggtgcgtctgaagctgccctgctgtctgccttgcttggcttttttttttttttccatttaattttttttttttagagacagggcgttgctatgtggcccaggctgatcttgaattcctggacccaagcgatgctcccgcttcgccctcccaaagtactgggattataggcgggagcactgtgcaccacgcctcggcttttggagagcaattccaaacccactgcccagtttctggtgtctgtaatcccttggtgctttaggtccactctttgccttattttatttatttgtcattacttttttttttttttgagacagagtctcgctctgtttcccaggctggagtgcagtggtgcagtcatagctcgctgcagcct

SEQ ID NO: 126468 - DNA, 1086 bp, Homo sapiens
caccttatatgcagttgtacagcgtgttagtttttttttttttttttttttttgagacggagtcttgttctgtcgccaggctggagtgcagtgacgtgatcttggctcactgcaacctccacctcccgggttcacatgattctcctgcctcagcctcccgagtagctgggattacagatgcatgccaccacgcccaactaatttttgtatttttagcagagatggggtttcaccgtgttggccgggatggtctcgatcttttgacctcgtgatccgccggcctcggccttccaaagtgctgggattacaggtgtgagccaccatgcctggccttttatttcttttttttagcccattctcccccttttatttttaaaattttattaaacatagtcattttataatctatgataaattattatctaaagtctttgtgagtataattctgtcagtgccttgtttctttatatgttttactaggttttattgtgagccactcattttccctggagttcttatgtgttggaattctttggggcctaggccaaagctgggtttttaagaaaggaacctgcttttgctttgacagttgtctggggacactccagaatcacttttttttttttaagacagggtctcattctttctaggctggagtgcagtggtgctatcacggctccctgctggtttgacctccctcagtggcgaggtggtgatcttcccacctcagcccctctcatagctgggactataggcatgtgccaccatgcctgactaattattctgtttttggtagaccagcctgggcaacatgagtttcactttacttgggttactgctcccagcctgaatcgcttttaattatctgaatgattattctgggctgggtgtggtggctcatgcctgtaatcccagcactttgggaggctaaggtggatctcacttgaggtcaggagttcgagatcagcctggccaatatggtgaaaccctgtctctactaaaaatacaaaaattagccattagccaggcgtggtggcgcacacctgtaatcccagctacttgtgaggctgaagcaggagaattgct

SEQ ID NO: 126469 - DNA, 2168 bp, Homo sapiens
gttcaagcgattctcctgcctcagcctcccgagtagctgggattacaggcacccgccactatgcccagctcattttttgcatttttagtagagacggggtttcaccatgttggccaggctggtctcgaattcctgaccttgtgattcacccaccttggcctcccaaagtgctgggattacaggcatgaccgactgcacccggctggcctgcatcttctttaggccgttcttgttgtgcttcttggcaaagcacatattcctcaggaatttgggtccatccgcttaagagatttgtatctttgtgattggggtttcttgatgccatttctgtgcagttttcagcctggttgtgtgaggtgtggttcttggatttggccatgtctacaccataacctgtggctcccttcctttgggtttttagagagattgccttatagcagatacatggttggatgttggcagactgttgaccagggggtcttctcattccccacctaagctctttgcagaatgtttccttgctcatcttcaggtatatctgtaaatgatcaaagcatcctgttattttccttgtaagcacctcatatccttcattctttaggcattgtgacccctgagatgttcaagaagatgtccaactcagagatcatccagcacctaacagagcagtttaatgaggtggaagaagatgaccaggatcctcttacccctcttatttcaaaacacaatgcctattatccccttctttttgattctgtgaaatagggtagcttttagaaggaggaattcagtctcttgggggtaaaagagatctgaatatgcctctcaaattggggagaataccaggaaatgaggtataacagatatttttactggactgttgagttttgacatccaagcccctatgacttcatggacctggtaataactttcccatccttttcatacatccttttgtaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctggtgagcattcatttttactctggacattctcctggggatttataggactttcctctgttctctgattcaggatcttctttcctacctgcatcttggctcttcacttcaaggccatgcctcttttatcctaaacttcaatccagtttctcactagtggagttttgagaaggggtagatcacagcaacaatttccaggtttaatatttttgtcagagctcaccactaggggtatgctgatggttaaaagaagaccacaagggttcgagggaaacagtccactccaggacaggccgtcttaggattttagggtcatcctgctctgacgtctcattttcattgcccttctttccttctattttttccttctactcatcctctctcctctgacctcagtaatgatttctttatctctttttcctttctcaaagctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagaggtgaggagtgttccctgcttcttccttccctttttcccaacttgcacccacttctgccacagacccccttatcaggccctgggcagtctttcaagatcatgaataatggagtctggcaatagtttcatagacccatcctgtaaggggtcattacatgctcatcttgtttctgggttgtgggctcaacaaataatgtgtaatttagagttctctctaattccacttttgctcagtttttttttttttgtcagcactcattgttaggagtgtttaagtgctgtacctgcctgtcatgcagggaattaagttttgacctacttgtcaagtgtgcagtgtgcaagtgagtgcaggagtactaaaagccaaccattgacaagggaggccaaattttcaaggaatggaaagaaaacaggcctcccagtg

SEQ ID NO: 126470 - DNA, 1057 bp, Homo sapiens
taactgaatcctttttgctacctagcttatttccccattttctttgaaactgttctttctaaaccaatgacttcctaattcctaaagccagtagccttttctcagtctccctttcccaaatattttacatatttgctttacctatttttgctattttagtgtaaaatatggacatataggtacttcagccctaaagacttaagtatgtcctgtcgaaaatgatatgttgttcttacataattgaagaggtggggcctgttgtcttaaaggatgttccctttctccttataattctgtttccttggtgtctattgttcatgtgatccaggatttttcaataatggcactatggacgttgcggggctgtcctgccatggtaggatgtttagcagatctctggcctttatctactagatagataccagtagtaccctgctcccccagcaagttgtggcagccaaaaaaatctttagacactgctaaatctcccctggggaacaaaattagcctcagttgagaaccactgatctaattcctttcttctcatttttgctagttccacttctattaaactgcaacttactaaaaatttgttttccaaattgttagaaacatatacgggcatcatacctcaaagatattgcagattcaattccagaccaccataataaagtgaatattgaagtacagtgagtcacacaatcaaaaaatcaaaatttttaattctcagtgcatatgaaagttgtgtttacactgtagtctgttaagtgtgcaagactattgtctaaaaagcagtgtatgtaccttaatttagaaatattttattgctaaaaaatgctaatgacaatctgaacctttagcgagttaaatctttttgttggtggagggtcttgcctccatgttgatggctgctgactgatcagggtagtggttgctgaaggttagggtggctgtagcaatttcttgaaataagacaacagtgaagtttgctgcatctactgactcttccttttacaaaaaatttctctgtaacatgaaatgctgtttgatgacattt

SEQ ID NO: 126471 - DNA, 1447 bp, Homo sapiens
ggctgaggcaggaggattgctcgagtccaggaggtggaggctgccgtgagccatggtcacaccactgtactccagcctgggtgccagagtgagaccctgtctcataaaaaaatatgtaacattaaagattactgatcacagataaccataacagataccataatgaaaaggtttgaaatattgtgagaattaccaaaatgtgccacagggacacaaagtgaggatatactattagaaaaatggcactgataggtatgctcaatgcagggttgtcacacacctttagtttgtttaaaaaaaatccacaatgtctgcaaatcaataaagtgcaataaagcgagatacacctgtataatgccagctagggcttctgaatagtccgaataaccacatgcagaggggttattatttttactaaacacaaacctctgaggcattagttgactatacagcttcttccagaattagaaggtttaaaagagagcataggattacgggggttcacactatcctataataaacaggaagtaggtggaagttgtagtttttctgtatcttcagggccttatgcttgttagggtacaagaaagattaacccgtttctccctgtcctccagctccaagagcatcaagaggagattgaggggatgatgaatgccctcttcaggggtgtctttgttcatcggtacaggtgagctaatgggcctctctcattgaagcagctggcctttggttatggaatctgaggaagtgaataaggttttcccccctccaacccttagttatttggttagtcccagaattaatgcagctggagcaaaaattcttgacaacaaatgtttcaaattggtgaggtttagtttatcaccacctacaaaggatcttgtaagtgcttctgggagaaaataagagaataaagcattgctgagtattttcctgctctggctttgccccagatctgccccaactcctcatctttctggggttggagacttgaggataagagcagagaatagaaaggcggggcttttctgagggatgcctgctgcctggtgagccttctcctggcccagcctgctgtctcactgtgcgaagggcaggggagttttatactgtttaatgacctgatcaaattaagttaaaaagaatatatgtaggccgggcgtggtggctcacgcctgtaatcccagcactttgggaggccaaggcaggcagatcacctgaggtcaggagttcacaaccagcctgaccaacatggagaaactccatctctactgaaaatacaaaattagccgggtgtggtggcgcatccctgtaatcccagctgctcaggaggctgaggcaggagaatcgcttgaacccaggaggtggaggttgcggtgagctgagatgacgccattgcactccagcctaggcaacaagagtgaaactccatctcaaaaaaaga

SEQ ID NO: 126472 - DNA, 1021 bp, Homo sapiens
gagccctttcctcgtgtccattccaccagactcttctaccctgagtgcgagataagaatgatgggtggaagagagcaacgccagagcccaggcgcccagaggactttcttccagcttctgctgtccttctttgtggagagcgaggtgacatacacagagagaagtctggctgttgtgcataggacctacaagtgggctggggttggtggctcacgcctgtaagcccagcactttgggaggctgaggtgggaggatcctttgagcccaggagtttgagaccagcctgggcaacacagtgagaccctgtctctatcgaaaaaaaaaaaaagacaaatggagaaggatgggagtggacactgtaggaaggagagcgatatttaatcagtaaccacttcgtagggtatttttaacatgctatcattaactccccatgcacgttctcccctagctccatgaccacgctgcttacttagtagacagtctgtgggactgtgcaggggctcggctgaaggactgggagggtctgacaagcctgctgctggagaaggaccagagtacgtgtcacacggagccagggacagggaccttccaccccctagggtgaaactgggagggattgcttgcttcacttgtacaaggcagcaacggtggcatcgggtggggggagcttggagttggaaggtggctaatctttgattctatgtttttgatcctcctggcactccagacctgggtgatgtgcaggagagcacactgatagaaatccttgtgtccagtgcccggcaagcttcagaggggcacccgcctgtgggccgggtcactgggaggaaggtatggtgtgagggtagagtgggtaggtcagcaatactcagtcttgacaggcaatgtgcatccttatcccccaggctggggttagggtgctccttctaccctttaaagaatttcatttccagaaaaaagggccaggcgcagtggcttacgcctataatcccagcactttgggaggctgaggcaggcagat

SEQ ID NO: 126473 - DNA, 2373 bp, Homo sapiens
tttctttacacctcccccacccccaagtgactctcattccagggcttaacctctaaggagcgcaagacccaagccgatgacagggtgaagttgactgagcacctcatccccctgctgccccagctcctggccaaggtaccgctgcccctccactctgcatcacaccaagagaagtgaaaggaaatggcctctgtgggggtgggagtaggaattagcaatgtgtcagcttgtaaggaggcctccctgtcaatcatcacagttctcagctgatgcagagaaggtcactcccctgctccagcttctcagctgctttgacctccacatctactgcactgggcgcttggagaaggtagggagatagatttcctataccttgctgcttgcctgccagggccaaagggttctattgccagtatctttttttcctaagaacttgggttccagaaaaatcagcaagccttttcttaggcatcttatccttgaagtttaatgcttttaaccccgttccacttcccgccagaagagtgtcctcctcccatccccacagcacaccatcttctgccttttcttctcagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacaggtaggagctggggctggacaatgggacaccccaaacaagggtgggaggggctgcaagacgggggatgtggactgatgagttctgggggaaatgctattgtggatcttctttccttctcagtcgtccttcctagatgaggatgaggtatataatctggcagccactctgaaacgcctctctgccttctacaagtgagtggctttcctcctcttccccatcccgtttttactggtgtctgtggagttggttccctctgttcttttccagtataacattcccctttctcccccaaagcactcatgacctgactcgctgggagctctatgagccatgttgccaactcctgcagaaggctgtggacacaggagaggttcctcaccaggtgagtggacaggctagagatgggttgggggctggggggctagattttaaggacctacgttctaggtggccactaggtgtgtcaagtctcagtgcgtggagtggacaaagcgaggaagatcaggtgggtgggggtcacctcttacattcctctcttagaaggtggactctacttccagggtcttcttggatttcctggaagccaaggataatattgagggattctagaagacgtagagtaaattagggagcggtgacatttctacttcgtgtagatgcctctgaagaatgtccagaatatcactcattttccactggaaaaggaattagctctccctttactcattttctctcctcttcactggtgtgtttctggctatctgtctctccctctcctaacccaaacctcatttttcaaaccctttgttgttacaggttatcctgccagccttgactcttgtctatttttccattctctggacactaacccacatttctaaatcagatgcttcccaggtgagtgtgggtcttagatgggataatgggaacagaggagtctgtgtcttcattcttccccttcaagccactgtgcccacagaagcagctgtcgagtttgagggacagaatggtggccttctgtgaactctgccagagttgcctctcagatgtggatactgagatccaggagcaggtgagtactgactcaagtgggagcaacaaggcgagtatccctgcccccattccaaggagaaattgacagtgtcatttctaccttgggaaacattctgtccttttaaacatcctttcttttccccctacaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgcagtgactctatacctggggctcagtaagggctggggcttgggtgtagctcagaaatatagggcaggaagcttaagtctgtgattcccttttgccttccatgtgagccaggtgattcccaggaggatcatttacagatagagcggctacaccagcggcgccgcctcctagccgggttctgcaagctgttgctttatggggtgctggagatggatgcagcctca

SEQ ID NO: 126474 - DNA, 1135 bp, Homo sapiens
actgctgggattataggcgtgagccaccatgcctggcctgtttcattatttgttttttattttatttatttatttatttatttattttttgagacggaatctcgctctgtcgcccaggctggagtgcagtggcgtgatctcggctcactacaaggtccggctcctgggttcacgccattctcctgcctcagcctcccgagtagctgggactacaggcacccaccaccacgcccggctaattttttgtatttttagtagagacggggtttcaccgtattagccaggatggtctcgatctcctgacctcgtgatccacccgtcttggcctcccaaagtgctgggattacaggtgtgagccactgcacccggccttattatttgtttaccgaaactctgatttattttgggctttgcacctgttgattagagatgaagtctagtctgaattattttatgcttcagttcatgtttcctacctaagggagtttgggagggagacatgattagggatgtgaaggaagaaaccaaatggtcttttccaccagtcagacattaccttccccactctttcccctcagttctacaatgactatggtgacattatcaaggaaacattaactagagcaaggcagattgaccgaagtcattgttcccgaatcctgctgctgagcctcaagcaggtgcgcccttctgccttgaggacatgccagccctgttgtccccaagtctctgtctaccctcagccactcagaatgtaagatccttcagagcagtaacttttcttgttttgactcttaactttacgtgataggttccttcattcttagtagacccttgggaagtattttttttttaactgactgggcaaccccatcaaaagtaacttatcaggacattggaacgccaacaaggaagtgatagggagttcctaattatttttcagtctgttctctctcagcctccttcagttactatagacgtttttatttaatgttatggagtagaggtgattggctttgtttgctgcaggggtatcgggagttccctagaaggaaggaaagagtaaaagtagtagatggtgtcccaaggcctttggaatttctgagtagagaagagaatgctggacttctctgtt

SEQ ID NO: 126475 - DNA, 1311 bp, Homo sapiens
agcatcacactgggggaaggatttcaatatgtgggtttagggggacacagatattcagtccattacaggctgcgtatcttctgctgttattcttctgttctcttctctgcagggaaggaaaaagaacagaatagaacagaacaggggagtcttgtgctcagaaggagaaaccaaacaatgataccttcaaaccagagactagagagcaaggcctctgttaaaatattatttcctaacatctcagaaaaaatccgttttctggtttccaaaacaaagtcatttaaggggctcagtcagcaggccaagaagcgctctgcagtcaggcctgatcctggtgcccacactgacttccctcccaggaggtgccataggggcctgctgtgcccatatttgttcttatgaggctgggaaaggaactggtttttttatttgcgaagtgacaggagtgtgtaaaggcctttttgacttttaacctcattctctctagcaagcaagtagctactcttccaccagtgagcgcgggctggacctcttagattctacagagctggatattgaggtgagtgtccccagagcaggagttatgtatccttcggaaatgctggcaggcaacccgtgcactcatcaaattgacaggccatagcctgggggtggccctctgggctgtctctggggctttgagggtaacccaggggaggatggtctgcccattggcccgttgctgtgtcctgtgtattcctttcatctttctcattataggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccacacgttcccaaggtgtggcttgagatcgttaaactgatggaggtcaggttcttggtccgccttgtcccatggcccagcatatagatgtccccacaccctgcaggtgctttgtctacaggctctccaggaagtattgcttagtaactgagaggtggggtgaggcagtagagatgggga

SEQ ID NO: 126476 - DNA, 1038 bp, Homo sapiens
tggactggagggggccatggggcaccggaccctggtcctgccctgggtgctgctgaccttgtgtgtcactgcgggtgagtgccggcaccagagaggggcaggggctgcagggagggtgatgtaggacaacagcccaccgaccttgctgctgttccacagggaccccggaggtgtgggttcaagttcggatggaggccaccgagctctcgtccttcaccatccgttgtgggttcctggggtctggctccatctccctggtgactgtgagctgggggggccccaacggtgctggggggaccacgctggctgtgttgcacccagaacgtggcatccggcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggcgaggggtccaggagggcagggaggggctcgggaactggccacccatctgattcttgtctccgtgcccagggctctctgccccgccgactcctgcccccattctgcgggcagacctggccgggatcttgggggtctcaggagtcctcctctttggctgtgtctacctccttcatctgctgcgccgacataagcaccggtgagacctggtccctgtccacgtccccctgacactgggatggccacatgccctgcagagctctgaccatccttgctctctcccagccctgcccctaggctccagccgtcccgcaccagcccccaggcaccgagagcacgagcatgggtgaggaggggacctgctttggggatgaggtgacaggggcaggggcaggggggccagggctgggcccaagctgtgcagactcacttgaccctccttcccccgcgcaggcaccaagccaggcctcccaggctgctcttcacgtcccttatgccactatcaacaccagctgccg

SEQ ID NO: 126477 - DNA, 1028 bp, Homo sapiens
tcccgagaagctgggactacaggtgcatgccaccgtgcctggcaaattttttgtattttagtagagacagggtttcaccatgttgcccaggctggtcttgaactcctgaggtttggcattccacccacctcggcctcccaaagtgttaggattacaggcgtgagccaccatgcctggcctataatttttttatgtacacaaaattatcattacctggccatcctggaatgaggcagatcgatctggaaaggcttgcagaaagatacatatttgtagtttttcctgaaaatttaaatatttaaagttctgtgatatgacaggtaggctctttcaggctacagggagaagacactttagagaaaatgttagggagtaatagagtggctttttcgtttttttgcttctctgcttatagtattttgttttgggagggatgggatctggccttgattttgcagagacttcttgtgcccagcccgtagtatctacccaatcagacaaggagccaggaattactgcttctgctactgatactgataatgctaatgggtaagtttatttcagtgaggcaagttgaacacagaatggactacacattcatggtcagtcagtctatctatctgtctgtctatctggtcatttatcatatttctttttttttttttttttgagacggagtctcgctctgtcgcccaggctggagtacagtggcgtgatcttagctcactgcaacctctgcctcctgggttcaagcaattctcctgcctcagcctctcgagtagctgggattacaggcgcctgccaccacacccggctaatttttatactttttagtagagacggggttcaccatatcagccaggttggtctcgaactcctgaccttgtgatccacccgccttggcctcccaaagtgctgggattacaggcgtgagccaccaggcccagcccatttatcatatttctatagatttctctcagctcaggaaagatacctgtttgagttgggaaaaataggcaagtagatgg

SEQ ID NO: 126478 - DNA, 2163 bp, Homo sapiens
gaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacggtaagagggtccagaggctcttggaataggggccaggtgtgaagatgagattaaatgggaatgtagcagggaaggttatgacccagatcctcaaaagaggggtctgggttggcaagtgagagcctctgctgggcgtctctcccctcttataacctggaaaggtggggtgtctaccttggggcattgaccctggagtcctttgtcatgactgcaaggatctccaagatagaggaggactctctttttgctctgctcccggcttggcctataatccacactggtccaccttcccttcccttgaaggctgctgctcactagggaatttgatccaggtggaacttggtcctcagatttactgaaggagcctgagaatgggagtcagacatggaatgtcttctagggaggagattagggtagcgacagactaatactggcgtttctgccctttgatagccaccttgctcctatcagcggcttttgttttcctagacagtttgttgaagcgtgtcagg

SEQ ID NO: 126479 - DNA, 1033 bp, Homo sapiens
aattggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaatttggaggttgacatctcgttcgttgcttgtgttcagactcaggggtcgcgcctgccatttagggctcccctgagatcttttgcagactggggaggtttaaagcgtgggagacggaggaattgagacagaggctggagaagggagccagcggttcgggtcctgggaaggggcaagtgaggattgggggtgggggggcgtctgcccacgtgctgggcggggggctgggaaacaataaggtctttggtggttgcccaagatccacccctggcttcccagtgtgtcccctctgcgggctggatccgggtggctgcttgggggcggggcggggggccctgaatgggccccttgtctcggggctgggtgtgggccaggctccccgggcacacggtgcccttgccaggcctggccagccgccgtggctcccacccccggccagctgaggacgggccctg

SEQ ID NO: 126480 - DNA, 1528 bp, Homo sapiens
gggagctggggtgagggtgggggctcgaggcccaggagaggtctctctgagtggccgggccaggctggggagctgcttcagcctggttctcccaggccctggagtccgagctcttgggacaatacgggccccctgagtcagaatcccaggcgagaaatgcccaactctgggactcatctgcctctttctactctgagtgccttcttggatccagtcccctctgccctggtctctgtcatctcttgcctgtctctgggtctctgacggtttccccttcccccactctgctccccggagaggaagccccggaggtggcctgcccactggtttcacacacacacacacacacacacacacacacacacacacacacacacacactctctctctctctctctctctctctctccccctctttttccagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtaagacctgggttctagggctggcccatcagccctggcctaacctctatcttgagcctccttcctcctcctc

SEQ ID NO: 126481 - DNA, 1055 bp, Homo sapiens
aggccgcagcccagaaggtagcagtggggccagactggagccccccgggtgggattgaggggcggggactggaagaggaaaaccagggggcctcccaaatcctggaggaagaagaaggtgattggggccatcagcgagggagggaggcagagactaaaccattgctaaagggccagggagccagaatcggggtggaccaaggcccaggcccggggaaggactggaagtgggggaaggcaggcagtggagatagatggatgggtggtattttagatacccaactcagggtgtctcccatccttccttcagcgtccccaccctgccctcatgagatccccctacagcccaagataggggggagagtctgaccatctccccttttcccagtggggtgcaatgtacgcaagtaggccctgggcataactctgcctgtaggtgtgtccagttctgtgtagcagatttgtgtgtgtctggaggtctgtgggtgtgtctgtgggtgtttatgtctgtgtgcctgtctatccctaggtttctgtttacctatgccaatctctgcgtctggtcctctgtctgtagatgtgggtcggtggctccgtggtttgtgtgtctgaatgtgtacttgtgtagctgaggggttgcagtccgtttgtggggcctgtatgggtggtggatcgggatgtctttacacaagaagggaatctgtgttgacctggtctctccagagtgtgtatttggggctctgaacacctttgtcggggtctgtgtctgtctgtctgtgggtcctcgaagctgtgttgggttttctgtctgtgttttcctctctgaggacccgagtcatgtctcttctccgttttctctctttcattcatccctggcccccacccatcccacctttcttttttttccgttctcacccaccccgcccgccagtggatccgggacccagggagggccgccccccgggcctggtggcactgagcagggccccccagcccccacctcctgccccacgagatgaacctcctctaccgaaaaaccaagctggagtggaggca

SEQ ID NO: 126482 - DNA, 1023 bp, Homo sapiens
gcaatgctctgccaggcctcctctcagagatgagcttagttcacaggcagcccttccccccagcgctcccccttctgggctcaggaattgggattctccccctacaggtcttgatcccagggggatggtcattctcgccctatctggagatggaggggcttggaagctaaagctgcggttggggaggcccctctgaccagggaaaagggtttggatgcagcacatagacatgattctcagccccaagagatggtaccaatgggtggaaaggaaggggtgtgtgtgtgtttgtatgtatgttgggggagtgtgaaggagccccatcccagccgttacttgcaaaaggggcaattgtgtctcctggtccacccatactgcagcatgtgtggccagagggacagaatgacgcctccaacatgcaggcacacagctctccttgtcatcccagcagaggtcgaggacggtgcccgggcctggaatggcagtgccgagggtccaggcaaggtggagcgtgaggacaggggccctgggacatcggggatcccagtgagaagccagggggcagagggactgctggccaggatccaccatggagaccgaggagggagccgcaccgcgctgcccattccctgccagaccttccccgcctgccaccgcaatggaggtgacgcggcctgcacacacctgtgcacagcggggctggctgggggatctcccggggtctagctgcacctgtcctgacttcctctcacctgttcacgtctgtgcccagggccctaaatcctcataccacatctccacccctttttcccttctgatgaggcaggggcagcctggaccattcaagggcaggggactgggaactaggggaggggtacctgaggcccctgcactcctcactcctccttcttccacctcagacttcacgggaggctaccgcctggggcgctccgcctccacctccggagtccggcaggtcgtgctccacacaccccggccctgcagccagcccagggatgccct

SEQ ID NO: 126483 - DNA, 1044 bp, Homo sapiens
gtacaggattaaaaaaaaaaaaaaaagcgaattaaccccgattgacagcctagagatagtggctggaagggagccatggtccagagttcaggtgtagatactaatcttagcagggctttgaaatgttacccagaaggtaaaactcttacgaaatctaagagatgagagccaatgggttaccctggtagagagcttagctttttcaaacgtttgcacgtctaggtgagccatcctgaaggttaatcatttacacctttaagatccctgttgccatgactggatcctggtggtagcatccaggaaactctagattttgggggggctttggtgcatcatctgagtgctactcttggcattggtactgttcggtcatgccagagtgaatttacagccacaattctagcctagatttctggttatatagtaaagccccctccactcccctctgcactcctcctactcccaaattaagatattatttggttagatgcatgattaacatctgatatcaggcctggatctctgttttttaataagtttgtcaagggatttattttgacaattttttagtcttattttaagacactgttgtttttgttttgttttttaaaaaatgctttccagccaggcgctgtggctcacgcctgtaatcctagcactttgggaggccgaggcaggcagatcatgaggtcaagagatcgagaccatcctggccaacatggtgaaaccccatctctactaaaaatacaaaaattacctgggtgtggtggcgcgcacctgtactcccagctacttgggaggctgaggcaggagaatcacttgaacccgggaggtggaggttgcagtgagctgagattgcgccactgcacttcagcctggcgacagagcaagacactgtctcaaaaaaaaaaaaaaaaaaaaaagctttccctgtcttgatacctttaggagccagggagcgagcactattgttcttgcaagacagatgggagaacagaagcaaagagaggtttcgtaacttatccagtgccatatgggcattgc

SEQ ID NO: 126484 - DNA, 1090 bp, Homo sapiens
cagagctctgggctgggtgtcaagaatgcacttgacagctctttatttgtgacaagttcctgccctccttgtgccttactttccctgtcgggcttgctggtggttcttagttgaagcattttaatctccatgggaggaaaggtacagtatgttcttcaataattcagtacttttccatctgtctgggttggagaggtacacatgtaccttgcccctgttttagtcccatccctccatcccctcctctgtcacctttcatgttgacctctgctgggcagaggtggacagagtctctcactaaattacagatgtaggtgctgtttcataaggggtgcatgaaccacttgaaaagccccgaaggaagtgataaattactaaagggatgagaaaaagctcgacgtggggtggtgggcgggggggtggggatgagagaggtgagggcagagggagacatgtaaaaaagattgaggttgagcctaaagggaagggcggctggatgctatcaggagtctacctggctctaatcaacaggacagctgtttatcattgctgctgaggaggaacaaaggaaatgggttgaagcagaatttagatcaggaagagggttcctaaaattagtgaaattgaccctggagcagggtaataggagagccttcctcttagggactattaaaagttcctaacagggactcttcatggtgatgtttgcatccaagataagagctaaactggtttagttgtatcctgttcagaagcagaggagtgaaatcccagagcaaagaaacacgatctggggtgtatgaatctgaacacaattgttcaaaggcaaggatttcccaagtccaaatttggcacaaatgaaaaagaacttgggtgctgggtggaactggtttttttccattgttgacctggcagaactttcttatctgagcagctgagcaggtttgatgcttttatgaagcaagatagaagcaaaaatatgggccagcatgagggtgatgatcacagaaaaacaaaaggtgtggtatttgtggaaatagtactatgcctaatggaatcagagaggagacgggagggagggaaagagaga

SEQ ID NO: 126485 - DNA, 1050 bp, Homo sapiens
tcttctctacaaataattaaaaaattagccaggcatggtagcatgtacttgtttgtggtcccagctacttgggaggctgaggcaggagaatcacttgagcctaggtagttaaggctgtgttgagccaacattgccccactgcactccaccctgggcaacagcgagaccctgtctcaaaaaaaccaaaagatgttcaaggggatgctcaagataggcagaactttgctaagttgctcggttcccttcaaaaaagggaatcagtagagaaaaatgagcatagattttgactcctgtgtcttcccaaacatctcagctgagcgtggtccaaagttttatccctctctttacagcctaactattctttctcaaaggtatgtccccccagaccaagtcaaggggcccacttataccaaaggcagtgcctccacccctgtgcagggctccatcccagaagggaagccccttcggacacttctgggtgatcctgcaccgtctctctcagttgctgcctccacctcgagccaggtaactctcagatctgctcgtcatgtttcttttgagatttgggagacaggagtgtcagtttcctgaatcagattccccggacttagcagacaacagtgcaggagctgtgagttgggtctcggctctgctgttaacctgtatcttgtatttgtcacttctggacctcatatcttttggaagtcagaacctaacaggaagtggtatttaggaaagtcagaatatcagctccaaacctgagcattccatcaaagaaacacagaaggggctggaatatggtgtccaatacctgggaaggttgaggagtaacagccctgggggcagtattgggcagtattcctgtatatctcagggttaccttggctcatgtgctgtaaaatgtgtggttcttggagcaggtgtactgagaagatgaggatgatatgagctctgagaggggctaaggcagctcctgcccaggaatcttctaggttgagggcagttactcactgtcttctctctctacctgcctatctgagggcaacctgg

SEQ ID NO: 126486 - DNA, 1269 bp, Homo sapiens
gtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagcgactgggggcctccatgccttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccaggtaggacaggccctgctgcctctactacccctaagagcctctcactgactgtgagcctgttataatccccaagcgtccccccagatccccgttccccccaggtggcctgggaggtggccccctcgaggatgactccactagcgccctgggaccccaagtatgaagccaaagcaggacctcggccggtgtgggtgagttgggggcaaacctgtgggactggctggggtgctcagggagctgtgcggtggcctgaggctccagtgctctgtcctcctcaccctagggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcaggtacctcccttggtcccccgggggcgcaaggctgccccaactcctctgggaaccagtgcccag

SEQ ID NO: 126487 - DNA, 1019 bp, Homo sapiens
ccagactgtgccttttttttttttttttttgagacagagtctcgctctgtcacccaggctggagtgcagtggcgcaatctcggctcactgcaagctccgcctcccaggttcacgccattctcctgcctcagcctcccaagtagctgggaccacaggcgtccgccaccacacccggctaattttttgtatttttagtaaagacaggttttcaccatgttagccagggtggtctcaatctcttgaccttgtgatccacccgccttggcctcccaaattgctgggattacaggcgtgagccaccgtgccggtcccagactgtgcctttttaagatgagcaaaaggcacctttccctgtgggcaggcagcatttcatgcagggtgcagtgctgggcccgtgctggggaaaggggactcccgggcggccacaatccgctcaacatctgcagccctggttgcatgtcacaggaggtgtttgaacagggtttgtgccttgtgctgatcatttgaaaatggagggtgggttcgagtgtggagtgggcaggcgaggagatgaggaggacagacagggctgggcgggacctgacgtccggatgggccttcccggggaagctgagctgacgtccagatgggccctctcagggaggctcgcttagaccgtggaccagaatcatgtggagagaggagcagggaggtttctcccggggaatgacttgagccacccaggggagaggctgtgctgggcccagggtgactggccagctggagccaagggtgagggagtgagcacgaggccacagccctgagcatgttcctgacttttcccttgcccacctgttccagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtgaggcgggtgcctggggggccacgaggacaggggtgtggc

SEQ ID NO: 126488 - DNA, 1028 bp, Homo sapiens
ccctctgtcactgaaggcatcattcccaccgtaacacgcatcatcttaacccttccctcaaatcttcattctccagtccccggccctccctcctcttccaaagcctcagctcttgtcccctgcacaggctaccagcagagctgcagagaccaggccctctgctctgcactcacatggaggccccttcccattcagtccgtttctgcaagaaacgcttggggcaggggagctgccctctggctgggttgtgtggggcctgactctgtgggtccccgcctctgtccccgctatcaggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactggtgagaactccctcacctccgccttccccccctccaggccccgccccggccgcagccccgcccccagccctaacctccgccccgcccaccccgcgccccagtgcctagggccccctacctccctgacccattttcctcactaaccgccccttcagtccctcctccccgtcttctctcccctcctcccgcacccacccatccctcttccagggccccccccaggcgcgaggcggaaatgggtcaccgacccgcgggtggaatgggcggcctggggttactgggacggtgagtaactgccggcccccgtccgcaatcgggctccctccgtcgggcgcgagggggcaccccagggctggggggactaggttcctccaaccccggggggcccctacacccagccctgggctcccgattgcggtcccatcaccccctcctggcggcagaagtctcccttgcaatgtttcaggcggggacc

SEQ ID NO: 126489 - DNA, 1071 bp, Homo sapiens
cacatcatcgcgcccccggaccaggtaccgaccctcctccccgggctgccctaggggacccaggcggcgccctccagcttgcagccagcagagatttattgaagatctgctgtgtcccgagcactgcgcttgcgctggtgggcacccaaaacagccccaacccctgcatgcacgcaaacaaaaatgtaaaaattacaactgagacaagtctcaggagagcgaggtacagggtcctggtataacacgcgggcctgtcacttgtgagtgcgccaggacttgaccttgccaaccacgacgaccgacacccctgcagggtcccatgggtgtgtgtggtcctccgtgctgtggtgtgaacgccttcaggaggggggcccagaggacgcgggaggtgggagtgggagctgctgcaggcacccagtaggagatgaggtgcaggcgcccaggggtgtcccgccgcgcagtccccgcctccgcccgccgccaggtcatcgcgctgaccttcgagaagtttgacctggagccggacacctactgccgctatgactcggtcagcgtgttcaacggagccgtgagcgacgactcccggaggctggggaagttctgcggcgacgcagtcccggggtgaggggcgggacctgggcgagtccgggagagagtcggcggaccgcacgcacgcggctgtttggaggggcggggttcagctaaagggacgggatctgaaccccagggctccaaaccggcgaggggagcaggttggaggccaggcaaagaggagatttggccccgggtctggggtccgcggatagagaggcgactggggctctgcgaagttgggacgaagttaaaaggccacctggccaggggtagtggctcatgcctgtaatcatagcactttgggaggctgaagcgggaggatcacctgagcttaggaattcgagaccagcctgggcaacatggcgcaaccttgtctgtaccaaaaatacaaaataattagctgggcatggtggcgtgcctgtagtcccagcaacttgcggggctgaggcaggaggattacttgaacccagaaggtca

SEQ ID NO: 126490 - DNA, 1051 bp, Homo sapiens
ggcaacagagcaaaactccatcttaaacaaacaaaaaagttcttccttggctacattcactcattgattcatctggtactcactggtgcctccttcctgccgatgacccctactgggtgctaggaccggaagcctgacagagctctgaacagttcaagtcaatgaggctgttatggggacagtgctccctcctacctgctgagcaggtcaccctccaccctcctccctcctagatgcacccacctgcccaaagcagtgccgccggacaggcaccttgcagagcaacttctgtgccagcagccttggtaagaatacccccaaccccattccagctcctcgaaccacctcctgcttctgtttccagtcctgccatctggaacctcccatctcctcatctctcactcccattctcccacagtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggtaacagagatgtggggaaatggggatgggtcaagctaagccacacagaaatgatcaaggtgtggaatcttgagacctgctgacaggtctcaagaataagagatctcaacccctccctccttcttccaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatgaggaatgggtcagatctccatgcttatggtattggggtccatcttgaggatttcttttcattaattaattaactcaacacatatttactatacagaata

SEQ ID NO: 126491 - DNA, 1032 bp, Homo sapiens
acggcagaaacaaagacgtcctagccaatgacagaggccgtacggcggaagtatagaaaaggactctctggaacatggcaacattaatctgaccacaagctgactggcaggtgctttaaccacaaggtgggcatcctaacgcgagcgaccgttttgaggcagaagcccgatggggcccgtgtccgagcttagggaggggccggagacgcaaacacaggtctcccaggaagcaggcggcgtcacaggtcgctctgcaggcgcccgctgcagcgggcggagtctggctggagagaggaggcgggcgtccgggaacgcccggaaggggcgaggccagcggcggggcggggcttatggagatcgtgagctgggcgtgaggagaaggccgggttgggagctgcgaggggccgggtttagcggggtgggcgtggccgtcgaggtggggctcggcgggtccgaaggaacctggggcagagctggaagaggaaaggtcttgggggccctgggcctgggtctgcgggagccccatctagcggggttccaaggcggcggcggcatcagtcgaggccctgctccgggagctcatcttgtcccctttcgcccctcacgccccccagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgaggtaaagggatcggcgcctcgtgggggctggtggccggacactggggggttgtgttggctggaggagtcagatgggtagggttgcacgtccagctttggtggactgggaaagtcatgtccagcctccggggcagaaggcagaggggacttaa

SEQ ID NO: 126492 - DNA, 1339 bp, Homo sapiens
catcctgcagtgcccatggctgtagcgatcctcaaggaggtggaatccccctatgatgtccacgattatatccgttcctgcctgggggacacgctggaagccaaagaatttgccaaacaattcctggagcggagggccaagcagaaagccagccagcagcggcagcagcagcaggtgaggcagccggcaccagcagctggggtgggcttgcctggtgcctcctgaccttcaccctcctctccgctgccttaggaggcatggctgagcagcgcctcgctgcagacggccttccaggccaaccacagcaccaaactcggccccggggagggcagcaaggccaagaggcgggcactgatgctgcactcagaccccagcatcctgggtgagctgggctggggcaggagcgggacttccttggcacagggcaggaggagcccaggagagagctcagacgcagcttctccccggcttcagggtactccctgcacggatcttctggtgagatcgagagcgtggatgactactgaccagcccggacccccagcccctgggctgtaggccagggcagccacagcggcgtggaccgagggtcccagcctgcaggctccccgcagagagcacaggaagaggcaggggcggggtccccagcacttgttacaaacacacgatgcaccttaactcacccaccacgaggcactttacagactgggggagggggtttttctttttatttttttttttaattttaaacgactgaagaaaacattaggagaggcaaaaatattgttaaaaactagactctaaacaccccttcctgctgtgaggatagtgggtgtgacaatggaaggtccacagaggtttttgttttttggttttttttttttttttaagaaaaaaagatgaaaaatgaaaaaaaaaatggttaggaggctgaaagaaaaaacacactgttattttggggcagtggggacacaggccccgtggacctgtcctgcctggcccccaaggccatacttaccccccagaaggcgggccatggggtaactggaagctgggggccagcagtttgcacaggaggcctgtctgagccccacccgccagacctgttgtgagcagctcctgtcactgaggctggctgaggtgtccggggtggggccaaagtagccccttggcttcgctgctttgggggacagttgcacaaattggacgagtggccccagctctctggctgccatcttgtgctggccgagtagacgggaggggccaagccgtgccaacctctctggctggcagggtggggcagcaggactctggttctggtgaggggcgtctcccactg

SEQ ID NO: 126493 - DNA, 1818 bp, Homo sapiens
accgccgccgccacagcagcagcagcagcagctcacggcattcctgcagcagctccaggcgctcaaaccccccaggtgcgtggtgcgtgcgagccctcaggatacagggtgggggggggatgggggcagaccagagatggatttggggtcctaagaatccacaatttgctcctcagaggcggggaccagaacctgctcccgacgatgagccggtccttgtcggtgccagattcgggccgcctctgggacgtacatacctcagcctcatcacagtcaggtgtgtggcctgactggtccccacccccaaggcagtctccgggtgaaatggggtctggggtctgctccccacccccacacgcccctagctgccattctggctggggagcccactgctgcggctggactagatcagtgggcccaagtgcccacctgcagccgcctctgcccccctgccccctgcaggtggtgaggccagtctttgggacataccaattaactcttcgactcagggtccaattctagaacaactccagctgcaacataaagtgagtgggcatcctggggctgaggccctgggaatgaagggtggaccgaggcaggccccaggctgtcccctgcagctctcccctctgatgggccactggtctcagttccaggagcgcagagaagtggagctcagggcgaagcgggaggaagaggaacgcaagcgtcgagaggagaagcgccgccagcagcagcaggaggagcagaagcggcggcaggaggaggaagagctgtttcggcgcaagcacgtgggtgctcccaagcctcagctggctgggtggacaaccctcgccaggtcccctcaccatgtccccctcttaggtgcggcagcaggagctattgctgaagttgctacagcagcagcaggcggtccctgtgccccccgcacccagctccccgcccccactctgggctggcctggccaagcaggggctgtccatgaagacgctcctggagttgcagctggagggcgagcggcagctgcacaaacagcccccacctcgggagccagctcgggcccaggcccccaaccaccgagtggtgagcaggccgggaacctcccgggctccccctacagtttccagggtggcacagggagggggatactgaacccagacttgtgcagccccagccccagtcccagcctctcctgtgatggcaacagctcttgtggccctcacctcacctgtctccctttgccacctaaacaagcctccccatccgcttttctggggtgcctttgtttgagccactctgatcttctgccatctgtagcagcttgggggcctgggcactgcccccctgaaccagtgggtgtctgaggctgggccactgtggggcgggccagacaagagtgggggcggcagcagcggcctggggctctgggaggacacccccaagagcggcgggagcctggtccgtggcctcggcctgaagaacagccggagcagcccatctctcaggtgggcgtggcacctggaggctccgggatggccctgagggggaaggtggcagacccccccaacccctgccagctgatttccaaccctgactcaccctcccccttcagtgactcatacagccacctatcgggtcggcccattcgcaaaaagacggaggaagaagagaagctgctgaagctgctgcagggcattcccaggccccaggacggcttcacccagtggtgcgagcagatgctgcacacgctgagcgccacgggcagcctggacggtgggcgagcggctcccaggaggtgggcgggacctgggtctccag

SEQ ID NO: 126494 - DNA, 1096 bp, Homo sapiens
gggccgggcaggcactggtgttctttgccgggctgggcattggctgcccacctacctgtagaatcaggctacttagatctggaagaagagtgctgagaggtggggaggaaccagggggtagcagagccatgtcttcaaggcagtgtaccagatagaaatcaggcgtaatcaaaatgacctttgaaagtcccttgaagaagctgtagaacctggagtgacgtctgcggtgttgtgtggtgttgtgcgatgttgtgatatgttcctgccgcgtctggcagcgtggaggcgagggtcagggcaccgcattccctctgccattagttgagttgacccaagtgaagtggtggactcggcctaagggagtgtgacccgcggttccagccacactcaagggcttgtgctaactcgcgtggcaggcccagcccttggttctgaactctggccatctccctcttctaggtgggaaagagctgaccccactgcctcctcaggaggagaagtccagctccccatccccactgcccaccctgggcccactctgggggacaaacggggatggggacgaaactgcagagaaagagcccccagcggccgaaggtaggaagggaggatggcctacctcccgggtgcgctggggctgtgggagaaagtgctccccactcgtgggggtgggcacacagggcattcacattgaggagccatggcaagagcgtggtgttctggagtgagagtaggcgaaagctatcttgtctcctccccgcccttctttccacctcctatctcatgccttccagatgatattcgggggatccagctgagtcccggggtgggctcctctgctggcccacccggagatctggaggatgatgaaggcttgaagcacctgcagcaggtgtgggggcctgagaaagcgggagggacccttcccacttctgacctgacctgcttggccccagccccggccccagctcaagctccatccccatccccatcctgatgttgctgagattggcagctgagcctttcttctttttctgggcatccaggaggcggagaagctggtggcctccctgcaggacagctccttggaggagga

SEQ ID NO: 126495 - DNA, 1567 bp, Homo sapiens
ggggcagcacgcggagccgaggtagaggggtgatggcgtgtcctggggacgggcagatctgggcccctgacttcgagaacgtgcagcaggtttcattgtgcgtctggcctcttctctaggccgcggccgtggtgacagctgcttttaccaaagaagcatcgaagaaggcgatggggcctttggacgaagcccccgggaaatccagcgcagccagagctgggatgacaggtggggcggggagggggcatggcgcagagccgggcaggccagggaggggaggcctgggccctgtcgctagagggtaacagaggcccaccagataagccctgtccgagatcccggtgctcctgacccctggtttcgtttgtccccttcctccctccactgcctcagggcacagtggacaaggcatggggcggttgcacagggtggcaggggaggctgtactgtttctgacccacacgtttcccctgctgcagaggcgagaggcggtttgagaagtcagcaaggcgggatggaggtacgaggctgctgagggcggcggccggggcggcagggaggaccaagatgggtggcccagtctgggggtgcttatttcggaggtgttgggggcaggagggcctggagctggcccccccaacgtttcttgagggtccaggcaccacgctgcctttctaataactgcccctgtcttcccgtctcccagcacgatgtggctttgaggagggaggggctggcccaaggaaggagcacgcccgctcagacagcgagaactggcgctccctacgggaggaacaggaggaggaggaggagggcagctggaggctcggagcagggccccggcgagacggcgaccgctggcgctccgccagccctggtgagattggggcctggtagcattggcgggggcagtggggagcaggaactgtaatgagagggtgggctcctgtagccacggggagggagcagaggctggctggtgtgggagtggccgggacagcagccctggaggtgctccgtgagctgcagcagagggggccgctggcttcgcttgggtacccactcttcttctccctgacttttcctgtgcagatggtggtccccgctctgctggctggcgggaacatggggaacggcggcgcaagtttgaatttgatttgcgaggggatcgaggagggtgtggtgaagaggaggggcggggagggggaggcagctctcacctgcggcggtgccgagcgcctgaaggctttgaggaggacaaggatgggctcccagagtggtgcctggacgatgaggatgaagaaatgggcacctttgatgcctctggggccttcttgcctctcaaggtatctgtgaggaggcgagggtgggaacctgcccttccggggtcctcttcctccccacccaccccagctgttctctgctccccaccccggccccatgcagaagggccccaaggagcccattcctgaggagcaggagctggacttccaagggttggaggaggaggaggaaccttccgaagggctagaggaggaagggcctgaggcaggtgagccgcggggtg

SEQ ID NO: 126496 - DNA, 1051 bp, Homo sapiens
cagattgctctaggtggccacctgcagtcagtgacaggctggtggcttttcatgtcatggaacacaccaccactggagcatccagccgaggcagaggaaggagaggtcccaggggaggccagcctggccttgggttgcctctgagcccggtgtttccccctggagtgcctggactctgagcaggcctcggcttgtcatgggctgctggctcagctggggctgatggcctttcctcctcagcaccctggttgaacccgcttcctcttctttcccagactgtggcgtcctggagttgatgggagctgcagcaccaagccgggccagcctccctcccagccagtgacaacaccgcagcacctggaccccgcccacccgcttgagtcctctgcctggggccccagggatgcgcctcctcctgaaagtcccctccatcctcccttagaggaacaggctgccgccgcgcccccatcagcctccattgccctgaccttatttccacctgatggtgccagaggctgcttcccagctggtatcctgagatcctcgttcccttggtggcttggttgtttaagcctccattattgattgggggcggtggtctgggtgtgattcctgtgggggaaaccagcccgaggtgccttggctcaggcttgcctgcctggagtccttgtcgtgtacccgtctgtggccctagagtcacctcctgctccttttcactgggtttctccccagaccaagcccctggatttgagcttctgagcagccaactgatttttttcatgagggaaagaattttgctcctagatttatttctaatccttttctccgtaactgaccttttctctgtaagctatttgtggctctagtgggtttttgtttgcttgcttgtttttgttttatctttgccctgaacgtccatcctggcctcggctgcctccctccccgagttcttcactacacctcctgtctcagcctcccagagagggtggcgagggtgctgatgcccagagacaccatccggcgaatggacctctcctgtcatgcggggcag

SEQ ID NO: 126497 - DNA, 1615 bp, Homo sapiens
ggctagatgaaggatgttgaaagtctaacaaatgtaaaatggcttcaaactcacagaataatgcttgcgagtttgggatggttactgctaccgtgcgcacctccagtcttgcatagtgtcaaggatgtcggggcacgctgtcggagcagcttcctccttcttttccctggctggagcccaaggctgggcaagtgggcaaaagggatcacaggaggtaaagagtgaaaatcctttgaaaactgttaacttgtagacaattgccaagcggtggtgtgatttgctgggatggctcagagaggagagagctgggataaccgaccagccgcgaagaatgcgggtttgcatctcttttttaagcctcagcgtcctcaccctaccacgcttggagaatctccatcctgagaaagggccaggtcccctccagcaggcctggggctgggcggttgttccagtgttgaggaattggggactgtgcttctgtttaagtggctctgttctgtgccaaggcacagtgctctgtgttggagctaattttaggggtgatggagtgaggagataatgttcttagctgaatgtgcactgggaccgcctgttctctgtcttttctttctctcttgagttctgagccccagagagcaggctccctttcccgcgcgccctggcgcctactggagcacccgggcccagcgtgtcctcgccccttgtctccggcagggggcagtctttcaaaagcattgattcagatgctgggggagtgagggtagacaggcccgagaaagagaaggggtggggaaggggcgaggagccgaagtaggccgaggcttgagggcagggccagggcgggggacaggctggaaggggcctgtgagaaggagaccctgagctgagaaagctcagccgggtaagctgagacgggcaggtggcagtaccccagcccccgccacctcctgctcttaccttcattggacagggatcagatacctggccctgagagcttgcaatagacaaacttaggcagtttttcttaaaaaaaaaaaatctattcttttctcaaagattttctcctggcaggatttcagatttccctcgtgggacagtgtaattagggaatgatgtccctgctgttcagagaggagaatgacccagcgtgcacacacctgccttcccttgccttccccttggcccagtagacccccaagggctgtgcccatgctcgtggcgcagaggagggtgtctcagcactggcgcacttggtatctggagtcacatagctcttggctgtggggctgccctgtgcaccccctgcccagtggtgacaacccagaatgtctctagacttggccaagagccccctgaggagcagaggtgcccccagtccagaacctgttggagggtgggagccccatggtggcctgcaggtgtgccactagttcctttagtccaaggaaggggccaggcaccatcagcttccggcaccagaccctgctgtgggggtgcctagagagttaacctcactctcctggtttcttcccaagaaggcgggtggcatgggctttttcctgctctgggcctgctctctcccctgtcttggtgtcgctgtcctcagtctgcatga

SEQ ID NO: 126498 - DNA, 1079 bp, Homo sapiens
ccacaggggatgccaccgtgggggagggactctggggactgtcacacctgggcagggtcccttctcagtcttttgttttgttttttgtttttttgagatggtgtcttactctgtctcccaggctggagtgcagtggcgcgatctcggcgctcactacaacctctgcctcccgggttcaagcaattctcttgcctcagcctaccaagtagctgggattacaggcacgcaccaccacacctggctaatttttgtatttttagtagagacagggtttcaccatgttggccaggctggtctcaaactcctgacctcaggtcatccacccgccttggcctcccaaagtcctgggattacaggcgtgagccactgcgcccggccccttctcactgtctgacttcttggcagagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtaagagctgggccagggcctggtgggtgtggggaggcagctggaccaggtaggccacctggagtagaagtcagggatccctgttccctgggatgtttgtggcaggggtgggctggttgtaaaatcagagtcagcaggacgcagtggttcacgcctgtaatctcagctactcaggaggctaagacgggaggatcacttgagcccaggagttcaagaccagcctgggcaacatagcaagacgcaacatctctgcaaaaaatttaaaatgagctggatatgggggcgcacacctgtagttccagctattgggcaggcttaggctggaggatcacttgagcccaggagtttgaggctgcagtgagccaagatcttgccactgcactttagcctgggtgacagagagaaactgtctcaaaatcaaaaaca

SEQ ID NO: 126499 - DNA, 1589 bp, Homo sapiens
tctgtgcagcctcttcccccagtctcattttgcgggcttttctctcttttctttccttccctggcacccaagccaaaggccctgcctctggcctccagccctacccccttctgcggttgcacagaaggatggctgcccagctcttaaaaaaactgcccgggaactgttgacatctgttctccctcccccgctggcttttctgattggcttacaatcctgaggctaggaccgtctcaggagccaagagaggagagcggccacagggaacctagggtctcaccaagctctcctttccttctgcagggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggtgatgggggtgatggactagatttctaaggagagtggggctgggtagggagggctttgtggctgaccgagaggtgtcagaggtctggaggctgcagggctgtaggggctggaacttggttatcagccccagggtatgtttgaggtggtggggtgggggccgagcgagatgaatcattcgcagctgcttctaacgtctccagctggctctgccaagagcctggggcacctccggggtggggctgtcccctccctcccctgtc

SEQ ID NO: 126500 - DNA, 1014 bp, Homo sapiens
ataaagatgtgtgactcagtttaccttttgttcctttcccatcggctacaggaagcagagcaatgggagagaagcagaatattcggacaaacacggacagtatctcatcggacatggtgggttgccctaatttgatgggaataggggcttggggccgggtgtggtggctcctatctataatcccagcactttgggaggcagaggtgggcagatcacttgaggtcaggagttcgagaccagcctggccaacatgttgaaactccatctctataaaaaatacatcagtcagccaggcatggtggtgggcacctgtaatcccagctactcaggaggctgaggcagaagaatcattttaacccgggaggcggagattgcagtgagccaagatcgcgccactgcgctccaggcctgggtgacagagcgagactccatctcaggaaaaaaaaaaaaaaaaaaaaaaaccacggagacaggggtttggggctaaaagctatgagccgagcctccgagtccagtgggagttaattcccagctgacggggccctgcctgatttctcaggtactaaggtctacatcgaccccttcacttatgaagaccctaatgaggctgtgagggaatttgcaaaagagatcgatgtctcctacgtcaagattgaagaggtgattggtgcaggtgagagccgaaggctgcccgggcacctgggaacgaagcgggggtgggcagggccacactggagcgggagagctgatgacctctgcgtccttgtttgaaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactcctt

SEQ ID NO: 126501 - DNA, 1033 bp, Homo sapiens
ggggaacaaaaaccatgaacgaggggaagaggaaggccaaaggggtggaaaaaccacgaggacgaggtgtggtgagaaggaaagacgcaaagaggaaatggtgattgtgacacctattacctgagtgtttccaagcaccaggcctgtgctgagcgccttacaaatattaatttcacccatccagcaacgctaagggtggtgctattattgcccccatttttcagatgaggaggctggggcttagttaaggttaagtagtttatccaaggccctgtgccgcgaggaacagcgagaagtggaggccgaaagcgaaggagagatagtgactgtcagaaagagaaacggaggtggacagagagtggaggagagataggtgagagacatgcgaactgacagatcaaagcgtggctgcagctgagctgggacgcagaaagggagcctgcgcttgctctgggctgcggacagcccgaggcagagacagtgtgtaaattggagacaggaaaacactatcccggctggaacaatggagggtggagacggcagcctctatccacccccttcccagaacccgggcatcctgtccccagtgagcagggctgtctcttgccacccatggggaccttgcgcctctcacctcaggctggctggcttcccatctgacccctagctggaggacatcatttggtccccaggaagaggctgcctcacccaccctctttctcttctctcctgcagctcccatggggtgggagccaggtgttctggctcccctctccacccttcccagcgcccaatgccccccacattgccggcccccgaggggattcctgtaccctccctcctccactctccactgccaggggctgtgcagtttttcctaatccccccccttcctccagtgcctgtcccctcccccgatgatccgagccaagccaggtgtgttcacccctcccattcataccgccccccagaatctcctcccctctgccttcccataaccaaatccagatgtgaggcctcggcgggagcctgg

SEQ ID NO: 126502 - DNA, 1036 bp, Homo sapiens
tccctcccgggcccggcgccgcccggcccagttccagcgcagctcagcccctgcccggcccggcccgcccggctccgcgccgcagtctccctccctcccgctccgtccccgctcgggctcccaccatccccgcccgcgaggagagcactcggcccggcggcgcgagcagagccactccagggagggggggagaccgcgagcggccggctcagcccccgccacccggggcgggaccccgaggccccggagggaccccaactccagccacgtcttgctgcgcgcccgcccggcgcggccactgccagcacgctccgggcccgccgcccgcgcgcgcggcacagacgcggggccacacttggcgccgccgcccggtgccccgcacgctcgcatgggcccgcgctgagggccccgacgaggagtcccgcgcggagtatcggcgtccacccgcccagggagagtcagacctgggggggcgagggccccccaaactcagttcggatcctacccgagtgaggcggcgccatggagctccgggtgctgctctgctgggcttcgttggccgcagctttggaaggtgagtttccttgcgggggggggcgcaccccgtcactcctgggacctcccccccaacatctgggcctcggagtggaggggccggcctctgactacccctacccgggcactgcagtcccaaacacttcggaccgatagtgctggaacgggaggggggcggggaagaggcgcccgacgggtagtggagttttcttttgtttgggaaagagatggagtctggctacgacccgggacattcccctgcccgggctccccgaactctcactgctgattacatacgcccctggctgcctttcctttcctccctaccccactattcaaaactatctgcaaagtttctgtcccagtcccacctcccgccgtacatgagggaaggtttctggagaagcaacagcagacaaggcacaacttttcgtgctaggccctaaaacgacccccagcgccaattccttagcgatcacac

SEQ ID NO: 126503 - DNA, 1059 bp, Homo sapiens
accccgtctctactaaaaatacaaaaattagctgggcatggtggcgcgcgcctgtaatcctagctactcgggaggctgaggcaggagaattgcttgaaccgggacctaggaggcggaggttgcagtgagctgggagctgagatcgcgccactgcactccagcctgggctacagagtgagacgaaatctcaaaaaaaaaaaaaaaaaaaaaaaaggtgggtgtgtccgagagggtgaggggtccggctagatctccaaatcgcccttctcactctcactctcgtgttttgggggggcttccccgccgcccgcagccatgacccctgaggctggggctgcggctgcggctgctgtctttcctgagctgtttcctgtctggctcctgggggccctcgggatggctgggaggggcccttcctctcactgccaactcccctcaccctcccatcagttagcggggagggtccagcacagccgtgctcctcccaccaacccccttctacttcagggaacttaacagtatgggttactggatagatggattggagggggtgctgctccaggagtcagcccctccaaggggcagaaggaaaggacttagactcccacagtaattagcggggacagattttttttttttttttgagacagagtctccctctatttcccaggctggagtgcagtggcgtgatctgggctcactgcaacctccgcctcccaggttcaagcgattctcctgcctcagcctcccgagtagctgggattacaggcacagggcaccaaccccggctagttttcgtatttttagtagagacagggtttcgccatgttggccaggctggtctcgaactcctgacctaaagtgatccacccaccttggcctcccaaagtgctgggattacagacgttagccaccgcgcccagccggaggacagaatcttgaggagcccagcaagagagacgttggagcccagcaagagagacgttggagtccaggatgcttggggggctgccaagcgcccttacgtcccagaaaggacagccgggcctgtgataacct

SEQ ID NO: 126504 - DNA, 1043 bp, Homo sapiens
ggctccgagacccgcggcccacgtcctgccggagacgcttgtctgcagggctgcattgcatccccgggcgcacgtggagctggagcagcgcaggctggggaagagcagagagggtcgggcttctccgggcgcgccatggggcggggccgaggacggggaccaatagcgcgcgcgtgctggtgggggtggggacaggctccaggcctggcatcccggtagccgcagctgtcttttccggcccccgtgcactctccgcccgagcggagccccccggctcgcggggatcgcccccgagcgctgcgtcctgcgggtgggtgagtgagcgcctcgcggcccccgagctgtggggtgcacctggccggggagaaggatatcttggctcccttgcaccccaacgggcgcaaaggggcaggagcccggattgggggaggaggaggacccggggaccttgtgtcgctcggtgggagccggtctgtgtttctgtttcgctagggtgtgtttgggttggtagagtttgtggggaggggtgcctcgtgtggatgggaggaatcggggaggctaaggcgaggaggagggggtttgagatgggttgagggagaggattgacggagggtggggttttgaaagagttggaagtttcttgttacctgtgggtgcggtgattgcattggggggcttggtaggggcagctcaggacaccgaaggagaggatggggaaggctctcctgcccgtaacttacttcccttttgggagatttggttcctcttgcattgctagttaaggaaggagaggctggagaagcctgtgccgtcagagaacctttgcccctttccagaaccggtgccatccctagtctcaggaacataagggaaggggtggcccccaggagccgggaggggccttgaaacccctgctgacaggtttggggtaccacttttttgtggggcagtggctggtaccatttgcagcccacggacttttttgagttgccggtaagcagggtgtgggtgcgttcctgtttccttgcggttgtctctttttt

SEQ ID NO: 126505 - DNA, 1069 bp, Homo sapiens
tgttgccgtaagagcccgtacacagtgggaatgtcatacctatggctgacgcaccttgctgtcagtgtgtgggagcgtggtgtaaacttagcctgtgagcctgactcctgtctgttcctgccttccccgctctgcccccaggtggcatgaagcccaacacgttggtcctaggtttctacgatgacgctccaccgcaggaccatttcctgacggacccggctttctctgagcctgcagacagcaccagggagggcagttccccagctctgagcaccctgttccctcctccccgggctcctgggagcccccgggccctcaatccccaggactatgtggccacggtggccgacgccctcaagatgaacaagaatgtggtgctggcccgggccagcggggccttgccccctgagcggctgagccgggggtctgggggcacctctcagctgcaccatgtggacgtgtggcccctcaacctgctgcggccccggggtgggcccggctatgtggatgtctgcggcctcttcctgctgcagatggcaaccatcttgggcatggtgcccgcttggcatagcgcccggctccggatcttcctgtgcctggggcctcgggaggcgcctggggcggccgaggggcggctgcgggcactgctgagccaactgaggatccgggctgaggtgcaggaggtggtgtggggcgagggggccggggctggggaacccgaggcggaggaggaaggggactttgtgaacagtgggcggggagacgcagaggcagaggccctggcacgcagcgccaacgccctggttcgggcccagcaggggcgcggcacaggaggagggccgggtgggccggagggtggggatgctgagggccccatcacagccctcaccttcctgtacttgcctcggccgccagccgatcccgcccgatacccccgctacctggcgctactggagactctaacccgagacctgggccccacgctgctggttcatggggtcactccagtcacctgcactgatctgtgatgcccctgcctccagggctaggtagagagggcccaggcagg

SEQ ID NO: 126506 - DNA, 1069 bp, Homo sapiens
actttgggcggccgaggcaggtggatcgcttgagctcaggagtttgagaccagcctggccaacatgatgaaagcctgtctctactaaaaatacaaaaaaaaaaaaaaaaaaaaaaactagccaggcgtggtggcatgcgcccgtaatcccagctactggggaggttgaggcaggcaaatcacttgaacccaggtggtggaggttgcagtgagctgagatcgtgccactgcactccagcctgggtgacagagtgagactccatctcaaaaaaaaaaaaaaaaaaacgaagaaaactagccaggcatggtggcgtgtgcacccgtagtcccagctactcaggaggctgaggtaggaggatcacttgagcccaggagttggaggctgcagtgagctatgatcatgccattgcactcctgcctgggcaacagagtgaaactccgtctctaaaaaataacaataacaaagaacgaaggagggccagggttggaaacaggaagagacagtcctggggcatgaagagatgagagagacaggaaaggtcagacattgtgagacaaggtggaggccaggcctgacctgtgaaagtcctcaatgcagtggatctggctcgtagcatccactgtgaaggggatgccgtcgaggccgcggtgacacaccacgcaggtgaagcagccagggtggtaggccttccccatagcccgcaggatccggtccaggatgggctgggagcacgtggcacatttctccagggtggcctgttgggaaggaaggcaggaagatctgggagcgggcgggagccatggcagctcaacaggaaccccagcaacccagccatctaatttctgcagcctcctgcatgcagcctcctgcatgtgattcggtgaaaggcagacttgagcagatctgagttcaggtcccagcactatacacggtatttaaacactatgagaaaaacaggaatcaggctgggtgcagtggctcacgcctgtaatgccagcactttgggaggccagagtgggcggactgcttgaggccaggagtttcaaaacagcctggccaacatggcgaa

SEQ ID NO: 126507 - DNA, 1053 bp, Homo sapiens
ttccggccgcgagggtggagctttgtgcctcggaggcgtgggtgacgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacgccgcggccgcaccaaggtgggggaggggaggagcctggggggccccgctggggcgggagaggaaccggggtccacgggggcgggcgcggagaaactcggggcgagtggaggtgttggagccgcgttctcaggcctaggatggtgggggccgcggagggctggccttggcgggagggaagcgggcgagctgcccgcgagggacggtcccttcctccgctcgtccttttgcaccactcctaccgcctctccccggtccccaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacaggtgagccgtttttaacttcatcttgtccccgtttcatgccgtttcactccacccgcgtcgcttttctttctcccccttgtaatttttatgagggcgaatcctatgaaatggctcattggaccgttttctgtggttcagcctatttgctgttggccaaataactagctgtggcttggtttttgaaattctctgcagatcagagctatagagctaagagtttgagtatgaagaagcactgtttatacatgcacgaaaagcgtgcttttttgcttttttttgttttgttattgagatggggtcttgttctgctgccctggctggagtgcattgatgcagtcgtagcagcctccacctcccgggctcaaccgagcctcccgcctcagcctcttgagaagctgggactccagggggaggccatcacgcccgcc

SEQ ID NO: 126508 - DNA, 8437 bp, Homo sapiens
aattattgttacctttttaaaaaataaaaaattttttgtagggatggcggggggcgggggggggtctcactattgcccaggttggtctcgaactcctggcctcaagtgttctctgcctcggcctcaaaagtgcttggattacaggcatgagccactgtgcctggcctttaatctttgttacttgttcttactgccagagagtgggaccgtggccgtgagcgccgtagtcggggtgaatatcgggactatgaccggaatcggcgagagcgcttctcgccacctcgccacgaactcagcccgccacagaagcgcatgaggagagactggtgagatggagcggtttccctctcctcccctttgcctcagttccacctgggcctcccctttctcccctcacctgtgcctaaatctttgtcatttccttttctcaacttcccatcacccatcgttactttgtcccttgaaacccttgtctgggagaccatgctgtgtgtacccccgtctgtccatcctccatgctctggggaggtgactcccttctctgctttacttttgtgtcccccaccttcagggatgagcacagctctgacccataccacagtggctatgagatgccctatgctggggggggtgggggcccaacttatggcccccctcagccctggggccaccctgacgtccacatcatgcagcaccatgtcctgcctatccaggccaggtaagggtggggcttctcagaagagggttggtaggcctgggggatggatggggttgctgaaggccatggctgaagccagggagcgggtcaggcacacagaggcatgtccctggggtaggggtggtagctgttggggtttggggtgatgtccatggtggacaaagtaaaggggccccagctactttggcccctgtagcctcccaccgttccccaaaaaccaagccttcctgaccggggtcccctccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtgagtgcccctacttccctggacctctgccctggcatgtccccctggccccgctggtggagccacagccctgtcctcttcccagttttccctgtccagaactttctgggggcgggggtcgggaagtatgacagcattggctgatggggtctccccctcacttcagcaactgccacggcccccgccccgccctgtctcctgtcctgctgtcctcagagagtgggacacctccaggcagcaggccagagccacttggccccttggggcagcagacagactgcttcccacttgttggtgttgggtcattgtcatccctgatcaccaggaccctgtgtggctgtggcgtcctcctaaagcgacgagtgaatccagacaagaaaagcaaagatctcggtcgtttgacagaaaaagaattttaatttttttttccttttgtggatgttttaattttaatcaaccatcttttccccccttcctgctcctcctcctcctcatcctctttctgctcctcctccttgaaaagagccagaactgggaactacacccgctcatcgacggagctcggagcaaacccacctccacccccaccatacccagcccatacatgagcccctgggctgagctgcgcggccccggccaggcagacaggccagggcactgctgtgcacaatgcagcggtttagctgaatgtgattgctcaggcagctagccagtcaggccccactgcggagtcccgcgtgggcatctcggccgggcgcccagccaggagccagccggtggcccaccagccagcatgggccctgggcgccgctagttaaatcttgagctctgtttgaccaagcggccaaggtaaagatcctggaggtgatgcctgcggctttcctttcctcttctgccccactcgtggttctgttctgtcttcgctgtcccctctctcgaattgctctgtgtctttgtcctaatctctcagcaccttcattcttctctgtttctgttcttgctccctgcctaacaccaccttcttccctgttggtttttttagtttctctctctgatctttagtttttccctttgttttcggtttctgggactttctcacactctcccctttcctccctttccccttttcctcatactcctcatttcttctgttttccctctgaggtcctatttgaaatgttttatttttcttctccctaaccttccagccctctcctctctctccccctgtgggcaggacctgaggctctaaagggcactccagtgtctcccttcggtctttcctgtcccttcaccgtcttgcttatcttcccacgggtggagaaaggtgccctgcctctgggcttttgctatctggccctctgtcttccacctcggggtggagggagttggcgggagcagtttttgaatgactgcagtttggggttggtgaggagagggaggttcttcagggcctgctatttcctgagccttcctctctgaagctttgggaaatgacacctttttactacgttagtgtttcccagagatttaaagtggtaaatctgcctctcctaccctggcgtccccctgtagtcattggtcttcccaaatccagagctcttagttcctggttctcccccaaatcttcacagaacacaacttctggttccttttggggtgttgggtggttctagcgcacccctatcccttaatctctctattttgatgaccttttgtggttgtgagaggaagggggatatgccctgtctttcctgggccccttcccacatcctggccttggcttccaataactgttttgtctttccctcccccgcttcgttcccaggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcaggtgtgcggatttggaggggtggcaggcatctgggccccatgggggtgggggtgtctggggatcaggtagaagccggttgacaggagccagggccctggggtcatgacctctgttccctttgttggtagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggtccgagccctgggtctcctagtgttgtccctggcagcctgggggaggggggcgggtaggggtccataggagctagaagtagggggctggggaaaatgaacctgtggcctcagctgtgggggtgggggccctctgataaaggtgggaggggaggtttgacatccccagtggttgtctcttaccataggctgagaatgacagttctaatgatgacaaaacaaagaagtcggagggtgatggggacaaggaagagaagaaagaagactccgagaaggaagccaaaaaggtgaggtgtctgtggcctggggtcagagtgttggggctggggttctggcacgctgacttgtcccctctgctgtggctcacacagagtagcaagaagcggaaccggaagcacagtggtgacgacagctttgacgagggcagcgtgtcagagtctgagtcggagtcagagagcggccaggctgaggaggagaaggaggaggccggtagggtttcttttctgctttaaagtgcgttctcctaatgcgggtggggaggtgagaggttggcgacattgacgggagggtgggtggcttttaggggaaagcttctgtatcctccccaccacaatcagtaataaaaatgcaccaactccttcctaccccccttcctgcctagaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccgtgagtggggacccgtggagtcagggcagggctgatggagaagtggagggtagagggaaggcagtggggccctgcctgtgacagatgcccccgtttcacctgctagggaggccccttccccaggttccatggcctccgaggactagtcctgatagcgccattggctttcaggtgctggtgttctgaagccctttagtggtttttccctgcccaaggatgggaagagtgataaggcagttagtccctagggttctgagggcagtgggggattggaggaagaagcgaatgaatccttgagtcactgtggggctgcttttctgcttcttgcagctttgtaaaaggtacccaggctttatgcgggtggcgctctcagagccccagccagagaggaggtgagtaactcggtgcgttggagggaaaagtgcaggggaacgttaatggccaacaccaactccctcgcttgactatgctaacattttctttcttgtgtaggtttttccgtcgtggctgggtgaccttcgaccgcagtgttaacattaaagagatctgttggaacctgcagaacatccgtgtgagtgctgggggtgggactgtggggaagaggaagggagactctgtgccacacgggacctctgtgtgactttgttcatctgatagtttggttgttctgcacactctttgaccgttttgtctggctacgttgtctctgggcaaggctctagggcgttagcatggacggaacctatgtggtccccgtccccagggagctcgcagtctgatcaatcgctggtgctcaagagggaagggtcttagagctgctgtttctctggcaagcggggtaagtggggtaagctgctgatgatgtctgccctccagctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacggtcagtgactccccaaaggactttgtcagaagcaactggtagtgcctctgctgtgggcacctctgaccttacctatctgtagccttgaacccttgcacccactcgcctgctcactcatttgccccttcgtgtgtgggtagcagcacctccagattccagcagaactggggggatgctagtgatcatttgtggctggggtggaacaaaagctaaaataaagacaaatctcaagggggcaaaaggtgccatttatgtccggtgaactcctgtcccctcgctgctctttcacttgtggaaagtctcaggttacctcctctgaaggtcttctctgccttacttgcttctcttcctcccatcagagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtgccagtggcagcgcggggcacgtgggggctcgggcggtgagggcaggagctgaacgctcgcattcacttcccttaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaaggtgagctccaggttcccctttgttcccggctgcccctggccttggtcctccagccccttgccaccatccttccttctggctcccttgccaaccttccttcctctgttcccaaaccacagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaaggtgtgggatgttggagaatggccgtgctacggtggtgggaggtggggttgagacaggaagccccctgggcaggggtgggggaactgcttactgcactggcaggcgggagctgggaatccttccagctcgggcctgggagcgaggcaacccttatgtggctgtcctgacccctctcctctctccacccagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagagtaagatacgatccatgaaggtcgcatgtgccctcttccttgactacccagggactcctgtttctctttaacgtgtcaccccgagaagtttctgccccatcctcaggccatagccctagaagtcaattgtacccgtatccccctccccgcccccgcagtaattcatgtccctgtccgtgttgtactccccccaggtttgaccccaggactcccctacccacaccagactccccagggcctgatgccctatggtcagccccggcccccgatcttgggctatggaggtaagtacaggagggagatgaaggggcttggtgagtgtgtggctttgggagaagaaaacagaggatggaattgaggacatagttttgcaactcaacactgatctctgtcatagctggtgctgtccgccctgcagtccccacaggaggccctccatacccccatgccccgtatggtgctggtcgagggaactatgatgccttccgaggccagggaggttatcctgggaaacctcgcaacaggtgaggagggcagacgcccaagctttgttgccgcctgcagactcccttttgggagccctcagctctcatcctgtacctctcacctcacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacagggctcctgactctcgtgtgttacataactcctccatccttccagagtaactcctgaggtgttgctcagccctgccacttttattattgatgtcaaaagcgccaggctttgcagggacaccagtgggaggtacataggtgcgtgtctgggacccgagaatctcagttctgtaacttcgtcctcagtccaaggtgcgctgctgctgttgggagctaaggctggtcaagcacaggttgtagaaggagttggggtcaaaggctgcactcacctcttgccagcccacccacccagcagcctgtagttcactggggctttttggagtgccccagtagtgagggtccaataccaggacataggcttccgtgcctgaccctacgcagactcccagcaaggccttggacctggcatctgcgtcccccccaaccatgactgggcccccaccccctgcgaagtgcgagtaaagcctctccagctccccgtgcagccccactccccggggtacgtggcagaggcgtccctggggccctccgaagtgagcgaggcagaggctggcctccacgcagccgatccagtcccgggagccccggaagccggggggcttgtcgcccatgtcctccagggccgcctgtacggcggccagtccaggtacgcccgcgggctggccctctggccacgagcacagcgtctgcagagtgcggtagccgcagccccagccgcggtcgtccaggccgtcgcagccgtagtggtagtagaggtagtggcccgagagcagcgccaggcggacagggccgcggctcggcggggacaggcccacgtggacgtccctcagcggctccagggcggtgggcgggagcggaggtccc

SEQ ID NO: 126509 - DNA, 1063 bp, Homo sapiens
gacctaggcatctctgcccactgggatccccgtctgtgtccttactgcctgctcctcgcaccctggcaccctatacagcaggaccccagtacctgtgcacacaggagggcttccaccatgtttgccacaaggcctgtggactggggacactgaggattcgattattagctaaggccagggactcctggtcttgtcagttctcacaggtctgacccaacaagtagcactgacatttttacgtttgctggatgtacacacggaagtggaggaggaggaggagaaggaggagggcagctccttagctcaagagcaagtggcccaaggcctcagaagactagaaggaagttcctggccattcaggtgagacctcaggttccttcccggccatttgggtcagcccctagccctggggatccgtggggcttgaggacgggcggtagaagctagagggtgagctggtgaaggtgccttctcaactctgatcctgacgcctctgcctgcagcatggtttcccacgggtcctcgccctccctcctggaggccctgagcagcgacttcctggcctgtaaaatctgcctggagcagctgcgggcacccaagacactgccctgcctgcatacctactgccaagactgcctggcacagctggcggatggcggccgcgtccgctgccccgagtgccgcgagacagtgcctgtgccgcccgagggtgtggcctccttcaagaccaacttcttcgtcaatgggctgctggacctggtgaaggcccgggcctgtggagacctgcgtgccgggaagccagcctgtgccctgtgtcccctggtgggtggcaccagcaccggggggccggccacggcccggtgcctggactgtgccgatgacttgtgccaggcctgtgccgacgggcaccgctgcacccgccagacccacacccaccgcgtggtggacctggtgggctacagggccgggtggtatgatgaggaggcccgggagcgccaagcggcccagtgtccccagcaccccggggaggcactgcgcttcctgtgccagccctgctcacagt

SEQ ID NO: 126510 - DNA, 1238 bp, Homo sapiens
ctggccggtgtggacaataacctggtggagctggaggcagcgcggagggtggagaaggaggcgctagcccggctgcgggagcaggcggcccgggtggggactcaggtggaggaggcggctgagggcgtcctccgggccctgctggcccagaagcaggaggtgctggggcagctacgagcccacgtggaggctgccgaagaagctgctcgggagaggctggcggagcttgagggccgggagcaggtggccagggccgcagccgccttcgcccgccgggtactcagcctggggcgagaggccgagatcctctccctggaaggggcgatcgcacagcggctcaggcagctgcagggctgcccctgggcaccaggcccggccccctgcctgctcccacagctggagctccatcctgggctcctggacaagaactgccaccttcttcggctgtcctttgaggagcagcagccccagaaggatggtgggaaagacggagctggtacccagggaggtgaggagagccagagccggagggaggatgagccgaagactgagagacagggtggagtccagccccaggctggagatggagcccagaccccaaaagaggaaaaagcccagacaacccgagaagagggagcccagaccttggaggaggacagggcccagacaccccacgaggatggaggaccccagccccacaggggtggcagacccaacaagaagaaaaagttcaaaggcaggctcaagtcaatttcccgggagcccagcccagccctggggccgaatctggacggctctggcctcctccccagacccatcttttactgcagtttccccacgcggatgcctggagacaagcggtccccccggatcaccgggctctgtcccttcggtccccgggagatcctggtggcggatgagcagaaccgggcactgaaacgcttctccctcaacggcgactacaagggcaccgtgccggtccctgagggctgctccccttgcagcgtggccgccctgcagagcgcggtggccttctccgctagcgcacggctctatctcatcaaccccaacggcgaagtgcagtggcgcagggccctgagcctctcccaggccagccacgcggtggcggcactgcctagcggggaccgcgtggctgtcagcgtggcgggccacgtggaggtgtacaatatggaaggcagcctggccacccggttcattcctggaggcaaggccagccg

SEQ ID NO: 126511 - DNA, 1050 bp, Homo sapiens
gttgcagtaagctgacatcgcgccattgcactccagcctgggagacaagagcaaaactccaactcaaaaaaaaaaaaaaaaaaaaaacaggaagaaaatatttagggttcataatttaagaacagagaaaaatattctagcccaaagaaagggttgggatctgagacttttgaagaaaggaaggagatacagaaaagagatttcatcctggaatgaaatctccctccagagagccctgggaaagcacggtagcccccatccatcagagtggagccccttgtgggggaagtgggctcggctgggaaccctcaattcagcataagcctcacatgtcctctcctctctgtcccggtgcagacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtgagcaggcagggaaaggaaacccatttcctgggcctcaagagaaagggaatttggaaataaatccacatatcccagttgggtgcagtagttcacacctgtaatcccagcccaacactttgggaggtctaggcgagaggaaggcttgaggcctggagtttgagaccagcctggccaacataacaagacctcatctcttcaaaaaatttaaaaaccagccgggcatggtggtgcacacctgtagtcccagctacttgggaggctgaggtgggaggatcacttgagtccagcagttcaaggctgcagtgagctatgtttgcaccaccacactccagcctgggtcacagaacaagacctcatctctaaaaaacaaacaaaaaccaaatccacatatcctaaaaaatgctccttttcagcattctcttctctatggacaaagggctggatgctttaagaacc

SEQ ID NO: 126512 - DNA, 1002 bp, Homo sapiens
gcaagactttgtctccaaaaaaaggaactagacgggttcatttaaacccctgactgcagccctttgacatacatccaattgaggactggggactccgggaaacatctaaaaggcttaaaaactttgtctaacttcagccgggcatggtggctcacacctgtaatcccagcactttgggaggctaaggcaggtggatcaaaaggtcaggagtttgagacgagcctgaccaacatggtgaaaccccgtctctactaaaaatacaaaaattagccaggcatggtggcaggcgcctgtaatcccagctattcgggaggctgaggcaggagaattgcttgaaccccggagacagaggttgcagcgagccgagatcgcgccactgcactccagcctggcaatagagtgagactccatctcaaaacaacaacaacaacaacaacaaaatcgtctaacttcctgatcttcctgatcattgattttcccataggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatagtaagtccaagagccccttccccacagcccacagcaactgcatctcattcctggggtctcccaaggaatacccaaaatgtcaccctctgagggaggaagaccacagggaatgctcccctttaagggaggagagaccctagaatatactccagctttgacaaagatttcccaagcaggagacatcaggataatgggaacagaagacaggaggtttatcccatgaaggatgaagaagctgaaatccagagattccctcagggccacatttgtccacctgactccagggtctcatcttcgtgtgttgctagtgtgattacctgggg

SEQ ID NO: 126513 - DNA, 1021 bp, Homo sapiens
aatacagaagctgaggcgggaggaacatttgaaccggattcggaggctgcagtgagctatgattgcaccactgcgctccagtctgtgtgacagtgagaccctgtctcttacacacacacacacacacacacacatgcacacacacagagagagagaaattagaagatactgaattggcagaagagaagggaaatagaaattaaaatactgaataggggagcagtgaacaggggatacccaaaagccaagagcgagagagagcctggcttccagaaatagtggagaagccaggagaactaggtgaaaacccagtgctgggttgccatcagcgagagctggagccatttccaacgaaccatcttgtcgtcttcacagctgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagtaagccaccccgctatctccccgacctaccaacccctctctcctggctccctaaagtcaccgcccccaggttgaatttcccagatctgtgatgcttgcaggacatgcatgtgtgggaggctgatgggaaactgtggcctgggtttgattatgagtcttgcaatcatccctccccctgtttctgctggagggcaggggacagctcttcctgaccacacccccacattgactatccccagaatacccagcaaaagcccccaaaaggagagtcagagaaatgagggaggtgggggcccaatcagtccacatctacttagggtcgccccatcagcacttccatccccaaccctttcaagtcaacatccaaacaaaagaaatcacttccaaggacggagcagctcaaagcgcagcttctagctggggttccaagaaagcagatttttcgaa

SEQ ID NO: 126514 - DNA, 1091 bp, Homo sapiens
caacatggtgaaaccctgtctctattaaaaatacaaaaattagccagccgtggtagcgagcgcctatgatcccagctactccggaggctgaggccagagaatcacatgaacctgggaggtggaggctgcagtgagccgagatcacgccactgcactccagcctgggggacagagcaagaatctgtttcaaaaaaaaaaaaagaaaaataggaaggaaggaaggaaaggaaaggaaagaagagagagagaaagaaagagagagagagaaagaaagaaagaaagaaagaaagaaagaaagaaagaaagaaagaaagaaagaaagaaagaaaaagaaaggaaagaaagaacgaacgaaccaggcctccctctccaaccttcacctccgtccctattctggccacttgattcgggggacacctggtaggggatggggaaaggtgggagctgccagccagaggggaccccggcttgagcagcctcttgctgctatctgcaggttctccctggagactgaagtcgacctcaggaagcccctagagaacctgggaatgaccgacatgttcagacagtttcaggctgacttcacgagtctttcaggtaagaagactttcctttgcattttctcaccccagtggactgcgggggcccctaagaggaaaaaggaacctctccttgagagcggcagctgatctaatcctgtatccacatctgtttcagaccaagagcctctccacgtcgcgcaggcgctgcagaaagtgaagatcgaggtgaacgagagtggcacggtggcctcctcatccacaggtgagtctggctcaggtgaggctccacgggtgtcgcctccatcgcccttcaggataactggtccccagacccggaaaggaccccgcagccctctcggcacagagcagctctgtctgtgctcagccatcacccactccccacctgtttctcagcctggaaaacgggcttgggaccatggaaccctgtttcctcgcctgatggctcctaagttccctgactgtgaaaaggcctcctaaagaaaaacccaagttgttcccacagtgggaagtaaacttaagaaacatgct

SEQ ID NO: 126515 - DNA, 1238 bp, Homo sapiens
accctaccctgcttcctgtcccaagaggaggctaccttctatcacccacagacagtgccgggtccccgctctgtgactcaggcagctgcgactccagacagctcactcatctgcctagatctcagtccttccacccacatccagcctgatgagctgtcccactccttctgcttctcaacccccatggttcttccaccctcaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaatgtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgcccccc

SEQ ID NO: 126516 - DNA, 1047 bp, Homo sapiens
atgtttcatgatcaggaggaaagatgcaagaggaagagggaaaaaaactgatccaaggcaaggcgcggtggctcacgcctgtgatcccagcattttgggaagctgaggcaggtgggtcacttgaggccagaagttcgagaccagcctggccaacatggcaagaccctatctctacaaaatattttaaaaatgaggtgggcgtgatagcatgcacctgtagtcccagctactcaggaagctgaggcaggaggatcacttgagcccaggagtttgaggctgcagtgagctgtgatcatgccactgcactgcagcctggacgacagagcaagagaccctgtctctaacaaaataacgaaacaaaaaaactgaaaaagctgaccaatgactaaggcttggaggttgggggcagaacccaaggtgggaggcacggtcttgaaaaggaagtggctccagttgcccctccatgctcaacttagcctctccccgccctcccaggtgtgcgagctggacatcatcttcaactttgagaaggcctacttcatcctggatgagtttttgatggggggggatgtccaggacacctccaagaagagtgtgctgaaagccatcgagcaggctgacctactgcaagaggtacgggccagggacagtgaggaggaggaggaagcgcacagtggcggacagggtcctccctcccctggacacccggcctgccctgcccaccgtcgccaaggagccccccctccctgtggtatctgacccccaccacgcccagctctccagcttactctcaagccctgaccccatggggtgggaggtagggtggcagatagcccacctgtgcacccctcattccaagctctgtccttctcccaagcccccagatgtctcgtggccacccagtctcctttgtccaattctctgagcaaggcttaacaccaaagggttaagggtttgctctggagttaagggttgcttggagaattggagaaggggcacctggtaggtcattcttttcttccctgatttcttcccccacctctcttt

SEQ ID NO: 126517 - DNA, 1047 bp, Homo sapiens
cagcacaaggtggttttcgtccgtgtgagtgtgtccgtgggcgtctttgtgtgtctgcgtttctgtacatgtgtgtacgagtcagggggtgtctgggtgggatggattcgggacaacgtgcctggtgtaccccagaatcaggtacctcaagtggttttttttctgttgctttttgatgaggacgatgcttgatatgttactatgtgcgtgtggacggggaggcaggcgacttgtgtgtattgtcgagtgtgcacagcgcagcctgtgagtccctgcaaccgcgtcttgggtctctgaagtcgcattccttgagggttttggcgcccctccctccacctggtaaaaggaatgagtgagaacacttagagcacacctccattgccctgcacacatctccagcctaggtctgggtaactgctaggctaggtgtgacattgtgtttgtgtaagtgggtgtgtctccgaatctcagtgtgattctgtaggacagtgtgttatgtgtgtgacaggtggaagttgaaggaggctggttcaggatgacagaagtggttttctttctcttggtggataccaccttgatggtgtgtgtgtgtctgtgtgtgtatttgagtgtgtgtgtgtgtgtgtgtgttagtctctccagtggctctctcttcgtgtctctccccatctctgtctctttctctctctctttcttggtgactcatctctgcggcgttgccctcccccgcttgctgggtctcccctcccccactcaggagtgggtgggggtctgagggcgaatgggacctcaggactaaaaatcagggtgggcacccccttcccatcactcatcattccagaccctcccgtagcccccagcccacccctcagtcccttccccaggattccccagctctgggatggggagaggatagggcaagagtgtgttctaaatggggcaattttcagggggccttcagcatcttctgtaagttcaaagtggagaccccttcccctctcataaagtgccccctccctgcctgcccctccaccatggctgacgcag

SEQ ID NO: 126518 - DNA, 1050 bp, Homo sapiens
atgtaccatacatctcccaggcctatgtgatccggggtgataccctgcggatggagctgccccagagggatgtgttctcgggcagtgacacagacccggacatggccttctgtaagagctttcgagacaaggtgagcgcgggtgcacggtctggcctgggggcagtcccccagactccaggcatcgcctgcatcacggacacccccaccccactacagggcatcttcctccatctgagcaatcagcatgaatttggccggctcctggccacttccagatacgacacggagcacctgcaccccgacctctggcagatcttcgacaaccccgtcgtgagtggggaccccacgcccagagcacacaggttccccgccttgtgctaaggaagacaccaaacgtgatggctgctgccagcgcaggacactgagtgggagggggcggtcccctgggggctgggagcgaggggggcacagatctgatgtgccccccaccctctcacaggactggaaggagcagtacatccacgagaactacagccgggccctggaaggggaaggaatcgtggagcaggtgagcccacgcagcctccccacccaccccctgccctcatggccatcgcctcttgggggcccccgcctggattcaaagttttcacactgagttccccagagatctgagggttttctgttcagacaagatgaaggcagaggccgaacagaaaggactcttgcccccaaagccagcattgatcagacagcctcttctcctgtatattgggtatactggtgttatgcttgaaatcacatcttaaaagaagaatggggctgggctcagtggctcatgcctgtaatcccagcactttgggaggccaaggtgggtggatcggttgaggccagaagtccaagaccagcctgggcaacatagcgagaatctgtctctacaacaacaacaaaaaaattaaataagaaatgaggccaggagtggtgctcatgcttgtaatcccagtacattgagaggccgaggcaggcagatcacctgaggtcaggagtt

SEQ ID NO: 126519 - DNA, 1042 bp, Homo sapiens
ccatccagcccctcctgggcctccccattcgcatccttgcagcccccatgctgtcactcctgcccttgccagctcacccagacagcagagagcctggggaaggaaggatagacactgcctccctcctcttctcctgggggcatgggccagttaccccatccacaccgcctccccacctgccgccgtctcagctcgcctctcacctccagggacctgtgtcggcaggaccccgagtgtgagttctacttcagcctggacgccgacgctgtcctcaccaacctgcagaccctgcgtatcctcattgaggagaacaggtggcttaccccctctccccgcagccggagggcaccccaacaggccccgggaaccccactcctgccctgggcaccgggctccccaggcctgctcccgtctgcccagccctcacccccacctgtccgcaggaaggtgatcgcccccatgctgtcccgccacggcaagctgtggtccaacttctggggcgccctgagccccgatgagtactacgcccgctccgaggactacgtggagctggtgcagcggaagcgagtgtgagtcccgccagcctgcagccccccgcctcctccgacccggggcccaggtagacccaagccccctactctcaggggtttggagtggtcaccagtcagaggtgccatgaggctggctgcagtggctcacacttttgatgccaccactttgggaggctgaggtaggaggactgcttgagcctgggagtttaagatcagcctgagcaacgtagcaagagcctatctctacaaaaaacttaaaatattagctgggcacggtggtgcgtgcctgtggtcccagctactacggaggctgaggtgggagaatcacttgaacttgggaggttgaggctgcagtgagccatgtttccaccactgcactccagcctggaaacagagggagaccctttctcaagaaaataaaaaacaagggccggccgcggtggctgacgcctgtaatcccagcactttggaaggcagaggcaggtggatta

SEQ ID NO: 126520 - DNA, 1050 bp, Homo sapiens
ggtgtagtggcatgtgcccatagtctcagctacctgaaaggctgaggcaagagaatcttttgaactcaggaggcagaggttgcagtgagccgagaccacgccattgcactccagcctgggtgacagagtgagactccatctcaaaaaataaaaataaaaaaaaaaaaaaacaaggagagagagaatatgaggaggggtagggatgctgaggctcctactggcctcccgctcagctcaccctccccttcctcgcccagctgcggtgtgatcacgcaggtagtaggcagtggagctctctgggccagcagcctggtcagaacccaaaggttcctgcccacaacgagccacactccaggatagccctggtgtccctttattccctggagaatttgggaccccatatttagaagaatgtgttgcttggtagctcccagagaaagggggtctgaagcctggcctttttcttccccagatgaagtggttttaaagtttgatcggaaccgtgtgcgtatccggaacgtggcctacgacacgctccccattgtggtccatggaaacggtcccactaaggtgccaccagtggtctcaacccccgccccgccctgccccaacccccaggcacctccaacccttctgagaagctggcccttcccagcccccatatcagaggtgcctgacccccacctccacccctggaggcctcagccactcagcctcagtctgtccccaacagctgcagctcaactacctgggaaactacgtccccaatggctggactcctgagggaggctgtggcttctgcaaccaggaccggaggacactcccgggggggcaggtgaggtgggggtgccagggaggggcacgagagggcagcgtgctgagcaggaggtacaaggacagcggactggggggcggtgggggcatcgctcctgggtccctgcacctgtcagggtggaggttgggtgggggcagcagggaagtccgggcttctctctgagtccctgcgtgttgcatcttccagcctcccccccgggtgtttctggccgtgtt

SEQ ID NO: 126521 - DNA, 1567 bp, Homo sapiens
ctccctatgcaaagggactcggaattcctgggcaccactcccaccctgccctccttggggtcagagtgttcctgggtgagaagagtttaagaatgggaaggaagaaagggagggaagtcgagtgagagggaggacagcaaagcacgtgaggcccggagctgggcggtggatctcaagtgccatttccctctggtaacagagaagctgctggtgatcactgtggccacagctgaaaccgaggggtacctgcgtttcctgcgctctgcggagttcttcaactacactgtgcgggtgaggagagggaaaggcccctgggagggggtcccagcaggaggggtgggctgaagtctggatgcccaggtccccacggtaagcctggtcaggagttccccccacaactccccaccccttgcctggcacggggcaatcttctccacagaccctgggcctgggagaggagtggcgagggggtgatgtggctcgaacagttggtggaggacagaaggtccggtggttaaagaaggaaatggagaaatacgctgaccgggaggatatgatcatcatgtttgtggataggtaacggggctggggatagggagcggggtaaggatgctgaggttcccagtggacccctgcccatcctccccttcctcacccagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggtgagtggcagagtgcccaaggcagaggggccaagagcggtgggacacagagtgttaaaggcgcctgagggctggagacagcctgggggacaggccctgggaccctgggagtctcgaggtcaacactccccctccccgccaggattcatcggttttgccaccaccatccaccaaatcgtgcgccagtggaagtacaaggatgatgacgacgaccagctgttctacacacggctctacctggacccaggactgagggtagggaaggcagaggagtgggcgcatcccgcagctctgtgggagtggaggcctcaggctgaatgggatttggggagcaaagggggttgcaaagagaaaaatgtgtgcctgggcgtggtggctcacgcctgtcatccaagacttttgggaggcttaggcaggaggattgcttgagtccaggaatttaagaccagcctggacaacatagttgagacctcatctctacaaaaaaaaagaaagaaaaaattagccaggcttcatggtgtacgcctgtaatcccagctacttgggaggctgaggtgggaccatcacttgagcccaggagtttgaggatgttttgcaccactgcattccagcctgggtgacagaatgagactctgtctctcacaaaaaaaggaaaaccatggtggctcatgcctataatcccagcactttgggaggctgaggcgggtggatcacctgagattgggagtttgagaccagcctggc

SEQ ID NO: 126522 - DNA, 1054 bp, Homo sapiens
cgggcggaagacggggagagcgagaggctggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcgggtatgtgagcccccgcggttcgcccccttccccttcccaagtcagtcctagaattttcttacctagtcattcctcttttttggtctcgctctttcgcctaggctggagtgcagtggcatagtcatagctcactgcagcctcgatttcctgggatcaaaccatcctcccacctcagcctccggagtggctggaactgcaagcatgaggccccacgcctggttaatttttaatttgttatgtggtgacgggctctcgctatgttgcccaggttggtctccaactcttggcctcaaagcgatcctcctgcgtgggccttccaaagtgctgggattacaggcgtgagctgccgcgcccggccccagctattcctcgtaaatcccttcctcagccctcgggtcctggcgttgacccttcattcacgttttattggtgcctgctccaagccgggcgctggggatgaagaggagaaagacccctcttatccaagcattggctttttctggaagggggg

SEQ ID NO: 126523 - DNA, 1052 bp, Homo sapiens
gaggcaatgggtacagaaatgttctgcaaattgaaaagcaatggccagatggcattgtttttgttttttgctgagacgggttctcactatgctgcccaggctagtctggaactcctgggctcaaggcagttctcctgccttggccattttttttttgacagtctcactctttcacccaggctggaatgcagtggcacaatcttggcttactacaacttctgcctcccaggttcaggtgattctcctgcctcagcctccaagtcagtgggactacaggtgcctgccaccacgcctggctaattttttttttttttttttttttttttttttggtatttttagtagagacagggtttcaccatgttggccaggctggttttgaactcctgacctcaagtaatccacccacctcagcctaccaaagtgctgggattacaggcatgagccaccatgccccgtggtatggcactgtggacgtgcactgtgtgtgtgcgccatagcgtgcaccctaactctgctccccagctaggatgtaagctcccggaggcagccgctcactcttatcttcgaagtccctcccacacctggccgtggccagcccctactgggagctcaagaaacactgccgatgggctgatttgcagccaggagatctggggagtacagatgaggcaggggtgagcaggtgtccatgcagcagggtaggggaggtgagcatgaggagtgggaattggagaggagattagatgaggacaaagcagcctgaagtctgcggttgagggggacccccgccccatcaccttcccccagttaccggccagaatgtggagggcccctgcggtggccgccagcttggctttcctggagagctccaggcccccaatgttggtgcagcgcaggcccgctatgcctagcaagaggccgaggaagcccaggaggatggcggtgatcatgagtgcccggcaggcctgaatataccctgggggtgggcacagttgtcagcctttcccatctcccctctgcgacggagccagcccaacagcccctcaccat

SEQ ID NO: 126524 - DNA, 1614 bp, Homo sapiens
gcaggagaatcgcttgaacccaggaggcgaaggttgcagtgagccgagatcacgccattgcaccgcagcctgggcgacgagtgaaactccgtctgaaaaaaaataccacagcagatgccaaaactgagtcacgctgcctttggcttctccagggccccgatttcctcatttcagttggatggaccagttgactgtaatactgataaaaggcatgttctgtcactggggtgttggcacagctggggttcaccctgtcccagagctctggctagggtgctgggagtgactggagctgaaagggaggcttaggactgtgaccctcccaggatcacagaggcattcagagagtggaaggggcctctgggacacagtattaggaaagtattaggaaagaagcatttctcaccctcttctctgcccctccccagagctgctgcccaaagggagcaaggaggaacagcgggattacgtcttctacctggccgtggggaactaccggctcaaggtgaggtggggaccccgttcccttcaccctcctctggggctgcaggaccttcttactgtgtcctccagggtggagccctggacagcgggaaggctgaaggggtgcagaggtgcagagcggtgtcagatgaggactccgagggaagatcagagtggcgagggggtggggaggaaggtgacgtcaagagactgggtgcaggcccaagccttgcgctgttatctcccgcagagttggggttgtttgtggactctactccgtggggtggggctggagggagggagtgggtggaggtcgagggaggagcccccagggctgaagaagggaaggcccttcacgtgggcagggggagtggtggatactgaggtgtagccggcccagtggctcacgcctgtaatcccggctactcaggaggctgaggcgggaggactgcttgagcctgggagtttgaggttgcagtgggctgtgattgcgacgctgccgtccagcgtgggcaacagagcaagaccccgtctcttattaaaaaacaaacaaacaaaaaaacactgcggtgtgtatgacgcgtgcgcgtttccccgagcgcaggaatacgagaaggccttaaagtacgtccgcgggttgctgcagacagagccccagaacaaccaggccaaggaactggagcggctcattgacaaggccatgaagaaaggtgacagcctcggcccctttgttcagccccgctcttccccacgcctgggcactttggtctctctgtaaatgaacccctccaggcagcccctcagccccaccccttccagttcttagagccccttgccctgcgactccaggtaggggtgtgcctctgttgaggggcagggctggcggaaggggacggtcagggtttccgcaggggccgggctcctgacactgtccctttccttccccagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgt

SEQ ID NO: 126525 - DNA, 1489 bp, Homo sapiens
tccagcgatcttcccgccgcggcctcccaagttgttgggcttcggacgtgagctacgcgccgggctcccggttctagttaagattttgttgcaggcgatgaatagtcacgtggcctccaaggtcctagatttctgaggggcgtcagcttggcaccctaatgtactgtgatctctggtcagctacccaccctctttttgctgttttcatcctgggggctaaccgccaagacatggcctccagtttccctagggaagcctccacagaggaaggcaccggctgaggcacctgggaagaccaacctggggaaggtctccctgcgcgcagtctgcgggctggagggaccggccgagcctgcgcactagcgccccgccggcgctgctgaactgagaggaaggggcggggcgtcgccaggtcgtgccagcatccgccggacgccggaagtggttctccgcccctgccactgggccatggagactgtggcacagtagactgtagtgtgaggctcgcgggggcagtggccatggaggccgtgctgaacgagctggtgtctgtggaggacctgctggtgaggcctggcccggacagagggaaagggaaggtcggagggcgggtcctgaggagagtcaggtaggggccgaaccctcctcccggcatcggcttggccgagggaagccgaactacggctcccggcagcctccacagcgcctggctcctgcccggagggcctgctatgccgcagaggctcctgggagttgtagtgtcctgagccccccacacctcagactacgggcctggagcccgaccgtggttagactgacgggatctgggatcatgcaggagctgtgagctcagggcgctcctccagcggtggaggaatacagtgaccatcataaggtgtcacctattactgcgtccggcacggtgctaaggcatcgcatgccagatctcagtctttgtagctctaggaggtaggcactacttctattcctggacaataaaaggtccaggcccggcagggtggggcaggatggggccagcagcctcaaatgaggaccgcgtgggctgttgagcagttctgacagcgtgtttactgttcggccgccggggtcagctgctccgggagcggtgcctggagctgccaccaggtggcatctccgctcggtaccgccgcggggaggggagaccgggggcctctgtcccaagagctggcccgcaggcccggaggagccgaaagcctgggtcccgggcatggagatagcagaagctggggtgccagataccgagacctgcgagggaaaggggcagagccagggagatggcatgtccagatagagaatggttgacgccctacatttctaaatgattcctttcctcccctgtggcagaagtttgaaaagaaatttcagtctgagaaggcagcaggctcggtgtccaagagcacgcagtttgagtacgcctggtgcctggtgcggagcaagtacaatgatg

SEQ ID NO: 126526 - DNA, 1003 bp, Homo sapiens
gcatgcgccaccatgtctggctaatttttgtatttgtagtagagacggggtttcaccatgttggccaggctcatctcgaactcctgacttcaggtgatctgcctgccttggcctcccaaagtgctgggattacaggcgtgagccaccgcacccagccaattttttgagacagggtcttgctctgttgcccaggctggagtatagtgacgcgatcatggctcactgcagcctctacctcctgggttcaagtgatcctccaacctcagcctcctgagtaactaggactatgggcacgcaccaccacaacccagctaattttttaatatttttatagagatgggggtgggtctcactatgttgtccagggtggccttgaactcctggcctcaaaatgatcctcctgccttggcctcccaaagcactggggttacaggtatgagccaccaccatgcccagctcacagtaacatgtaaatgtccagctactactgtgtggccttgagtgggtcactgtacttcttggtgcctcagttttcccaactgtaaaatgggatcagtaatagtatctatctcatctgttgttaggaggattaagttaatcaatagggacaatgagcttagattagagcctggcacctagaagtgccatcattgtgtctcctgtgttgtgtttggtcactagacaagcacgggaggaggcatggcttgggagcttgacactccctggttcaaatccaggctccaccactgcctcgctgtgtggctttgggcaagttacttaacctctctgagccttagtggccagttttggcaaacggggataataaagcatggtctcttggggtcgctgtgaagcttacatgcgctgtgggggaagagagcacctccactgtggccagcacatagtaggtgctcagcaaagctccactcctcctccccgccccacacccctacagtgaggcttgggcatcaaggaagcgcctgactccttggccctagaggca

SEQ ID NO: 126527 - DNA, 3035 bp, Homo sapiens
ccgggtgcccgggcagtgtacgctgcctccccgccgccggtccgagccgcgatcgccgcgcgcctgggggctccggcggcccccggtgacctgcggcgccgggtcccttccttgcgtcccctcggggcttctgccctctctgcagggcccgccatggagcgcgcggcgggtgcgctcggagatgccttctcgggccgggttctcgaaagcagagccccgggggcccgttgggaccgtggcatgccgggcggtggtccgcgcgcggagtccccggcgccgcggggggaccgtgccggggctccccggcccgcgcccgagtcgccgccgtgcccaaggggcgagtgcctgcctgccaccccccgcccggaggagcggcgcacccttagggtccgccccgcacgtgccagctcggcgcccgcggcgccgggacagccccgggactctgccaggtggatgttgtgcgtagccggagccaggttgaaggtgagcggcgtgtgggccagaagtcccgaggttgcaggcgcggagggaaccggggatgtcggggggtgcccgggtcccgcggcttagaatgctctagggcggcctggtgctctgggaggggataggagggttcctcagggcccctggggaactgcagctactcccaactgctaaggtgtgcgtgaagataaacttggctgaactttcctaacctggaggactggtgacagtgacctaccgcaatacctttgggagcaaagctcgagatgcaggcttgtatcaaacgaagcgggttggattaaaacatatttaaatggaatctgacaactttaattgtatatgcttgttttctgctcttgcctactaagaacgataaagccgagtcatagtcgttatgaaatttcctgaaatttctcgcttaactaggaagaagactatgcgaaatatgtatttccgataagattaaaacttaaaggagtttaagtatttattgactaaaatagattactccaaagtgtctattgtgtaaattagattcctggatgtaatgaacacagccgaatggcatttttgataaattggtctaccctgttttagtaaaaatagctcccttttaccataatttaattcctgtgcttactgtaaaacccgttgtggagttttaaggacaaacattattattatttttctctcttgtcttcctaaatgtgacatcctagcttaatatcaatgaagtgtcttttttaaagcatcctggcaaaattgcctggaaaatggatttggtttctagagttactagattttaagaactctaaaccttcctgtcccccatattagctacttcttcaggggatcagggctccagggttccatcgaaagtttccatgtcagtttacttgcactttatgtggatattaagaagaaatcaaaaccaaaccccaaaacaaagtcccttatttgaacttcattcctctttactcctttgcttttggtggttgctaacgatttggccttagatgatttcctatgggtttgcaaactttagtcgaatacggaatgtcaaagttcaagtctcaggccaatctggttctttctctgggcggtgaggaggcctttggagttggtgtctggttaattcccaccgatagtcagtgagtcaatagaacgagtttgggagagaattcattagttccagatttttctcatttttccagacctctttatactgagattgggttgccacctgggggtaaagaggctgatcggtctttgcagagagaaatccaggttggagacgtcagcgggtccaggtgaggttgggccgttccgcagttctgcaaccctggctcactgggttcttgtccctcggcttcctgggtcttgaagctgctgccttggcacaggagtgtgtgctcaggaagagaatttctgaagattgtgttttattccgtttcctttttagtcccaaaggcttgtggtatggaagtttcagtgctttggtattgctaagactagttggacaagttttttatcctatctcagacttgtaaaaaccaggttttcttttctttttaaataagaaaagcactgttgtataaatttgtcttttaaatacatatttgaaaggaggacactttctaagacaaagctcatggcactctgtatgttagtggagctttgaactctttgggacggggcccgccaatgactgccttccctttgggacattattcccacatggtgaccagccttcccctttaagcagcttctgcaaaagtaaacttgaaaagttgccttctttttcagaatcaaaaaacaatttcagttttgctgaaagtccattttctgatggctttttttccccctgttgtggaagtgtgtatgttactggctgtccagtactgtttgccataataagtatattattttaattaaaatgtcccatctagtaccctttataaaagagcagttcaagaaattacaccactgctgctcctgcttttgttttcttggttcttttaatatgggtgtctttgaggttggatgtgggaaggggtcattggcagttgatttaagttttttcctatgtgaaactctttttttccttaaaggtgcaagtggtgagttaatgcaacaactcctggtacagttgagtccacagagagccctttgactacatcctcggcttcgtgtatcttctgtcggtagttagccaacctaagaaagctgaaagggccaaatagtccaataccttcaggaatgattctctcctaaatccactgagctaaccttaaaaatgcagtctggtgaactgtgctgagcctgaaacctttaatggctatttaaaaagtctcctgtttttgtacaattaagacaaacccatcagggtttatatgggagctgtgaaggaacagtagtttgtgctctctgattcccttctgggtctacctgtagcagtaaacaatcaaaaccactcctgaggctgtactcactttctgtgtcttaggagagaacacaagactagaagtagaaaatccacatttgtttcagct

SEQ ID NO: 126528 - DNA, 1011 bp, Homo sapiens
ggtttatcaaacacaagtggggcgacaggacccacacttcggcgttggacgtgactcacgcggggagttggcttggagttcctttattcatccctatttgctttctgtctgtaatcctttgtaattccctggtttcatgatgtaattctaatggaaataaacccgaacctttcaaaattatgtaattaattgcattcagcttcaatgacaatgactaattatagtgatacctggtggcaaggcaggtacctactgctggggggctcctgtctgcttggtactaggactgccacttctgggcgcgtcggagcggctgcacagggggtcagctggctgtcctgtggcctgctccggtgcctctggtccccatcttaccaggagcagcgccatggccatgcagggaggggccggagagggaggtggtgtgcagggaggagctgcttaggggtgggagggcttggacttgtctgcaggttaaagagaagtcttgctgggaaagtaacttcggggctggttccctgagagcattcttatctgattcatgtattttcctgagaaaaagggaggagggtgcgttcgactgaacgtgaagcgttcaaggatcggaaaggcaagccaggtacagtggcttacacctgtaataccaacactttgggaggctgaggcaggaggatcacttgagagcccaggagttcaagaccagcctgggcagcacagtgagaccccatctctacagaaaaaaaaaaagaaaagaaaagaaattagcccagcatggtggctcacacctgtgataccaatactttaggaggtcaaggcggaaggattgcttgagcccagttgttcaagaccagcatgggcaacagtgagaccctgtctctacagaaaaaaaaaaaagaaagaaattagctgagcgtgatggtgcacacctgtgatcctggctgctcaggaggctgaggcaggaggatcgcttgagcccaggagttggaagctgcagtgacgtatgacagtgcc

SEQ ID NO: 126529 - DNA, 1039 bp, Homo sapiens
tctgatgtcttatttttttcttttattctagggagttctcatacatttatctctccaaatattttctctcctctctttattttttcttctttctaggacacccactgtacaggtgtcaacccttcttctgttgtccatctctctctctctctctttttgaaatggagatggggtctcactatgttgcccactctggtctcaaactcctgggctcaagcagtcctcctgcctcagccttccataatgctggaattacatgtgcgagcccccatgcctgacctgttctctgtatctcttaacattagcctcattctcaaacatgaagagagtagccttggtgtagactggccacgaattggcgattgttgagatgggcgattggtagtgagggtacccatgaattggcgattgttgagacaggcgatgggtggtgaggtactgtttgtatgtatttgaaatactgtctgtgtatagctccagttgaattacctcctactgagacccactggccttagcctgtggtgtggggatgaaagtggggagggaatagaggaggaggctggctagataggcttggggctggctgccaggacagttaacatgacttacatggcacatcgtacatttctatggaacagtgctgttccgatttagccccttgctaggcaaagtgattcatgaaccagcaacagtggtatcacctgggagctcgttagaaatgcaggatctggccgagcacagaggcttatgcctataatccccgcactttgggaggctgaggccggaggaccacttgagttcaagaccagcctggccaacgtggtaaaaccccatctctactaaaaatacaaaattagccagatgcagtggcacatgcatgtaatcccagctacttgggaggctgaggcaggggaatcgcttgaccccaggagtcggagatttcagtgagccgagattgcaccactgcactccagcctgggtgacaaagggagactccatctaaaaaaaaaaaagaaaaaatgcaggctctcaggcccca

SEQ ID NO: 126530 - DNA, 1021 bp, Homo sapiens
tagacctcattccacccctttagtggggacccaccgcgcgctggccgcaagcctattttaatttgtaacaattctgcttgatgacaggaagacgtcaaaaaggagaaatcaggctaactggggctccttgtccacttggggggcatgtctcagtgtcttgcctggggccttgtacacaccctctcttaccgggagtaaagtgaggtttagaaagattacctttgtcctgggtcattcttccttaaatcacagctaggatgcaaacccagacctctctgatgtcagtttgcaagctctttcaggtaccgtcagccacatgccaggccttcagtggggtgatgttttttgttgtttttagaaaatactgctattcactcatgggaaatagggacgagggcttagatttcagctgctttgcattagacaatgatttctcttattataagcagagctctctattaaccaaaaacacttggctgttagacatggtgtttaattgctgttagaatgtatttttgtcacactgccctataataagccaaagaactgtttgtgccaaacagtgaagggaagctaggggaggatgaaaactgtgcctgctactccacctcccttctttcgaggtcgtggtgttttgtttgctgttttagctgtggtgtgtgtgtaccactcgtacctttcacaggaggacacctcatctgaataccagtcaggacctgagacgcgttgagcccctccccacagtgcccacgggtaggtgcgccgctctctgccccttccgggagctctgctttttctacctttagagatttctttcatcctctattacgtaggcctgactttttgcctaataaaggaaaaacaaccatctatttagcactctttttttttttcccaaaatggaaatgactttctctctgatttttacaaagcaaaaaatgagagtaaagattaagaaactacaagaaattatggtgaagggagtaaagatggccatgaatcctatgactgccgatggttt

SEQ ID NO: 126531 - DNA, 1006 bp, Homo sapiens
caccgcagggagcgcagatgtacttggagtggggaatggttgggggggacccattcccctgctttaaaccgcaaatgtcttttgatatctagtaaaattggcaagcagaatgattgaaaacatgtgagaggtaactggatctaagtctcaagtagtacatatttgagaagttttccccaatgtaaaagtcactctttaagagccttaaactaataaaaacaaggaaattccatgttacggctgccactcggccttttcatttttattccagaagtcagatctgacaggtcagcagctcactggctctgggctccccgtgtttaaagcagtggggacgaggagaagaactggcagccgccgggacggggaagtctccaatgccattcagtgccaggctcgtaattccctcttagtttatcctattttctcttcttggggcggcttcctgtatgtactttattcactgaagctgcttcaggattccttcagagactattcttgtttctttccatttctgtgtctttttttttttttttttttttttgagacagagtcttgccctgtggcctgggctggagtgcagcggcgcgaccttggctcactgcaacctccgcctcccgggttcaagtgattctcctgcgtcagcctcctgagtagctgggattacaggcacgcaccaccacacctggctaatatttatatttttagtagagacagggttttgccatgttggccaggccagtctcgaactcctgaccacaggtgatctgcctgcttcggccccccacagtgctgggattacaaagcataagccaccgcacccggctaatttcctttatagttacactagcttggaagaataacatactgagtggcgtggaaggcgttggtgcacataggtgcagcatcccagagccccgtccactggcggctatttgtgcatggctgcctgtggcttcttatctgtgatggaacctcgtgggcagagaagtggctggagagcatc

SEQ ID NO: 126532 - DNA, 1016 bp, Homo sapiens
gatgccaccgcaacggtattggcgaaccggcaggatgaaagtgagcagtccagaaagcggcttatcgaacagagccgggagttcaagaagaacactccagaggtgaggcgcgtgaccatcgtgttcgctttgaagggatcttagaatgctggtgcatgttcaggcgacgctccgtgagcgtttcattttcatcagatgaacgcacggccggcaaacaacccgtttctttccccagatgtcttcagccccatttccagcagaacgcatgccatcctgcaggctgtggggatgtggaaattgataggttgtctggaaatatgaaagtcagagccaattccaggtgcagatactggacaagcttggtctgtaagaacacgtgggcaggtgtgtgggtgtctcagaccctcgagctcatcccagaccctgtcccatgtcagttagcaagccaccaaagtccataagggatcctgtggggtggaaggtccgcggggcctgcttccctgttgctggtgcaggcggagtgtctgaaggctgcacgcatctgggcatagcagtgcgcctaacgcttcttgtaaaacagacatttcgcctgctaggccttttaaatgcctctctgtttcttgaaatatgccgtaaagggcaatggaaatgtgctttttatatactcctgttttttctctcgtgagtgtgcaatcgggggacagtgttgagttgctggggtggcgtttttctgctcgtttcctggccccttcttccttcccttcaaccctatcaggggcttactaagaaaaaaaaaaaaacatccaagcgtgttgcaggcagatgagcagtcgcgggaatggctttccgggtgacatctgccagtttggtccccatggcgctcatcccgcgggctcggaccccagcctctcttacatcttccccttgtatgggaaggggtcgcagcagcccacagcttcggcccggcttccgggcttggggaatcttctccgtatcgtagctcttggctcctccat

SEQ ID NO: 126533 - DNA, 1091 bp, Homo sapiens
gcggaaagtccaagacgagacccacttcacttgtgccagcagccagagcttcctgctggtaactttttttttattttttgagacagagtcttgccctcaggttggaggaccacccaatcgctcaggttggagtgcagtgtcacaatctcggctcactgcaacctccgcctcctgggttcaagtgattctcctgcttcagcctcccaagtagctgggattacaggcacatgccaccaccacacccagctaatttttgtatttttagtagatttcactatgttggccaggctggtctcgaactcctgacctcaggtgatccgcccacctcggcctcccaaagtgctgggattacaggcatgagccaccgcgcccagccctcctgctggaaatgttgaaaccacataagaccagaacagtggtgggagtcgggggctgtggccggagtgtgctgggtgtgcaggaggcggagttccctgctgttccctgtgacagcaggtgtgtgtgtgtggggggggagctgtgacagtacgtgtgtgtgtagatagcacatgtgtggagcctcagctcagtgcctggcctgtgtcccaaggggacactgggtcaccgtttgtttggggtctcagtcttgaggagccaccactgccctgacactggttgctcctctggccacaccgcaggattgattactaaccgtggaggtgacgtcgggttgttgcatgtgtagaaacgaggcttgcttagagctttcgcccgttgggtaggacagcctggcttaccgggaggagggtatcctcttccctatggatgcagcccacgatccccatggcaacataccttccagggcacagcgtggcagagccagggctggtggtgttcctgctggtgtgacaccaagggtgttgatcttgatggaaacgcccacgtctctctttgttctgggaaagaaggaaaggtttcctggtgtctgatgaatgtctaatgtgttccacagggaggattaggcacccgcgagggttcagtggggagtaaagtttgtctgccatcggagatttcaccttctagactggcccttcccagatgtcactgggaaa

SEQ ID NO: 126534 - DNA, 1065 bp, Homo sapiens
tgtctcctctaaaacagaccccgttgctctgggaggagagccgagctgcggctcaggggccgtcactggtcatttttgccctgatgtatttttgcctctacatttcttgatctctggaacgttaatcccaacgatgcctggtctgcggtgctcacagtctgtgtctgtgctttctacacctgtcctgctcagatgcacatgatgtcacacccaggtctccatcctggctcttgttggctgcggcggcagccctgactgtcggagacgcctggctcagcatgcccaccttgcaacagggagcaccctgtgctgctcacagaactgcccatccactttcttttcctttcctgggtgccaacatcttcctctgccccttctacgccggcctggcgcatttctctgatttctgtgttcccgggtagcagttgtaaaaattcaggcttgggagttgtcttgagataggacttggaaaggaatcttttaccatcgttgaaattggctagatttgtggattccttcccgaccctggcaggcacggtgaggggaggaggtccctcctttttattgatcaggatgcactgtgtgcggggtaagccaggaagccacgcacctgatgctatctctgccatggggaggaggacagaggatgggaagatgctgtgaacttttatgattcgtttttcactctcggtgagaaaaggagctagcaggatgggtgagggagtggagggtagtaatatatagttgtggcctgggcccaaacgcatttagtcactgcctcgacagcctttatatagacaccaccagagtgactcagcctggaaaaagagagtcacttaaaaataaagttgcgactccagtggacacgtggtgcacaggctgccctgagatagtcaccagggctccatggccctgcacaccccccaggaccctgggcgagtcaggtggtgaagtgagggtgatcgttgtaaccccatcttggcattgacgtgaggatttagcaaagtcacatatcatcccaattacttttttccttttttttttttttctttttggagacagggt

SEQ ID NO: 126535 - DNA, 1119 bp, Homo sapiens
atttaaatgattgctttgccgccatcaagaaaaaatactgtttcacttaacagtgaattgagacaaggaaaagtgatgtgtgaatagaaataaagaaattaaagtaaaaaacaggatcagggtaggttctagggctaataatttaagaacagaacatgtggtttaactctttttgccactctaaggagaggtgatatttgtatttttctttttactgaaaccagatcgtgagacacgcttttcattcatacttgaaacttgataaaatgtttggctttatattaattttctcaattataagtgtgggaaatgaattcgttgataacccttttcaagtaaatgaactgattagaaccagaagagccgagagtcatttttattttaaaattctttttgcatgaacacatgtagtgttgaggaatatgtggaaaattgaaatattgcttctctcctaccgtgtctccagtgcctcgataaatcaccttttttttttccttttaaaatgtctggccttataatttatgtttgcataacccattactaaattcatagtaggtgttttagttggcaggcattattccagggatttggaggagtttaaaaaaaatacagagcctttgttagtatttatactaagtggacattttccttttttaacaacaacaacaaaaaagaattagatttttaaaaaagaattcagagctagctatttacctttttcctagacaaacactattaagtccatattctcacattattcattgtcttaatggagattaagatttcttaatggactttattatagcttttctttctttttttcaaaattagaactggccgaagaaaatgcttctactattaagatcagatgaatttctacagaattttcagtaggtgtcatgttgtataggaaataaacatttctgttttagtaggttttcgatttcttacctcccgttgaccgttttgatcataaagtgaagatgaatacattcattcatttactgcagtctttggtacttgaacagaaatagcagtgttcttggtttgttcgcatacttgtggcttacctttgagactttctaatttttaaccagacatttaaaaatagccattctg

SEQ ID NO: 126536 - DNA, 1047 bp, Homo sapiens
gtctgcctcgtttcaggctgggatcacagatcaggagcgaaggctttatgatattaactagtcaacagatacattctttgaagaatttctgtgtttttaattaccccacgaaagcctttggacgcacgggttatgaggggcattttgcattgctaaattccagccttgattgcaaacctgaaaagagcagaaactgctcagaacaagttgttaaaaccacagacacaagggaaaggtttctctctctccctccccctctctctgtccctgtttttaagtcctttcagctggaggtgaaactgcaacgttatcaaacatgccagtacacactgtttcccaggcctgtttttgcatgagttggggtagaaatgtacccagcttctgttccagtaggtggagaaagatgcttaaatcctagaagcactgttcacctacctttttagggtactgcaggtttagctcgagggttggagggcatccagaaaagcatgactaagagagaaaaagactactcccaaagctaacagggtggagtatcatagccaggacaggaaaattcccagcagggaaacggcctgtctgtaatgcagacacattgggtcataggtttgctttcacagaataagtgaaatggaacaaaagtcttttttgaattctcattccaagaggcccagtttctgcaggtgtgtcttttcgatcttaccttgtattcagtattatttcaagcaatctccattttaggcagtgtctactccagaccaaaaaacctggctaagaaagaaattttgttgattttgagacagggtctttctctgtcgcccaggctggagtgcagtggtgtggtctcagctcactgcagcttcaacctcctgggcttcagcgatcctcccacctcagcctccctagcagctgagaccacagatgcctgccaccacacccggtgaatctttaaattatttgtagagacagggtttccctgtgttgccccaggctggtctcaaaccactcctgggctcaagtgatccccctgcgtcgacctcccaaagt

SEQ ID NO: 126537 - DNA, 1054 bp, Homo sapiens
ggcaacatagtgagtgagaccctgtcttgacaaaaaattaaagaattagccaagtgtggtgacatgtgcctgtagtctcagccacttgggaggctgaggcaggaggattgcttgcacccaggagctcgaggctgcagtgagccgtgatcatgccactgcactccagcctgagcaagagcgagactccgtctcaaaaaaacaaaaaccgaaaaaaccacctcactattctaggcccgagcccgagcttaaatatttaccccatatccaaccataagttaatcccgcacacaccttcatcagtttcttaaagaaactggtgccccagcacggggcatgccaacgtattagacaggcaacaacttagacatggggatgaaatgaattccatcttaaatctcaaagtgcacaatacagtctctaaaattaaagaaaagaaagatttatttccaaaaaagcccacagtgaaataattgtctcagtctgtggagagagctaatttggacagaatcacatattttgattcctgggatttttttaaaaggaatcttttaaagcagtaaatgaaatatttttggatgtagacaaaaatgacttacttagccattccactggcaatgtggaaaggatgaagaccaattttgagttagcaaggacaccttcagaaagttcagctcccaggaattgttgaccctagccatccatgtctgtatttcctgaggactattgcttacggaattaattgggactaatttctgttgcacctgatctccagccaaaacactcacattttgcctcatctgcagagacctgggctgagttttatctctgcgtcactgccgagttccctgcccccgctctgttaacagagctataattaactcacaggacgccaggcagccagattcggccaggcgccaagaaatcagccccaattactatattcacattgtcagtaatgcccacttcacagcttctgctaatttgaaatggcaagttccaactttccatagtaaaattaccatttttgtcctattctattacgtggtgatatttg

SEQ ID NO: 126538 - DNA, 1049 bp, Homo sapiens
aaagtcgagcctttaaaataagggctagccttggaacgttgcctgctttgtagatttccagtgttcaagttgtctgatttctttataaagatggagaagtgtctctgtccctctgggtctccgagttcccttgagtctgggcctctgtatctggatcccctcaagccctactttgttgtaagagccaaattagccaggggctactggttggtggctctgctgggggggcatcacagagtctctcttctctgacatttgctgaccttcaacccgccctggtacaggagcaccccattgaggtcctccgttttccagagtcctgtccctgaggaatcacctgcctgagtccctgagcttgggactggctggcctgattgggttgtacattttgttctcttttcagcagagaaatctcaggaggcaccatgccaggccactgtgcccctgcaagtgtgtctgagtatggcccaggaccctgcccatcactggtctgcaacaagataagcacagaagttcagagtaggtgtctagaaatgttcatagcaatttaacgtgacggtgacatccaagtggcattttaattttattttataaagatctgagtccacaatgggctggaaatgtaaaaatctgttgtgtgttcttctcccacagattgtttgacaaacattggtcattattattattattattattttgagacagagtctcactctgtcgcccaggctggagtgcagtagtgcgatctcagctcactgcaagctccacctcctgggttcacgccattctcctgcctcagcctcccgagtagctgggactacaggcgcccgccaccacgcctggctaattttttgtattttcagtagagacgggtttcaccgtgttagccaggatagtctcgatctcctgacctcgtgatccgcccgcctaggcctcccaaaatgccgggattacaggtataagccaccgcacccagccaaacattggtcattatttaatctcctcatctctgattggatttcactgtgatcatttactgtggctaaggc

SEQ ID NO: 126539 - DNA, 1244 bp, Homo sapiens
gcatcacaggacctggggacttgttagaattgcagattctgaccaggcgtagtggctcacacctataatcccaatactttgagaggccaaggtggaaggattgtttgaggagttcaagaccagcctgggcaacatagcgagaccccgtctctacaaaaaaaaatacaaaaattagctaggcgtggtagcatatgcctgtattcccagctactcagtagacttgaggattgcttgagacctggaaggttggagctgcagtgagccgtgattgcgccactgcactccagcctgggtgacagagcgagaccctgtttcagtaataaataaattaaaagtacagattctcgggtctactccagacctgctgaatcagaaaatacgcgggcaggcccagccgcctgtgccttcaccagctctcctggttaaggcctgagaaccctgctacggaaccccgagtacctttcagaacatgttgacctcattcgcagggatcagtggccctttgtcatctggtctctggccagtgtccctccctcatctggtggacttggtactgatgccgaaccacctgtgggttccaaacgtgccattgtttctcccacccacgcatttgcacaaatgtggtcctgtgtggctcactcccttttctgccgccaccttctcccccactgcgccatgctggtctcagctcggggcttacctggtcccagaggtgtgttgggaggtccccaccccttgcctctgcccgttgccttttccacccctgcactgggtgtgcataggtgcgcagggcacgtgtgtgtcctctgcggtcactgacttgattgtctgcctttcccaggaggacatgggctctgtcgggacattttatccgtctgtttacaacatgaaatagacacctccgaaatgtgtgtgtgttccgtaaatgaaggagcagagggaccccttcggagcatctcagaggccaggaagcctggcttctggccgccctgcccgctcctcacgtgtgaggggaactggggaagtcgagtcagcccgctggggttcctgattctctgcggttctgggaagagcttgcagtggaaggcctcccagccatttcctcttctcccccaactgtgactcactgattgattaatgtttggaaattgtgactcatcttgttagagaaggaaaaggaaattttattctcttcattctccctccctttcaaataagtaataaataaaaagtggctgatcttc

SEQ ID NO: 126540 - DNA, 1061 bp, Homo sapiens
ggctcacgcctataatcccagcactttgggaggccgaagcgggcagtgcgggttgagtgcgggagtttgagaccagccagagcaacatagcgagaccctgtctctacacaaaatacaaattgtttgctgggcatggtggtgtgcaccagtagtcccagctatctgggaggccaaggcgggaggatcgcttgagccagggaggtcgaggttgtggtgggctgtgatcacaccactgcattccagcctaggtgacacagtgagaccctgtctcaaacagaaaaaaagaaatgtggccaaagctttatgaacaataatgttaattatagtgttattgatatactaaaaacaggtgggagggaacaaggctagtgtccaatatagaggaacggctaaatgatgctaaaaatcattcattcaaattattatgtaactgatattgtttcccaagaatatttactaacacagaaaagatcatgatatcacctaaagtaagaattaaagatgctgtatcaccctagtttaatgaaagaaaaatgttcaaaaatataaagacaagatgaatatatagacatacagcacaatagatgcaaatacctgcacatcacacaagggctggtgaacatgaggacactggattcttccaggcctttttctaagtcttagcagggattatttttggttggtgtgagattggcttttttctttgttatgcttttctgtgttttgcagattttctccatagagaatgttacttttttttaggcagggaacggtggctcacgcctgtaatcccagcactttgggaggctgaggcaggcagatcacctgaggtcaggagttcgagaccagcctggccaacttggtgaaacaccgtctctactaaaaatacaataaaaattatagccaggtgtggtggcaggcgcctgtagtcctagctagtagggaggctgaggcaggagaatcatttgaacctgggaggtggaggttgcagtgagctgagatcacgccactgcactccagcctgggcaacagagtgagattccatctcttaaaaaataaaa

SEQ ID NO: 126541 - DNA, 1447 bp, Homo sapiens
tgtgtgtgtgcaagagagcgtggctaagacaagggtattcacctggcatcctcattcccaagttgccaatactcctctccccttttttcttaactcaccacctgggaagttttcctatttctctccctcctatcccagataagaagaattgccttctttcctcccagctgatttgcttttctcgtcattatatggcaaaccaggctgcactcccctcctaaggcaggcggtggttctctttgggctctgagtcctcagtgttctgcctcttcgggtgccaaccaggaaagccgccttccgcttttagagcaacgtgaagaaatcatggcagcccacgtaagatctctcattatttctgttgaaactgattctatcgagggtggagtgcattgcctttaatttctttgtttgcgtgtattttttttcccctctctctcacaagaagtatattcttttctttcctgtttgttcctgctcgatttggggaggctgctgtttccactgcctaattaatgggaaggtgttctgcggaggatttcaccgcgtacatattctctgtttggacatggtacaacctgtggacccttttaaacatagttacatgtttgactctttatagggtaataactcgattaattttgcaaggctttttagaataccattgttctcttgaaaagaacaggtttgctgttttaacaagactttaatgccatcgagatgcctcacattggcacggttgcgtaagaatcgcacggtcccatgaaatgaaattgagagagctttttccggcgcctggttggttggggcggcctccgttcggtgcttttttcatcctcgacccagtgaccaactgtgtttgccctgatgtttctttcaattccaccattccgaaatgtctccggaatctgtcgttttagcttttgcagcaaggttcgttgtgtttgtcttgcccgcttcaggtttctctaatgagattcacgtgtaaaggaggattggcaattaatcggatgactgattaattgtgagattcttattcttaccaaggaatgctatggaagtcctggcttcagataaaattctcaatgagggccagttgcagtggctcacgcctgtaagcccagcacttgaggaggccgaggtgggaggatcacttgagctcaggagtctgagaccagcctgggcaatatgacaagaccccatctctgcccaaaaagaaaaaattagctgggcatggtggcacacacttgtgatcccagatacagctacttcggaggctgaggtgggagaatctattgagcctgggaggttgaggctgcagtgagcagagatggcaccactgcactccagcctggacaacagagcaagaccccgtctcaaaaaagcaaattctcaaagaggccttaatataccttttttaatcataagctttaagagcctggtcatgcaa

SEQ ID NO: 126542 - DNA, 1347 bp, Homo sapiens
tttttaaacgtgttcactgcctccttatcatttgttccactgtggttttggccagcctgaaccccactttttccagtttatgaccacaaagaaggattgtgcgggtgtgcatgaggaccagtaagtggcagagtctgcattttctggtgctgtccagacagcaaagagtgctgtgttctagaaagacagtaaatcgtatcatgtccttgctaaccgacgatggagaattctgtgggtcagaattgagcatcttttttgagacagagtctctctctgttacccaggctggagtgtaatggcatgatcttggctcacttgcagcctcaaccacccgggttgaggtggggagcctcccaatgtgctgggactataggcgtgagccgccgtgcctggccagaattgaacatctttgtatctttcttcttagtttagtacaaaactgaataatatttgcaggcagcagaattggatcgggaatttctcaaactgccaaagatgaaattagaatgagtgatttttggctggcagcttgaagtacatatatatcagtttgtgtatgatacgtgtgagtatgtagtggtttttccctcttcaactgtctttaaatatgtgtgcgtgcgtgagtgtgtgtacaaacacacgtagctttaatatcaaaaaggttatttttgtaggtctgttaggagacatgaatatgctcaaaagggaaaaaaatacatggatagggtgagaggagtttgctttatttaaggacatgataaaaggcatagcccttctgcctttctggaatgctgtaacagaatatagaaataattgtatcatctcctgtacttctcagagctggtgtttgcgtgaggctggccctgtgccaggttggcagggttgggggtaacccaggagcatgcctgctaaggcacactgccattcagggcctggccttgcccctgcgccccagccccctgctctcctccatccagctctgccctcttccatttctctgctacagtctgaaatctctcagccacaccagctttctcattccatgacctcatctgacttgtctccttcccctctgaatctgagcccttgttaagcctttttttgttttttctttgagacagagtctcactctgtcacccaggctagagggcattggtgcagtctcagctcactgcagcctctgcctccgcggtttaagcgatcctcccacctcagcctcctgagtaacctggactacaggcatgcaccaccacgcccagcttatttttatattttgagtagagatggggtttcgtcatgctggccaggctggtctcaaactcctgacctcaggtgatccacttgcct

SEQ ID NO: 126543 - DNA, 1051 bp, Homo sapiens
tggtcccagccactcaagaggctgaggcgggaggatcgcttgaacccaggaggtcaagcctgcagtgagccatgattgtgacactgcactcagtctgagtgacagagcaagatccagtctttaacaacaacagaaaaagttaattggcaaagacttcttttttttttttttgagatggagtctcgctctgtcgcccaggctggagtgcagtgcacgatctcggctcactgcaagctctgcctcccgggttcacgccattctcctgcctcagcctcccgaatagctgggactacaggagcccgccaccacgcccaactaattttttttttttttttttttttttttttttttaagtagagacgggatttcaccgtgttagccaggatggtctcgatctcctgacctcatgatccacccccctcagcctcccaaagtgctgggattacaggcgtgagccaccgcacccagccaattggcaaagactttctaaaagtgtcctttggctttaaaaacactgcagatagaccagggaagaagaattgtccatgggaatgatccagaaagcatctgtgatgatgtgtgaagagccagaggtagaggcatgggctgtgagggcggcggtgcctaagacctccgagcacacctccctgtagtgtgggcatgggggtactcaagccctcaggccagcatagcttccttgctgaaatttgggggcacgaggtgacaggcagctggggaagccagaccccgcttctttctggctttgcagagagtggtgagcctttaggactagaagggacaactctgtcctgctagagagcgaggcattgggcttactagggctggaactgctgtgagggaaggtattaccttcccttgtaggaagcatttcttgccagaatcacgccagtattgcagtaaaaggtaacctgcaaatctgcacattgagttttcatagatacgctaccctaaaggggagtatcctggttttttttttttttccccttcattgtcctctggtatctaattttgatagatccactctctggtt

SEQ ID NO: 126544 - DNA, 1047 bp, Homo sapiens
gcagcgccagggaccccttaactgatcccctctctcctcccaccagccaggggagctggggaagggcatagtacatccctagcatcaggggagcgcagggaaagaattgtcgaggaagccttcctaaagagggtggtatgggattcgggattggaagatgagtcaagtcaggttttgcagaggtttgtgaagatgcaagcctggcgaagcctgtcttggggaggacctgccagaggttccgaacgatttgcctgtggggtaggatggggcagcctggtggggcatttcccacatcagaaacggtctggacactgacaaaggcagcctaggaccaaccacgtaatgtaatagttcccagagtaagtcatcccccaaaaatgcagagaatggcctgagagaattggatcttggctactttcttttaactttggaggccatgggctcattctgagacctcccccactgcctttgcctccccttttattttccaggacagatttgtcactattccgtctgcttcaagtccaacctacatgtattttattagaccagacacgttttcattcatgtttgtgaatataagccccttggggcaaatcttttcacatatggtcttacagcatttcaaaaacaatttattttccctcttctgaaggagggattcttagggccaggcgcggtggctcacacctgtaatcccagcactttgggagcctgaggcgggcggctcacttgagcccaggagttcaagaccagcctgggcaacatggcaaaagcctgtctctacaaaaaatacaaaaattatcctggcatggtagctcctaactgtagtcctggatacttatgagtctgaagtgggaggatcgcttgagcccaggaggtcgaggctgcagtgagcctaattataccactgcactgcgacctgggtgacagagcaagaccctgtctaaaaaaaaagggattcttaaatatttgttgacgggaattggagaggcatgaaggaagatgggttttggagaaagactgacttgggattgattcactagg

SEQ ID NO: 126545 - DNA, 1053 bp, Homo sapiens
gatggagggaggcagggctccaggcctggtggccccgggagcgggtgagtggccggccccgcagtgagacccccgctctgccccttctaggatgcggccaagcccctggaggtgctgttgctggagaagaaccgctcgctgcagtccgagaacgccgcgctgcgcatctccaacagcgacctgagcggtaggttggccgggcttcgcgcgtgtgcggtggttggttcgcttccaggggtcggtcgaggacgaggaaggtgaatcgtgagtctggacagatgcatggccagagaagcgccggttgacgagaacctttgactaacgcgtgttgggtgccctcctcctcaccgctcctcccttcccttccccgccctgcttaaagctggatgtcgagacgggccagccgcacaggctctgcggaggtcagttaggggcagtgcggctggaatccccgggagggacagctcggaggacgtcggcctttctgatctgtgtctggttgtgctgcacagaggccaggggcagtgtgaacccagcctcgctctggtggtgttttcagggacagccccgggcctgccgggtccagtagaggtttttcttccttggtcaggtttcccctggggacgcgtcccccatccttagcctttcttggctcatcccccaaatggtggcgtcacttgactgtgcttctggtttgggcagctggtaaaacgcgtacaggtgtctcgggctctaatggtattgcattctcaaaacgggcgcgcgcctccacatcgagggggctcggtacggtgcatcgcctcagagcaagaggtgcgagcgaatccattggtcctaaaatgtcagtgtttgctgctcctccggccggggccagcgggcccagtaagaggcccgcgacccgtcaactcttccctgtgtgtgtcaccagctccttgtcacgctaggagtttgagtctatgtcaaggggactctccaggctgcaacgtacaagaaaggcgcaaacatgaatgcatgttgcttgttttgggaagcctcgtttggctgacttacaaa

SEQ ID NO: 126546 - DNA, 1051 bp, Homo sapiens
ggcgactagaaatgaggatgagtatttcaagtcccttgagatttctagttcagtgttgtaaaaataccatttgagaacattgaaatagacattcgtgctcatgccttaaatttagcagagacttaataacattgaacttgtttggcccgtgagtgcagttttattctggaacttgagaacttttcaaaagagtgatcggatgcagcccctaaatatcccagggcggcatctgtgtcctgtggggggtgtttgtgcctatacatatgtatggccatatgggagcgtcagaaaactcgggtgtgtacacgcaactcggcaatcatctgcggcggaatgtcactcccaggccggctccccaggtcccaccagctcacctctgggcccccacctttgatcaggatgtggtcagaacaagcagacctttctaaatgctggcctggctcagcgtttgcagaggacaccagcttcgccagtcccaccggcacccactgccccacctctggagggatcttgtccctggaaccttagcctttcccggtgccaccaagtgaagagcaaggtgcttgtacacacctcctccgcggggtgtcagggtgacagccctgccatcttggcaggatcaagaccctgggatgagaccctcttccctccctgggagctgagagctgtggctgtaaccatggctcacccgaaagtccccctgtgccggggtctcagccaccgttgatctttaaatgcatattccctgcccacaagctgtcaccgccaccaggccgtggttctgtgctcagaagtcagccctagacgcgccctctgcgtggtgggtgtgcattgcagcagcatctgtggtgtcatgctaatagccaggcactgatggcctgtgtgttcggtgccactccaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggc

SEQ ID NO: 126547 - DNA, 1417 bp, Homo sapiens
tttagtagagacagggttttgccgtgttagcagggctggcctcaaactcctgacctcaagcgatctgcccacctcggcctcccaaatgttgggattacaggcgtgagccaccgtgcccggctcccctgctcattcacacttaatgtgccaggccacgaccacctcccctctcccctctcccctaacctcctccctccttccacccgcccttccatacgtgtctgtctgtatagtcattggaatttcctggcttggcatgggctcaaagccgaaaccatggacagaatgaaaagtggcgcatcagaccagccgccagttaaataatgtttgggttcttgtcagaatgtcacggagtaccctgtcattttgtttcagcaacttgtccttctgaatgcacagttcgccttatggcatgccagcagtaaaaatgtcacttacaataattactttttggtgaaaatgcttgctgacttcccaccttcaagctgttttttacacagtggggagataataagaaacgactttatcctgactgctcaaatgaacactaaatggaatttgggttcttattactgcagatagagggccgggtatggaaatttcaacagtagatcggaagaactgcagagagatgtatctccgagaattacggcgggtgcgggttttcaattggctcccattgaaaacttaaggcagctgttgtttgcctgctgtttttggaatataatatttttcataatccttttatagttcgtgaatgccttgtgtatctcagagggccttgagtcactatctctgctttctgtagcttgctcaccaagctcctcttatgccagattcagtgccttgtaaaaaaaaaaaaaaaaaaaaaaaattaattcacatagatgactttttaaatgtaacaccttactattgctgtcaaaactggatggatggtactgtgcagtggggcttttaaaatatgcaaattacccattttcaattgtcctggtcctgcaggctgcagggtccttggaagcgaggtttttgtctgatttctcccttatccccaagacacagagtaggtgctttaaaaatatgtgagtaggctggatgcggtgactcatgcctgtaatcccagcactttgggaggcagaggtgggtggttcgctggagcccaggagttcgagaccagtctgggcaacatagcaagaccccatctctctacaaaatatacaaaaattagccaggcgtggtggcacacacctgtggtcccagctactttgggtcatacattggcaaggaggctaaagtgggagggtctctgaagcccaggaggtcgagactgcagtgaaccatgatcacaccactgcattccagctggagcaacagagcaagacctcgtctcaaaaaaaattaaaatgagagtgaaatg

SEQ ID NO: 126548 - DNA, 1015 bp, Homo sapiens
ggttgcagtctgcggagattgagccactgcactccacctgggcagcaacagggaaattctgtctcaaaaaataaaaattaaaataagtgcccgcggcaatttgttgcagtggagaataggggagtggtgtcccagccctgggatggctcctggccaggcccggaggggtgggtggtgactctggagaggggctgccccgtggcccgagggtcgctggaggggcacggaggggcctccaggctggacggagcaggagccccagagagaggggtctggctggggtagcaccagaggccctttccccagcagcacccccctcacgtccccgccgcttgttgtcttgtaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggccgcggccctggggcgggcagccaggctgggccg

SEQ ID NO: 126549 - DNA, 2189 bp, Homo sapiens
ctatgtcgtgttttcaaggaagaaaacggaaatgtgtggtcgagcttttttgtaccctgaagtgttttttttattgccctaagtgatttccacaggttctggaataactcttacagctttgccttgtgtcctcctgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggacaaaaaaaagaaaaaaaaagaaaaaaaaaaaagaaaagatccgaatctaggtattttataatctgctttttaacctctaaccgcagagcacgctgatcagacctcatatcttggaggtttaggagacaagttagaactgtagcatgtacctgttaattttgtttaatttatggtgtctcaatctgtctgtgcgtctgcacgtgtgcaagcattgaaagaaaggagagagtagtccgggcgagcacagcaggcagttccagggccagacgggcccatccccaagtagatagcagtctacggatctctctctggcacagaaggcacctcacctcacaccactctcctggatacctgatgaactgagccctcccaggggaagacactccccaggcctgggcagggcttacacgcgcactctctctcttctttccctttttcttcccaccgcaagcactgatgaccctgttgaactcgtgggaaacttcctttctctgcaggagagagaacgtggcattctgggctccccactcccatccctgtagaaatggcccaaactcacaccaaaacgtggatgctcttcaacttccaaacctaccatttgcccttctttcatttcgcctcttagttctttttatgcacagttttagggcagtctaagtacaaactgaaagtctaacttgtctctgattcctcccttgtctatgtgtatatgcgtgagaatagaggcgggtgagagtgtgcgtgcgtgtgcgtgtgtgcaattttatacgtctgtgtattttcttaagtacctgtgcacacgtagagtgcattactgccacctttttcaataagctgttttatcagttacggcttctacaagtttgctaatttagacttctttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagatgtagttgtcatactgtatattactgattgaaaactttttgaccgtattgtgtatcattgaaacctttgtcttaggtcaacatctttggatgacattttaatggtgcattcattatttcttaagtttaattaatattacttttttttttatttggggggtgggagggagttataattttaaaggtatgctctggctgttccacctccgtgtgcttgttaattaacttgtaggactttgactgtaagatgtgaaaccacgtttcttgcatgatgttttagagattatttcatttacagtcttttaacctgcagctgcagcacttagttcacgttttcacaaatttcaagagtcactacactaaagacaatgccttttcatgaataagaagttttcagaaggctctagggggctgggaggcaggctgttcgtttgtcttttgttgggggtatcatttctgaacttgaaatccagttcagggagaagagaattcaaaattagaggagcttaaggggac

SEQ ID NO: 126550 - DNA, 1061 bp, Homo sapiens
gctgccactaaaataatacagcaatccgtggccaggggagcaccccctcctggttgggcccctcagttggagtctaagggttaatctctcatcttgctaagcagtattcaagtgccttgaacagtgtcccctcggcatggctccccttcagcaggctggcattccaagcagtggcccccgcaggcagccgacccccttcctcttcacgctctatgagtttaaaaagctgatttgtacctctcccctgggggaaacggttccatataaaacactaacacttaattacaagctccattatgccattttaaatggcttctttttgttaattggaggcattgttcataacttaaggcttttgccattaacttagctggctaagcagaggctcggggtaaaatcagtgtttgcatttagcctcttgacccggagttccggcccaagctcccttgtgatagccgagatggcaggtgtgtgagttctgtcctagacctgtgcccaactcacttccaccccagaggagtcttctgtcctcctccccaacccccgagctccctggtaacctcctcttgaacttctgtatcagtgaagacatctgtggtttctgctcaccagacctctctttagaaagggttatcagagccatggagcttagctcaattggattcttctagacgatcttaggaggcatcttggcatgaggcagcttctaagcgtctcctgggacaggattggggtgacagcccagggatgcatgcatgggagaactctctgagaaatgccaggatcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagccc

SEQ ID NO: 126551 - DNA, 1010 bp, Homo sapiens
cctctggagcagctgcgcccccgccccctgctagggccccggccgggtagtggggcgagagcagccgggtccttagaggaggggtctctggttgggggaaggggtgcccaggtctcttccctacgctgggagcgctgggagggggcgtcaacctagaatgagggtgagggccacgggatgggatcggggaggacctcctccaggccacaggcacgccctccctttggcccaggcccccctttctcgacctgcccagccggggagctccccggagcccccgattgccgggaggatcgtggagggtgcccaagaggccggcgcctttaagaaggggcgggttcgtgccctccattcaggcccttgggcctcggccattgatgaacctgcgggctgcgcgggccggaaccgcgccagcccagcgggctgaagccgggcagaggcagggacgcatcctggccccctgcagccccgaagtgggggccttcagggagggaagtctgcagtgactggagcctctcaggagccacgcaaggcagaccgggcagccccaggcgagactctgaacacgaataagccaggatctacgtgcacttcgagctagtgcaagggagagcctcaggctaggctgtcagacctgggtggagccctaccaatgcccccgagccaacatcacctaccctgtaaaatgggatggtgctgcctgcctcctggctaagggaccggcaactcccggcaggaattgcgtcccagagtcaggtccctggagctcctctgggaggactgggggcagggggtgtggtttccccaagaggttttgactgcctcttgagctgaagcccccactactgtgtcccaccttgaactctcccaacctcttccctcctggcctccccactccacgcaggaagaggttgggagagtgacctagaacttttcagctccaggagctttgggagaggtctggtggtggcggtggtggcacttcttttaggctagtgtggatcagggca

SEQ ID NO: 126552 - DNA, 1054 bp, Homo sapiens
ctccagcctgggtgacagagcaagagcctgtcccaaaaaagaagtggtttgtatgccacttatcttgccttctcagtttccttatttttcattttgtgagagtaagcaagcttttccagttatctgctggaaagaaatgggagtaatgtggtaataccgagttgcgccccaaggtggctttggtgcgccgtgggtcctggatggactcagaggcacagatcactcaagctattttggctcttctcctaaaaagcaggaggggcagctggctgggtgttctgttgttggagaggacatctcaccgcttgttttctgtgctgatccagtagctcagggaagactcccggcagtgtgggacttgtgtctgaaatgacagcataggatgacattaagccaatgtggattattctgcagccttgaactccccagatgatgtattcccacaccactcttacttatcctaacataggcctgcccatcaaagaaatccagggcgcccttaggggatttgttactaggtacatctagagcagagcttctccacagttgcactactgatgcctcaggctggaaaatgctgtgtcctgaggggctgtgtcttggtcactgcagggtgtctcgtggcatcctagtgtctaccctcccgaggccaggagcacccaccttcccccagtcatcagcaattggatgtctccagacacgaccagatgcaccccagtgggggaggaggacggaattgttcctgtctgagagctcctgatctaggggcaggtatccagtgtccagaaggcactcagcatgtgtttggatcaaactgtttctttcagagccaaaatccttcaacataatatgttggaaaactacccacgtcctttgtgtctttggaaaaagagatactctatgatcattttagaaatttttaaaatatgcagaaaagaacaacatcaaaaataaaagttggctgggcacagtggctcatgcctgtactcccaacactttgggaagctgaggctggaggatcatttgaggccaggaatttgagaccagtgtgggc

SEQ ID NO: 126553 - DNA, 1054 bp, Homo sapiens; identical to SEQ ID NO: 126552

SEQ ID NO: 126554 - DNA, 1555 bp, Homo sapiens
ctctgcctctgcctttccaactctcacttgtcctcctgctcccgcgtgaagagggggaggggaggagttgggaacacgtcctcatgctcggcttctggctggcagtcatgatgggggacagggaacctgtgctgctcacaggtgtcaggaggggcttcctgggccatgcttgggaggagctgggaagctggcgtatgtgtggggggcagagccctctgccacacaggtttcggaaatccttttgcagacggcagtgagaacttgagacttcagtgagagtgttgtcagcctggcgttagtgttgaagagctgggtcgggaagttgcccacccaagaggcaacttgagccatgtaaaagtagtgcgtggtttatggggtgtcgggtcttgcgtgtgcctctgggcctttgggtaaagatggggtgcacccgtgagagcagtggtagatcaggtctgtgagccacccttactcctggggaatggctcagaggactggtggacgtgaggcatgaccctggtttcttgccatgcggtctaggaacagggacttttgacttcccatcagctctcctctttgaaagcacccttgaccctgaacgattttgcatgtctgtaatttgaatgtcgtgtggttacaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgtggacctggtcccaggctcagtgaggagatggcctcagctgtggggctggtccatgttgcccactcactccagtgggaagtggggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggctgagaga

SEQ ID NO: 126555 - DNA, 1068 bp, Homo sapiens
agagcgagaccctgtctcttaaaaaacgatgatgatgaacacagaggacggggcactgtgctgggagccagggggcctgggaggagccgagaccagccttttacctcggggttttgaggccaacagggacgacagagacagtttctagttagagccttggctccatttttggatgatttagccccgagttcctgagtctattttatgccccttacgtactttgatagaactaaggaaatagtggttttgagtgaagggaaaggaaacccagaaacattttacgttgcttttacttctgtagtgtagattgccccggcccctctctgagccctgtagcatctgtgatagcttctgtcccttcatcggttcatgtcacagggattttctttcccaggaagcggacacggagagtcagccctaataaatgagcacatgccctggctgtacattttgaaacctgtttttctctgtctgggactggctggtttgtgtttcggttttagttctcctatctttggactgttggtttccatccctctccccacccccacatgtgtcacagcccctgccctgagtctgcaacctggagcttgtgggccgcctcagtgctggggagggtgctggggcttggagcctgatgacctggctttgaatcctgcccctgcctctggtaagccaggggactgtcagcaagtcccttcctgcctctgccagctcactgggccaagagagacagtcgccacaggtgtgtgttgggtgggtgggcacatggcgacacagcaggatgccaggttgcggtgggcttcacccccacggggtgcaggagatgatatttaggcaggacatgtcctgtagccatttctggccattagtactaggtcatcaggaccttaagttgagagattctttcttcagggcatcacttatttaggaaaagaagaacaaacagatgtcatcattgagaaaggattgggtgatactgagagcccctgccctccccccgacaaaaaaaaccaccattaggggagaatcatgaagtaatgtccctcattgctcatgggtgggaag

SEQ ID NO: 126556 - DNA, 1057 bp, Homo sapiens
gtctcgctgtgttgcccagcctgtggacttgtgtttcttttgcagaaaacataccgtttcatttactgctccgacaccggctgggccgtgggcacagaggagtctgactttgagggctgggccttccccttcccaggagtgatgctgatcgaggactttgtgacccgggaggaagaagccgagttggtgcggctcatggaccgtgacccctggaagctctcccagtctggacggaggaagcaggtagaccggccctgagctcatgggggttgctgggctgcgctgaggagacagccctactgctgggggccatccccctccttgcagccacacccctcaaacctccagggttggtagtgggcgagttccccagaccttggggctgtgggcagccagactcgctgcaggacgtgtgtccgatgggcagaggtgcacctgggcaccccatctccctgtgatatgcgctcctgggctctctgcccctctgtagctggcttggtggtggtgaaggcaccccattctcccaagctgcaggcgcccccacctcccattgtcaccatccgtgtcctgtctcctcacacgcattcccaccttccccctccccgggcccgccgctccctccaactccttccccacctgtgtccaaacatccccgggtgccccctctcccttcattgtaggttttttttttttttttttttgagacagagtctcgctctgccacccaggctggagtacagtggcatgacctgaactcactgcaacctctgcttcccgggttcaagccattcttctggctcagcctcccaagtagctgggactacaggtgcccaccaccatgcccagctaattcttgtactgttagtggagacggggtttcaccatgttgaccaggctggtctcgaactcctgacaagtgatccgcccgcctcagcctcccaaagtgctgggattacaggcgtgagccaccgcgcccagccccattcttttgtgacatcctgttggatgttggtacatttcatttcctcattcatctgtcgatggacattggcgttgt

SEQ ID NO: 126557 - DNA, 1035 bp, Homo sapiens
ccgggctacccgcgtgttcacaccaatagctctgccccagtgactgtttactctaacccccgcccaggagttcttttctgtggcctggaccgctctgatggtggtcacacaggctggccacaagaagcgctggagtgtgctggcggctgcaggcctacggggcctggtccggctgctgcacgtgcgtgccggcttctgctgcggggtcatccgagcccacaagaaggccatcgccaccctgtgcttcagccccgcccacgagacccatctcttcagtaagcccctccccttcacccctgggacccccaagcacccctgtcctgctgccccagtagcctccacgctcccctccctgggatggctgtgagctcgggcgcctgccgggccccagtctgcaccgctccgactctagctttggcaggaagccatgtcgcttcaaccctggctttatccacagcctgctctgtggcctcggagttttccaacagcctgggccactctgtcccctgtcagtgacctggggggatgcccctgcccccgggtgtggcgcccctgtcaagggggatggatgagccacaggaagtggccgctggagccaccgcatcaggttagatggaggaaacagggattgggggcccaggagtgttcctgtctcctagcctcggcccgccctccccgcctcggaggggctggccttgggaccgtgggctcagcctgggatgcagccagcaggagggagcagggtcatctcagggccacttctcccctaccccaccccctcttcagcggcctcctatgacaagcggatcatcctctgggacatcggggtgcccaaccaggactacgaattccaggccaggtgatgcttcgggtgaggctggggagtggccagctgctggggcagggacacctcggtctgggtctgatgctctgttcccccttgcccactggcagccagctgctcacactggacaccacctctatccccctgcgcctctgccctgtcgcctcctgcccggacgcccgcctgctggc

SEQ ID NO: 126558 - DNA, 1169 bp, Homo sapiens
gctggcatttgtgaatgaggacatcgtgggtgagtgagctcagcttgtgggacagcctggcctccgggcacacagatggaccgcttgtccctgggctaggcttctgaggatctctagtgggagaaggtgtctgggaggggccaccctgcacagctctcccttctcccccacagcctccaaggggagcggcctgggcaccatctgcctgtggagctggaggcagacgtgggggggccggggcagccagtccacggtggcagtggtggtcctggcgcggctgcaatggtcgtccaccgagttggcctacttctcgctcagcgcctgccctggtgagcctgcccccctgcccgccccatcccgcgggcttccgggagctctgcccccactcagactccacctctgtcccggcagataaggggattgtgctctgtggggatgaggagggcaacgtgtggctctacgacgtcagcaacatcctgaagcagccacccctgctgccggcagccctgcaggcccccacacaggtactgcccggctcaccctgcccaggcttgggctggcaaggcatcaggggccctgcctttggtcagcaggagcccagcccagccctcccctctctccccaccagatcctgaagtggccccagccctgggcccttggccaggtggtgaccaagaccatggtgaacacagtggtggccaatgcctccttcacctacctcaccgccctgacggactccaacatcgtagccatctgggggaggatgtagcctcacaccatcgcaaaggaccagggacacagctaactaacttattcagctttgggccgatgggggtgggggggggtctttcagtgaatatttttattaaactctactgtggacaagaagcctgtggaaaggtgtttcgagttatgcaggaagaagtgttcctgctttgactgacaggcaggcccaggagttgaggcttctagagcagagactcttgggagctcatgggtttgcacacttctctccggctcagcacagcccccgcagcagcccctggaccccggatctttggtccagaatgaattcatccctgccagccggacgcccctgaaacaggtcatctgcctgcatcaagcctgacaatccatttgcttgcgaagtcaccgctgctcaagtccac

SEQ ID NO: 126559 - DNA, 1095 bp, Homo sapiens
tcgactcttccagggtttatctctgccctcaaaacccacgaaggtggggtgcggtgactcatgcctgttatcccagctctttgggaggtggaggcaggcagattgttggagatcaggagtttgaaaccagcctggccaacatggcgaaacctcttctctactaaaaatacaaaaattaactgatgtggtggagggtgcctgtaatcccagctactcaggaggctgaggcaggagaattgcttgaacccaggaggtggaagttgcagtgagcttagattgcgccactgcactccagcctggaccgcagaacaagactctgtctcaaaaacaaaacaaaacaaatgcaaagggccttctggtcaacccacagtgggatggggaggaggaggagacacggggagggagaaggtggaaggtgccctggtgggccttggcccagcctcttcacagactgaaagagtcagccctgccatcacccccagagccacctctagcccaggaggcccatgctgggccacccccagccttcccacaaggacaccagaaggtctggcagggagagtggaggctgctggccctcactctgacctcccccacagggagaggcaccgggagctgagcgggggcgcagaggcaggcacggtgcccacgagccctggcaaaggtaggtcttgcccacctgggacttgctcgtggcccgagccccctccagagatgcacgggtggggtcctcgggctcactcccaggggccctcacggctgcctctgcccacagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctg

SEQ ID NO: 126560 - DNA, 1021 bp, Homo sapiens
gaggaagggcagcttctcctaattcactcaaagctgctgggttggtatggtggggaacatggcgtctggcgtggtacaggagctccgggttaggagggcttcctggaggaggtgacgtctgaacaggcctccccctccgtgtcccctgcagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtgggagaggaggcctgggtcccgggctctgcatccgtccactgcgagatcgggcctctggctgaacgatgggaccctgagccctgctgtgcacctgcagggacctaacccaaggaatgctggcccctccaggagctctgggcagaaagggtcccgtggaccaggtggtttgggaaatgccacgtgatgtgtgtgatgcatatgagtgaattcgctgaaggctctaaggaggcccgaaaacacgttagaatcccatttctttttatttcttcttcttctttttttttttttttttcagacacagactttcactctgtcccccagactggagtgcaatggcacgatctcagctcgctgcaatctccacctcccagggtcaagcaattctcctgcctcaacctccccagtagctgggatgaccggcactcgccaccaagcctagctaatttttttgtattttgactagagatggggtttcaccatgttagtcaagctgctcttgttttgttgttgttgttgttgttgttgttgttgttgtttgatactgagtctcgctctatcatccaggctggagtgcagtggtgcaatctcggctcactgcaatctccgtttcccaggctcaagtgattctcctgcctcagcctcccaagtactacaggcgcaagccactgcacccagctaagttttgtattttcagtaaagacggggttttaccatgttggccaggctggtct

SEQ ID NO: 126561 - DNA, 1048 bp, Homo sapiens
ctgcacaattattgtgccagacccctaggttaacagtgaggattcagtgggagaactaaacagataaacagatccagtccccgccctcagagagttacagtttaatgggaaaaagagacattcaccaaagaaggacacagcccactagtgagttacactcgagagggatcatttacagaacaaagcagattataaaaatacagcgattggctgggtgcagtggctcacgcctgtaatcccagcactttgggaggcagagacgggcggatgacttgaggtcaggagttctcaaccagcctggccaaaatggtgaaaccccatctctactaaaaacacaaaaattaaccaggcgtggtggtgggcacctgtaatcctagctacttgggaggctgaggcaggagaatgaatcgcttgaacccaggaggtggaggttgcagtgagccgagaccgcaccattgcactctagcctgggcaacaagagcaaaactccgtctcaaaataaatacatacatacatacatgcatacatacatacagggattaaaatagtctagtactgacacctgaacagacagattgatccaagaaatgaaacagaaattccagaagttgacctgaacacacacacacacacacacacacacacacacacacacacgaaggcgtgaaagactccatgaccctcaaggtataagatgcatttttttttttttttgagacagggtctcactctgtcacccagactggatgcagtggtgcactatcccagctcagttctaccctccatccccccaacctcccccaaccaccctgagctcaagcaattctcatgcctcaaccctcagcctcatgagtaactgggactacaggcgtgcaccaccatgcgcagctaattttttgtatttttagtagagatgggtctaaccatattgcctaggctggtctcgaactcctgagctcaagcgatcctcttgcctcaacctcccaaagtgctcggattacagctgtgagccaccgcacccggccgcattcttctaaatcacagtaca

SEQ ID NO: 126562 - DNA, 1012 bp, Homo sapiens
gcgttgtcccggcaaccagggggcggggctgggcgtggcaccgccccgcgctccgctgccaggggcgggagggaggaatggttgcttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgggaccccggggtttccggcaggtgggcggggactgggcaggggggctccccaggccggggtggtggcttgcgtgtgctcggggtaaaatgaggagccgagctagagggagaggcagtacttgtgtgagtgcagggtgctgcgccgcccccgccgcccctttgctgactatactggtatgaaaacttgccctggctttcctgcctgagctccgcgtcacagcggaggattagatttcttaaaaacctgttgatggcctctcattttaaagcttgctccgggcctttgtgtaactaaagggattctcccgattgtggaagggctgttgaggggcccagagccataggtcaatctctgcttgcaggtgccctggaagaagggacgtcagagggtcagttgtgcgggcgctcggcccggcctcagacgggaggtacctgggag

SEQ ID NO: 126563 - DNA, 1159 bp, Homo sapiens
tgtgcctggaattaccaaaggaagcttttaaaaagtcaacaacttttgagggccagatagaaatttcatattttggccgggcacagtggctcacgcctgtaatcccagaattttgggaggccgaggcgggcggatcgcgaggtcaggagatcgagaccatcgtggctaacatggtgaaaccccgtctctactaaaaatacaaaaaaattagccgggcgtggtggcgggcgcctgtagtcccagctactctggaggctgaggcaggagaatggcgtgaacccaggaggcggagcttgcagtaagctgagattgcgccactgaactccagcctgggagacagcgagactccgtctcaaaaaaaaaaaaaaaaaaaaagtcgtattttttgaggagtcggttccatcctgagcagtagccctactccactgtgcagaaaagtggctgttcagtagaaaaattttggagattctaagatgctcattttcctcccctgccttcagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtatgaagagctattgtgtcaagcttattaacattgaaatagtatttgcaggccacctatcttaagttgatgtgcctcaaagaggaagatttattaaaaactcacatgggcccaagaaagtatattatttttagtcccaaatattccattgcaaaattaacttttgaaaaccatctgttgtttcacttatcaacagattcctgttcatttggttttctgagaagctagcttccccccaccaaatataggaacattgtgattaaaaggagtctgagtaatagtagtggttagttgaatattttgcttacctcagggttaacaaatcatttttttgattcagttatttgttgaaaaatatttctaaaacaacttttaagctgtagtaaatgaagtgaattgaatatatgaaagatgtctcagtgcttcactctgtccagttaggttgatataagaggcaacagatattgagctgaattaagtag

SEQ ID NO: 126564 - DNA, 1025 bp, Homo sapiens
caaacttgtttggatgtgatccaagatgtaccaaaaggtattgaaaattaaatgtaagagtagtcttctagcaatattgcaccattcccaggcagtttccaacgtgcatcagcatgtctgtctccagtggaacaagataacttccagcccctgaacccctggggaaactccttccctctttactgtatgttgttgccactgtaggagaaatctctcctctgcctgactctgcagctgctttacccagaacctcaggaggaactctgagtccagagccaggctgagttcagccaggcaagtctggccttggggctgtatatatctgtctcagacatcgtctgtgttttcatatattttttgactttttaaaagatgacccagaccacaatagtatgttctatttttgttttgttgtgttgtgtttttccattacattgcttagtacagtatttctaggatagaaaatttgctttcttggtctgccttggaacatacctaccaattacaacattgattttccataaaaattgagtttaaagttccaacttgcaaatgaacttttggatagccatccatttgttagtgggaaagtgtgtctgatttaggtattttcttagtaaataaccactaaaatgaatgtttaaatatcgtattttgcttaagtcagggatctcactgtactgtaataaccgtttgggtacaccactgattgataacttaatgcagatagtggaggattaacataaactgtgtgcttgttacatcctcaatgaaaacaaaactaatggtttaaaatgtcctagtgtcaccacaagatggtgcatgtgacgaggaaaaaaaacatgtcttaatatggtttcaaaccaaaatccatatatttgtttaatctgtagttgtactctaactgtatatatatttttttctcatatttaactcccttctacaaagaatagcaacatcagattttaatacaggataccaaatagctattgctgttgctattccctggttgtatacctgccctc

SEQ ID NO: 126565 - DNA, 1356 bp, Homo sapiens
tgtgagttattcaatgtagttttaaaatgttaaaatatacatgaaaaagttttcatatattattaatataaaataatactcattgtttcatatttcaggtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaa

SEQ ID NO: 126566 - DNA, 1441 bp, Homo sapiens
ctcggcctcccaaaatgctgggattacaggcatgagtcaccatgcctggcccctgttaaactttctacctagcaatgtggttagtcttcccatcccactgtatagcagtttcaggatgatgctgcctctctaacttggagtgctgaacaggaagtaagagttggctttacggtaggcagctgccaggctagcataaattctggcataccagaaaatccctttgatccttcctaaatgcttgtcttactttgtgccaaatgactaatgatttaaagcagtggttctcaaccctgcctgtatatcagaaacacccacagaacttttaaaaattatctagagaaactgccccacctgacattttgattcagtagcctctggtgtagtttaaaaagctccacaggggagctctttcctttcgctgctgtggctgcagccttgagtatgctcaggcttcagaagaggcttgcctctagtgtcctctgctgtggcaagaagaatatctggttagaccccaatgagaccaatgaaatcaccaatgccaactcccgtcagcagatccggaagctgatcaaagatgggctgatcatccgcaagcctgtgatggtccattcccccgcttgatgccggaaaaacaccttggcctgccggaagggcaggcatatgggcataggtaagcggaagggtacagccaatgcccgaatgccagagaaggtcacgtggatgaggagaatgaggattctgcaccggctgctcagaagataccgtgaatctaagaagattgatcgccgcatgtatcacagcctgtacctgaaggtgaagaggaatgtgttaaaaaacaagcagattctcatggaacacatccacaagctgaaggcagacaaggcccgcaagaagctcctggctgatcaggctgaggcccgcagatctaagaccaaggaagcacacaagagctatgaagagcacctccaggccaagaaggaggagatcatcaagactttgtccaaggaggaagagaccaagaaataaaagctgcccctttgtgtgtacatactggcctccgtgattacatagatcagccattaaagtaaaataagcctttatctgcttgcaaaaaaaaaaaaaaaaaaaaaaaaacaactccacaggtaattctgatgtacatttgaggtttcagggcttgtacccatgtggactggaaatgatctagggaggatttgcactttgttccttatctgtcacacactggaaatcagatctttcttgaaaacctgttttggccatggaaaaagcagatggggggaacaatatgatagtagagtcacttgggtaagagaggcaagaatactgaaatgctttaggggaaacttatttactcgtgatttatgtagagctggccttgcttgcctattttgccagctcccattgtgggaaatttttcctt

SEQ ID NO: 126567 - DNA, 1029 bp, Homo sapiens
agtttctggccgaaaagccagtcatttgcattttgaacatcgacccatcttcctatcctctctctctttttttttttaaccatttccaaaccctgttgcttttcttgaacaatgaaaacccgagtgtcagttttgtcttgtgtgtaggtagttttacatagtttccctctctttttttttttcctgcttgttttctccataatgaatataaaacatttctaggagaggtagtgaaataaagtcaatttctctctgggtaatgataataattgctcatcttccctgagggaagggcatgtttataaacacgttgctggctttaggacagtggctggtgacagatgtttctaggccaggcagagatctcagtggaaccaaaattcaagaagaaagattcttttatagagacagcctatttaaaatagatttggttttaaaagcaacatttaatatcagattagtaatgtgttttgctttgtctcttccacttcctacccccaaccagtcattatattttggagagaacagattaagaagtacacaggctgctacccaagttgttctgaatgttcctgaaacaagagtaacatgtttagaaagtggactcagagtagcttcggaagactctgggctctcaacatgcacagtaagtgactcaggcaaccttctctaagtgacccttcatttagcgtagcaaattgttgattttaatctttagctttttcgttggctggtggttcaaaaagggtgacagttattttgccttgacagatttccatgagttgtgaaccttttcttccagtggtacttagttacagggtgcatatgtatcctgttgcattgtctgcatcttgttcttgtagcttattattgattatttattttcagtagtattgataataatgaaagaaatatgtttgcagggctactctgccaagtgtttttactgatgtcttatttgataaaaagcaattgtttgtagtgggcatcctcacacctgttttatagttaaggaagtgagagaagtta

SEQ ID NO: 126568 - DNA, 1613 bp, Homo sapiens
ctgggctgaagcccatattagcctcccaaagtgctgggattatataggtgtgagccacggtgcctgaccagttctttgcttcttaacatagcactgtcattgctgtgggaacttgcatagtaaatacttgggtgatacaaaccctctgtacattgctagctaggtattttcagactaatatatataactttgtaattttcatatagaacaatctatattaatatgcaaatttccatagcattttttaagtaggtagagtcattacaaggtgatggcaaatttatactttttccccaaggaaaaaatcttttgtactataggggtttatatgttaaattttaattttgtcctgttaagtatatctgatgtttttctcctaggctaatcatttagtattgagtgatgggtcagtgtcatgatttctgattttggtttaatagattttaatagtgaaagttaagattgctggcacgttttcttatattttattttcaattagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaagtaggtataacagaatttcttggtgtataagggaatttatgaatgttgaaaataaacatttacaaattttcaaaaagtatgtttcagaaagtaattttccccctggtaatctaagtgaaactgtagttagctacattttagtcccacctagctcccaagcacgtgagttcataggtacttcgggaataaaccagtaatggtgtattttttctttgatgtaaaaaaggtgaagttctttgatgtgttgcctgtatcctatttctgactgcattttaggatacagttatggtccaatttgatttcaggtatattatgtgaagatctgttttttttttggtttcctttaaaaattgttttacttcatttacagatctataagtcgtaaggacttagtggattatataaccacacattataaggggccaagaatagtgcttgctgctgctggaggttagtcaatttaaatttctacaaatgttttaaacacagttgttggagtggtatgcttattagtttgatcctgttgggagataccctaagaattttcatttacatagcaaataactgatagtgtgtaaggggaatgtggagcactggaatcagaatttccctctattttttttaaagtaggtttcatttaggccaggcatggtgactcacacctgtaatcccagcactttgggaggccgaggtgggcggatcacgaggtcaggagttcaagaccagcctgactaatatggtgaaaccccatgtctactaaaaatacaaagtagctgggcgtggtgacatgcgcctgtagtcccagctactcgggaggctgaggtaggagaattgcttgaacccaggaggcggaggttacagtgagccaagattgcaccactgcactccagcgtgggcgacagagtgagactgtct

SEQ ID NO: 126569 - DNA, 1015 bp, Homo sapiens
tagatttgtctttactcatagatttctccaaaatacatttcatctaaataatcttaagcttcatatgcaatataactttgaatctttaagcgtatgtagccaagagtcctagaaattgggttgataatagccatctagttttagaagtaggtatagctactacattaattataaggactcattgcttttataacatgaatttctccagggggtgcactgggtaagtgagataataaacacaattcttagtcatactgaattttaactctactactgagatgttgaataaaactaggaaacagcctctaaggatattcactattttccacacactccatttttctttctgtattttggacatgtataattaaaattctcttggaatttttttttccttgcagaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggtgagaaaaatagctttaagtaatttaaattttgcctttaattcgttttaaactagttttttatttatactttatggtgatttatggtaattttaccttttaattaagagacctagataaacagtagttgccatgttttcaaaggttgcagttggtttttcctaagtctcaagatgtgaagctgatttatactatagaatttttttttttttttttttttgagatgaggtcttgctctgttgcccaggctggagtgtagttgtgccatctcggctcactgcagcctccgcctcccaggttcaagccattctcccacctcagcctcccgaatagctgggattacaggcgcaccaccatgcccacgatgcctggctaattttttgtattttttagtagagatggggtttcaccatgttgaccaggctagtcctgaactcctgacctcaggagatc

SEQ ID NO: 126570 - DNA, 1421 bp, Homo sapiens
cagactccaacagatgaggactcatgaagtctcaagatgcttatagcatttctgaaaatgtgatcagcccatttgtataaagcctttgtctgctaatgtgtaattaggcatgtttatgtatcatttttgagaaattaatactggggaaaataatcattttagcttttgcttagcattggaattaaattgtaatcacctgtatgttttgtgtagaagatggcatcatcattcttaggtcattaactcatgaaatacaacattttccaactactactgtttttccacgttttttaggatgcgactctgtacaagtgtcacagaaagtgaggttgcacgagccagaaatcttctgaaaacaaacatgttgttgcagcttgatggtaaaaataaagatataggttctgttttcatatggttgatctgtattccaatagttaatttttccttctctttaaacaggttcaactccaatttgtgaagatattggtaggcaaatgttatgctataatagaaggattcccatccctgagcttgaagcaagaattgatgtaagtagtcctgagttactattgggtcatgtgtaaaaagatccttgttacaaaagctgagaatatgtatctttcatcttgctttagttttaaaaagttccaggtatagactttgtttttactacaaacagctgaatgacagtgtcttccatatttcaggctgtgaatgctgagacaattcgagaagtatgtaccaaatacatttataataggagtccagctattgctgctgttggtaagcctggcttcttttcttctatgcaaaaagttggccaagtacttttaattaactcttctttttaatccttaggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggataaaaagactacccctctgaaggttgttttgtattaatggtcagtctttgttctctgagaaattatgttggaagcagcatactttcaaattattaccatgagtataattttaagaatgaaaatgtttacagtattttcagttttattataaaaatgcacacacaacaaagattgtcatttcttggctctacttgcattcagcacttgttcttgagcagctttctttgcttttaccatctcgacaagttcctaggaagggagaaaggtgtgatttaagaagttgcgatttaaaaacagacattttaatctagtgtttggtgtaaagaattcaagcaactaagatagatagtactaaatatactgatttcattatct

SEQ ID NO: 126571 - DNA, 1721 bp, Homo sapiens
taattttgctaggtttgtttccttcagtgtaaaacaagaatgatttccagggtttctatccagcaaaagtttaactgtgaggaagctcttttacctattctgtaaggaagtagatttatcagaactcttaatgaattgtggttgtgtttttgagtccaagagtccaacagtactataaatttaaatatggctttttaccagtctggtgagtgtattacattgatttttaagagataaacagtacaaggtagatctttactattgtgttttaaaagcctttgagattttattttctgggatgtgagctatctgaaattttttctcttattaacactcagagggctatatgtatctctcatctctacaagtttattttcaaaatgacacatcccagattgaaatgggcacttagcgaatacttgtggaccacaagacttgtctgagaacatgttcaaagacagttttcaaataaaaatttttcttaatcaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggttgcagacttaagcgtttatagattgttgtattttaaattgtagcttgggtgatatagctcatattttatgtctattaagtggttaataatatagtgcttatttcaaaaccagtagttatggggtcaatattatgaggaagaaatgagcaaccttagaaactttctaggccctggcagataatgaaatcagtatatttagtactatctatcttagttgcttgaattctttacaccaaacactagattaaaatgtctgtttttaaatcgcaacttcttaaatcacacctttctcccttcctaggaacttgtcgagatggtaaaagcaaagaaagctgctcaagaacaagtgctgaatgcaagtagagccaagaaatgacaatctttgttgtgtgtgcatttttataataaaactgaaaatactgtaaacattttcattcttaaaattatactcatggtaataatttgaaagtatgctgcttccaacataatttctcagagaacaaagactgaccattaatacaaaacaaccttcagaggggtagtctttttatcctttgaaagtatgatacagtatttaattcaaatttccaaatgtatatacatgttcatttttatttttctctagctctgttttataaatacatgtgttcaaacaatcttgattaggagcattttaatcacgaagccaacacatgttactgcgtatctgtttaaaatctggtagttgcttaatgggacctaaggattaaaaagaagagttaattaaaagtacttggccaactttttgcatagaagaaaagaagccaggcttaccaacagcagcaatagctggactcctattataaatgtatttggtacatacttctcgaattgtctcagcattcacagcctgaaatatggaagacactgtcattcagctgtttgtagtaaaaacaaagtctatacctggaactttttaaaactaaagcaagatgaaagatacatattctcagcttttgtaacaaggatctttttacacatgacccaatagtaactcaggactacttacatcaattcttgcttcaagctcagggat

SEQ ID NO: 126572 - DNA, 3849 bp, Homo sapiens
aggctgaggcgggtggatcacaaggtcaggagttcaagaccagcctggccaaaatggtgaaaccccgtctctactaaatatagaaaaaattagccaggtgtggtggcaggcgcctgtaattccagctactcaggagactgaggcagaagaatagcttgaacccgggaggtggaggttgcagtgagccgatttcgtgccactggactccagcctgggcgacagtgagactccgtctcaaagaaaagaaaaagttaaaaacatttacactgagataaaattatacctgttcagttgtcattgtctgtttttttgagatggagtcttgctctgttgtccaggctggagtgcagtggcgtgatctcagtttgctgcaatttccgcctccaggttcaagcgattctcctgcctcagcctcccgagtagctgggattacagctttgtaattatgttgatggatgtatttttgagtgtagatactatttttgtgtttgtgcttttagacctggaatcatttttctgataatgaggcagagcgggttaaaatgatggaagaagtggaaaaactttgtgatcggcttgaactggcaaggtatacctatggaactgctattgaagtcttcacttgagcttaggataaagtttcatttcttctttttttttctttagcttacagtgcttgaatgaaacactcacatcatgcacaaaagaagtaggaaaggctgctttggaaaaacaggtaatagaggaacacatcactcctacctatatgtagcatttaattctgctttgacctgtttcttcacctaatatataagtcaccaagtgcagggagtatctgatttctctttatgtttcccactgttttgttgttgttgttttatgtgttcggttttttggttttttgttttgagacagagtcttgctctgttgcccaggctggagtgcagtggcacgatcttggctcactacaacctccgcctcccgggttcaagtgattctcctgcctcagcctcctgagtaactgggattataggcgcacaacaccacacctggctaatttttgtatttttggtagagacagggtttcaccatgttggtcaggctggtcttgaattcttgacctcatgatctgcccatgtaggcttctcaaagtgctgggattataggtgtgaaccaccacgcccagcctgtttttgtttttgtttttgagatggagtctctctctgtcacccaggctggagtgcgggtgggattacaggtgtgtgccaccatgcccggctgatttttgtatttttactagagacagggtttcgctgtgttggccaggctggtctcaaactccttacctcaagtgatccgtccgcattggcctcccaaaggattataggcatgagccaccatgcccagtctgcattttgtttatgtagtaaggtgctgttgttgatttaagttggattagatgtttatggtttttaccatacttagtgtttgatttgtggtatctatcacaagcatagcttttgcaaaatcatattagaaaaaaataattgttttgattattccttgagtattttcatagggtaataacagttagaaccaaaagagatctttgttctgtctagtctataccttttattttacagataagaaaacaggcccagaaattcaattcaattcaacaagtattagtacctactatatatagcactatgcctaggttcttttggagaaatgcctaatgctgttgcaccacaaaggacatgctgagaagaacctgagaagaaccttaaggaccaaaagatggagagcccatagtaaatgaggtgtaggataggaagggccacaagttttagtgaccagggaaggctcagtgtagtttgaaccagcctgaaaggaaggacagagttaaaatgaaggtcagaagaataccacaaactataaaatagaagtagaagtataaagtatggttcagcctgggcaacataaacaaaatctctaccgaaaatacaaaaattaactggcatggtgtcgtgtacctgtagtcccaacttctcaggaggctgaggttagaggattacctgagcctgggaggtcacagctgcagtgagctatgatcatgtcggtgcactccaacctgggcaacagagcgagactttgtctcaaaaaaaacagacaaaaaaaaaatgttatggggaaatggagtgggaaacaaaatcagttaggaaaagcagaaccaatgatcaggtttttaataccttgttgactagtttccattactgcaaatctttgattaacagaaggttcaacattgtactactaatctgacgtttgtggataaggtgcatcagatagatgtaactagttacaagaatcttatttatttaagaatctgcactatgagcgtggtggctcatgcctataatccgagcactttgggaggccaaggcagacagatcccctgaggtcaggagtttgagactagcctggccaacatgatgaaaccccatctctgctaaaaatacaaaaattagctgggcatggtggcaggcatctgtaatcccagctacttgggaggctgaggcaggagaatcacttcaacctaggaggcggaggttgcagtaagcagaaatcacaccactgcactccagcctgggcgacagagtgagactctgcctcaaaagtaagaaagaaagaaaaagaacctgcactatgaatgtgatgatgggaatcaaaaaaatttttcaaggttagcattattgggactttactggttctaagggattgaaggggagaaatgagccaaagctgactcttaagatagcagctgacagaagcaacaagggcaaataaaggttctttttttacttgtgcatgtttgaaggtagtctagaaggaacaatgtaaatggtagagcttcaaaataaaagaggccattttgctatgccttcaccttttggtagagaataaatgagattgtctgcagaaagggtgaatatgagtttgaagagaggtttgaaatggccttgtggatgaataactcagtgacccacagacttgtcaattagtgtccaaggctaatggaagtcacatgacatgagtactgggaaaatcaggcaggctgtgggcagttcttggtccctcaggcagacctatgcagactggaagccagagtgaaaagctggtgcttctttttgggttggcctgagaggagtatggggtcagagtgagaatgacattgagagttgaggaccacaaagccctagccaggaagagagtgtagaatagcaatacagtatacttctaagtccctgacttatgatatttgtgcagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaaggtactggttttaatgaaacttttcttcaactcacactggagcctggagataatgtagacagactccaaatagcagcacttgttatcacagaaacttgcagagataaattctgtgccacagcagaaaagtgtgaaaagtgaggtgcattttgaagctgtcagtcttacccattgcatcagtacacatgcacatatacatatgacagaatacttgtttctcaggaaattgaagatcatgagacaagtcttgatttatgttggcttactctgtcatggcttgttctagggattaggttttctgtagtttttcttttacagtcttgctctttgttttt

SEQ ID NO: 126573 - DNA, 1852 bp, Homo sapiens
gacatgaatgtgcaaaaaataaccaaaattaatattaaatagaaccactgtttaggccgggcgtgctggctcattcctgtaatcctagcactttgggaggctgaggcgggcagatcacctgaggtcaggagtgcgagaccagcctggccaacatggcgaaaccctgtctctactaaaaatagaaaaagtagccaggcatggtgacaggcacctgtaattccagctactccggaggctgaggcaggagactcacttgaacctgggaggcagaggttgcaatgagccaaaatcacgccattgcactccagcctgggcgacaagagcaaaagtctgtctcaaaaaaaaaaaaatcattgtttaatgttagtaatgacacagcattttaacctctaggatgttatgtacatataaatattttataaaatattgcattttccagtcatagcatctataagcagtagtttgtttccaatattttctattttatagtcgtgatgagaggagatggattgaaaagcagaacagagcaacaagagcacaaagaaaaaaagaagaaatgaacagaataagaacattagttggtaagtagaattgatttaagtcccctaaatgttagaaattcaaaatgagattaactttttcttttgctagacaatgcatacagctgtgatccaaggataaaaaagttcaaggaagaagaaaaagccaagaaagaagcagaaaagaaagcaaaagcagaagctaaacggaaggagcaagaagctaaagaaaaagtaagacaacatttaatgaaggtggactttaaatgtttatgaaatctttaatcttcactttaatcttcacatctttttttaaaaaaaactataattcgaaagcagagaattgggtgctactgtgaatgaatcatgaccagttggtataattgagagatcttccttaccagcacgtttttattgagcaaaaaattgtgtcataagttcctttaatattatgcttatttctaatatgtcaattttacattttctaataaatgtttatagatctttaccagctgtctttccgagttcatccttcagttttcaataagtttatgttgccttttttcctaatataatttattaaaagtttaaatttttaaaattataaaacatttaggaattttactgtacctattaaaatgattttactccctttttttaaagcaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaaggtatatcagactgaacaaacactaggcacaagtaaatcaagttgcttattaagcaaaaatacttctttttgtttgtttgttttttagatggggtctcgctctgtcgcccaggctggagtgcagtggcgcgatctcagttcaccgcaatttccgcctccgggttcgagcgattctcctgcctcagcctcccgagtagctgggattacaggcgtgtgccaccacgcctggctaattttttgtatttttagtagagacagggtttcgccatgttggcaaagctggtcttgtactcctgacctcaagtgatctccccgccttggcctcccaaagtgctgggactacaggcatgagccactgcacccagccaaaatatttcttgaaaaaaaaaaattatttttatttatttatttatttgagatggagtctcgcactgtcacctggtctggagtgcaatggcacgattttggctcactgcaacccccgcctcctgggttcaagca

SEQ ID NO: 126574 - DNA, 1071 bp, Homo sapiens
taggttaccaccatttctaaatgtttccttaaatgtgattttacactttgatgctaatttttgaacagttgtatgcacaccgttcatatttactctttgccagttctcttacacagtgctccagaagcctaagatccttcgatcttttacaaccttgggatctaacaattaacttactagctatttctttttccccagagtcatcttttctcttgaggggtgggtgatatttattgttttgtcacttgtctactagaaaaataaagaaggagttaagtccagttatatccagtagtgctaaagctgttgttacctaaattaaatcctccccaacctgcaaacaaaattttcaaatatgaaaattaatgacttctatgttttaaggagggaaatacttgttttcttgcaggaaaaaataggtaaagttatggtgatgtgatcttaacaatttttttctcagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccaggtaagttaaggcatcccttttgatcatagtgccctgttggcttgtttattgtagtcttccaggtttctgctctttccctctgataatagtttcatttatagattatttccactgtctcttcctcctcctcctccttctctgcaatattcagcccttctggtgaacttactgttctcatttatattgctttctaaacagaagttctacatttccatagtaaaatttctgtacaatttatgggaagtttctcttttaaatttacttgggctgggcacagtggttcacacctgtaatcccagcactttggaaggccgaggtggacggatcacctgaggtcaggagttcaagaccagcctggccaacatggtgaaaccctgtctctactaaaatacaaaaattagctggccgtggaggtgcatgcctgtaatcccagctcctcgggaggcggagacgggagttttgcttgaac

SEQ ID NO: 126575 - DNA, 1160 bp, Homo sapiens
tggcatccaactgtggttttgatttgcatttcctaacagtgatgttgtccatttgtatatcttctttggagcaatgtttattcaggttatttgcccacttaaaaaatcaggttgttttcttgtgtggtaggagttctttatatattctggatattaactctttaccagaaatagattaccttcactatatttgtagatgtggccactacttattgtgtctaatatgccaggcgttttacaaacactgtaaagtttccttctcacaggtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgaggtcagttgacatgggccggagctcggagctggggcgggactggagcggagctgccttggcactggagaggagctggattcccgctcctggctctgtgctctggcccttttgtgcccctagtaatttagtctggacaccggccggattaacttgcctgccttctcagtctccctcatccactacaagttctgtattatctgctgatggaaatttttattcattctcagctctcgggtcttgaagaagtcacgcaccctgcttggcctaataggccttgaaaagttctgcctggcggtgctcggtcacctgatcctctttcctctcctcctccttccccctgtgacagccgggagctgtcactgtgtagccacaattctgagacataattttcttaaaaaaattatttgaccagataatacattcacagggttcacaattcaagaggcagaaaagatatctttgaaaagcctcgcatccttggccccagccaccaacttctccacagaggcaactaatgttgctattttgcatatctttttagacatattctatacatatacaagcaagtgtgcttatctattccttttttttaacacaaatgtagcatgctgtacatacttcaacatcttgattttt

SEQ ID NO: 126576 - DNA, 1074 bp, Homo sapiens
ccaggctggagtgcagagatgtgatctcagctcactgcaatcgctgcctcctgggttcaagggattctcctgcctcaacctcccaagtagctgggattacaggcacccccccaccacacccaactaatttttgcatttttagcagagaccgggtttcacaatgttggccaggctggtcttgaactcctgacctcaggtgatccgcccaccttggcctcccaaaatgctgggattacaggcgtgagccaccgcgtctagcctgattaagttactttcaatttaagctttccgatctcaacttggtcctaattgcagttaactttttgtgaatctcctattgactcactttgtttgagtggttatttcaagccttttacatgtttttcaggtcctcagttcagtctctttcttcatgactgatgacttttttctctcctgagacgattgagaatccacttaagagttctcttaacttctctgacattttccattttctgttttaatcctgccttagaggaagtggtatcaatttttgttatgtgcaaccttccccatttctgtttttgaccttatgccttcctcctctggactttgtttcttcagtcactacctcttctatttgttgtcctatggaatttttcccttttgttcttataagcatgctaatatccattttatcttaaaaacatagttgagaaaatcttcctgctctcctaagttacaagtcattttcttttttttctttcacggcctgaaagtggcagaaaggacaggcttaggagttaggaagacctaggtttgaatcttggctttgagttttgtctaataaattctgtgaaactgtttttcctatctgtaatgtagaaataattgtatttacttcacaggtttatatagaattagataatatcaatatgtatctctaatcacggtgtctcatacagtgatcatctcaatttatagcagctattactattctcccacagtacatttctttactatttatatatttatttttagagacagtcttgcactgtcgctcaagctggagtgcagtggcatgatcatagtcac

SEQ ID NO: 126577 - DNA, 1016 bp, Homo sapiens
tcagcctcctgagtagctgggactacagacatgcgccaccatgccaggccaatttttgtatttttggtagagacggggtttcgccaggttggctaggctggtctcaaactcctgacctcaggtgatctgcctgcctgggcctcccaaagtactgggattataggcaggagccaccgcacggggcctgcattgtatttcattgtatgactatggtataatttaaccaagatccttaatggatgtgttttatgtatgtactatataaaataggtcatcacgtatattatgtacttttaaaaacctattttcctcccagttagataaaaattccttgagtccaggaactatttgattgaatatgtatcatcataatcttgcttgatttttgacactcacttaaaacaatttgaatcgaacagaaaaaaagctctagtttcttttttaaaaattttaattctagtttctttttgaatctcacgtattgtctctcttctttcagctctggatgagggggatattgccttgttgaaaacttatgtaagtcctttcagtgtctacaaactatagatgttttatgttgaaataaaaactgttttggtattgtccttccaaaataattagaagaagttaagaaaccaaaaattaaaaaaccaaacaaaaaataaaataaaaagaaacaattagaaaagaatgtctggcagcttctagtaatcttcactaaatgaagttacctacctaaagtttatagaatagatcaaagtatttggcatgtctcagtttatgtattattttaatactattcgtgattaaaatgtgatgctatattgaaagatatttgaaatcatttacacaagtttactatatttaacaagtattactgaattagttctgaaatgaagttttaatgcatagaaatcgatagttttgcataatttcacacacgattttttttttttttttttttgaaacggagtgttgctcttgtcacccaggctggagtgcaatggcgcgatctt

SEQ ID NO: 126578 - DNA, 1008 bp, Homo sapiens
aaaaaacttttttggataaaaataagatctcacaacatagttttgcttcaagtaattgggctctttcctggaactttttggggggaacttgaatgatgaagttttataatatttgacctacacaaaaatgtcaaatgtggcattatatttttggcttgacaattactttagggcagggtgtagttttcagctggggtgattttgccccaccctcccaacccctcccagaggacactgggcaatgtctggagacatccttgattgtcatgactttgagagagggtggtgctgctggcgtctagtggtgagaggccagggatgctactaaacagtctataatgcacatgatagtcctcacaatgaatgattcagtgcaaaatatcagtagtgctgaggtttagaaagcttattatagggtgatgcattacattttagtaaattttgtcatctttctctatgtaggtattaaagaatctgacactggcctggccccaccagcactctgggatttggctgcagataagcagacactccagagtgaacagcctttacaggttgccaggtatgcacgggtgctctgtggcaacttacctttgtctgtattttcaagcacttaatgttagagtctcagggataatgcaatagttcataaataattttgattccaaattccaagtaaataaagctttctacaaaactggggttaaaattttatgccttaaacaattcttcaaaaatatatgaaggcataatcatttaaaagatttaaatgatataaaaagatgtagagcaagaaatgaaaaactcccttctcatacttgctttcccgttgccctttcctcaaacgtaactactgaaatagtttggccctcgtaatcctctgtgtatcttcctgtatttgcatgcaaagaaacatatcctgatttttttttttttagatataactacatgttttgggaatctttgtctttaatataggtatacttatttcttttttcttgtgttttt

SEQ ID NO: 126579 - DNA, 1018 bp, Homo sapiens
gtagtgaataaatggactgagttccttggaataccaaaggatgatctagtaatgtactatagttgaaaattctgtcttctgcatctgcttcctaacttcccatcggcttcgctgactcccctactcccactgttgtttattatgaatggcttcaaatttcagagttgaggttaccagtccatttaaggtaacatggtataggttgggggagtacttgctttaggatagttgtgatgctaagtgtgttaatgtctatagaatacataacaactcacttagtaaattaaaaaaaaatctcccctccctcctcaaaggtttgattgctgttggataggttgtttgcgacattagacatgtagtttagtatcctcagatttcatgctctctttatttctctttatataattagggactctgtctctctcttgttttcttaaagtatggttttggggataaaggactaaacataaaagcactttgaaagcttaaagaatgtattaatgactatcttttttacttccttagcgtggatagaaataaatatcaaattcacattccattgcctcctaagattgacccaacagttaccatgatgcaggtaagaaactatgggagggaaaaggaaggctatgtctttttttttttttttttttgaggcggagtttcactcttgtccaggctggagtagaatggtgtgatcttggctcactgcaacctctgcctcccgggttcaagcaattctcctgcctcagcctcccgagtagctgggattacaggcacccgccaccacgcccagctaatttttgtatttttagtagagacggtgtttcaccatgttggccagactggtttcgaactcatgacctcaagtgtttggcctgcctcagcctcccaaagtgctgggattccaggcgtgagccactgagcccggcagtattttatatatatattttttgagacagagtctcagcctgtctttattttactagtttgtttttcattcattagtgtcataaca

SEQ ID NO: 126580 - DNA, 1201 bp, Homo sapiens
ttagttttatataaagcaagctgttcttacaggatttgcttcaaagtgggatgtcacttgtgcctgaggacatgatttgagctgagatttttggtactttcaggtcatgcatagtgctactcttgagtggacttgaagagcttatctttccttttgtcttctcaggggctcgttttgatgatggtgctggaggtgacaatgaagtgcagagaacaatgttggaactgatcaatcagcttgatggttttgatcctagaggcaatattaaagtgctgatggccactaacagacctgatactttggatccagcactgatgaggccagggagattggatagaaaaattgaatttagcttgcccgatctagaggtaagaaaaccatttcattttaggaaagggatttttgaagttttttcttcctgtgatttttttccattttaatatttgtcaattttctcatttttagggtcggacccacatatttaagattcacgctcgttcaatgagtgttgaaagagatatcagatttgaactgttagcacgactgtgtccaaatagcactggtaagtagaaagttcttgcttatatttgctggtctgtctgctcaggctgctttaattaagcccgtttattttctttttgtttgaaaggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagct

SEQ ID NO: 126581 - DNA, 1313 bp, Homo sapiens
gtgccaccctgagatgctgtccttctggctcttcctagaagagcatcagtgtgtataatagtggacaggggctataaatcaccccatctccctatcctgctgaaaatagatactacagaaaagctaataataataatagtattattgtatttccaaaagacactcttcctggagtttaactgatgagtctcggaagggctttattgccttcattcattcaagtgttcattgagctcctcttctgtgtgaagcagctctcaaggcacttagaatttgtgaaacaaaatctttgctctggaggggccaacattctggtgagaggaggcaactgtcaaataaatggacatgtcagggagtaataaatgcaatgagaaaattaaatcggaggtcaacgagtgacggggttagcattttattagaggtggccagggtaaggcctctgaggggcgtgaccattaaacagaggcccgaatcgtgtaagagagttaacccagcagaaggactaaccagcgttaagagtcataccctgtaatcctagcactttgggaggccaagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacccgggaggcggatcttgcagtgagccgagatcgcgccactgcagtccaacctgggagacacagcaagactccgtctcaaaaaaaaaaaaaaaaagagtcatacccactggtgtttgggtgaccacaacagcccttatgtaaatgtcagtattaaatgatgttttacttcttaagtgagaaaggctgttgggaggtctgtttttcctacttttttttctgaatgacagctgaggttaaaagaaatgagtctgaatcacaagacagcaactaggcttttgagttcacatgtacctctaacataagagatacttttaatagttggtcgactcattgatgaattgattgattatttcatcatcttggtctggcttcctatgacaaaagtgggaagttacttgtctattttttctaaatgataccagggatagtactatttaaatagaaccagagtaaaagtggatacctatttcagttgtaattttagattaggtaaagtagttcctagatcagaccaagtttacaataaaatatttgttagaattatactgatgaatctctccaacattaaaaggaagcaactgtatagaaatagctgtcattctttt

SEQ ID NO: 126582 - DNA, 1038 bp, Homo sapiens
gaaaccctgcaaccagtctcagctgggtttttagtcttccagtaagtcatgagcggccagtggggaccctgtggggttcagttgtcatgggaatctgactatttcaaatgctgacagtgagaggaagaaaatgcattgagcgtaacacactactttaaaatctatgacttttgacactgagaaaatgtaagggacttattaagaacacagcagggtttgaaaattacttctgaaacatcataaccttatatctgtagattcacaaacctaatgaacaagaaaaatcactagatacctatattaaaaattatctgaaaaagcctctcccaaattagttcttataaattatataagaaaaagtatattgattaacatattaaacccataacagggcagttcaatagcaacacactgaacagtgagggacagctcagaggaggctgaggtttaggttaggactcttacgtgacctaggtttgtaaatatgcttcatgggataaacagtgcattaatgacatttaatcattatcctagttgcaaatcaagcatcagcactagtaaaattaaattataaatggatataaatatatgtatatgtacatatataaataatcaagacaaaaatatatattaaaataaaacaaaaattaaattataaatggatgggacagaatatatatatgtaaatgtatacataatcaagacaaatgacaactaagatgagcattaaaaaactaaaaaacaaaaactaagaaacagacaatgctactatcacagagcatgtctctgtctgagaaagtgacttactttaaggatcatccagacaactccttgatgaattcaaggatgttgcttatagacagtatttttataaccaagttctgttgaacatttattgaatgtaagaagcccccacaagactgtaatgccaaaatatgtgctgggtgatggggaaccggtaattggccttagcatcctacagtggcatggtagctgtctaagagggttatgcttagggtaggagtgtgggattttgca

SEQ ID NO: 126583 - DNA, 1050 bp, Homo sapiens
agggaagaactctgggatatcaggaggggagaaattatcaaataggaaactggagagaaggatggaaaggaggtgaagtttcctataagtgactgtccatgcatcctcacagctggtcacctgtctcctgcccggtgcatttcctctcctgtactgccccaccttgttaccagccccagatgtggcttcccggcataacactaaccagattttccctgcccctgactgggtcatcagaactttcctgttttgtaatttactttctaatggcttgctaaatgactcagcagctaatttgattaatttatttagatgaatactaacagagcttaatatggatgttggcattttaacaagggtcatctgcaagtggaattctctaattggaagatatgaatctccaattacaggagggaatccaataatgagaattaggctggccggcgggccagaaatttctgttaagaggaggcacttaaattatactcagcatctactctacctaggtgtaaaagtaatttaggtggtagcagaagaaagttactaagctgtaggtttttagactatacataggtggtcctccattttacaaatgtcttctttcaattaccgtgagccaggtatacataggtggagaccttactccctcttccctcttactttcaagtcattttcaagcccatttcaagctttcgttgatgcagcaattcctttcaacaactctggaagagattgtgatctaccaagcctcatctcattagtcataaaggggtcaaagtcttgataccaagatagcagttgagactccaggctctggaatccttggatcaaataccagctgtattgctactggctgtctggccttaggcaagttatttaatgtgtctctgtgactttctcacctgtatagtggaaagtagaatttacttcgtagcatttttacaggattaaataaatgaatatatctaaggcagtagttctcaactagggacattttgcccgccggcaaacgtagtcatttctggagacagttttggttgtcacaactgg

SEQ ID NO: 126584 - DNA, 2181 bp, Homo sapiens
cagcctgggcgacagagcaagactccatctcaaaacaaacaaaaagaatcatgtgtcaaaagtactttggtgcccataaatttgggtgtttctagagttgaacgaaagaaaaacatataaaataactttatgatttaataaccatactttttgcgtctttatgcaaaagattttttttaaactttttagttctgcagtattgttttggcagttttataccatttggaaaggcttagtattcttcagaggcactgttacaatgaagcaagttattcttcagtccaacattaggtaccacaatagccatagcatctctttttagctatttttaaatgtgttttcataagcagtatctatagtttcccattccacattttaaaaaatatttgatatgtcagtcatttgcttagaaacttttttagaaagtatattgcaaaatgatagacaaaaacattaattgatgatggtttaataaataagagcatgcaattagtgaatctttaaaaggctgttctcacatggatgattatttttgcagaattgaatacttaaggctttaattttatacttattgctagatcattatatccaattattttgaccatttattcaaataataaaccaagtctgaatatttatagtgaagaatgagttttgtgaaaggagaataattatatgtctctctctctgctattttattctgcctgccatcagagtacaaaaatatacattcacatcatctgtttgttgtatcatattcttggatcatacagatttagttacaatacacacacaggtcagccagcgttaaaagactgaaaagaatgaaaactataaatgaggacagatgagctatgcattatgtaatgacaaaacaggtgtctcggaagataaacaatgttcagaagcaaagaagatttaaatacttttgaatctctaattactttattctggttattagacaaagcaaatagctttcaaatgaagtctaaactttctgtagtacaattgaagtacataatgttgaatagctctagcttcgtttacttttttttagaaaggcaaacttcgtgcatggcaaaaaaaaaaaaaaattaaaatattgtgttcctaataacattttaaagaattaatgtcagtcctatcagggtgcatttgatagcactataggatttttagcattagtcatgaattattttgcatgtgctttccagaatcatacaaagctgagcaatctaggggtgagaatgctaacatattatctgtttttgtttttaggacggtgaactttgacataataaaatacttgtatgatttcttgtgaaaacaagcttcaaagccatatggacactgtgacaatgactaagccaagctgtgttcatccagctacttagctggccaaggagaggagttctttggctctattggatttgtccaaacaggtgctggcccagcatggaatctgatgaaaatattctgattggtctgggtggatgtgagcagaagactatttaccagggaccctggagtatttggaagcaacgtgttaattataaacagcagggtttgagcacaatctgttctactcttaatgatgttatcttaacactgaaattgcctgaaacccatttacttaggactacattttgctctgtgaactatcccctgcgctttgaacgtgccagcagcccttgtttatatgcccattcttttcacttcctctccacaggagcctctgcagtcgcttgccaaagcagattttcctaaggccactgttttaaaagatcatagttgcaaaatataataaatacaagttctttttaaaatccaagcttgtgtgtatttatcttttcacttgcttttctcaaaaggcaaggtagtttgatcagaaacagaccaactttccctctttcagcctacttgataactgtggtatgcttgtataaggtttatctggtcactttcttaaaattagctacccaacccagttttttttttttttatcagtatcatggttttattttctttctttctcttttttaaaatcactggcctttaagagttccacaataattttttttcctgttatatcacttgtgaactttggttttgattttcttgtccatatttttgaagaaattttcttttagcatttgaatgcttgaaaattattttaagcag

SEQ ID NO: 126585 - DNA, 1852 bp, Homo sapiens
ccacccacctcggcctcccaaagtgctaggtttacaggcatcagccactgtgtctggccaagagagaggattataactgctgaaggggttatgtggttgagagagggttattatttattttttaaagatttgagcatatttaaatgctgataggaaagaacagatagagaaggagagttaatgatacaaaatggagaaagattaatttaaagcacaaaattactgaaacgttatataagcatggggtttagaatttgagttgcaagagctgtagatgagagagcggaatcttcttgcgttataacaagagaaaaagatggattctgatggagctgaatttggaggtttggtggcaaaaagttgagggagttctgatctgatgaattccattttctccgagaaggaggagacaaaattgagactaagggcagaaatagtagcagtttagagaaatctggaacatttgaaatagctgccatggggaatggaagaaactgttgaaaggaaagcagtttgttgggagtgttgaggtttttgaccttgaatttacttacaatggcaccaatctgtgagacttgtgatcttctccaacaccaatccatgtgctagagactgggacagcaaagaattataatcgaaatcacatcgtactggggttttgccaggtaagttcagtggattccagcaagtaaccacttgacctgatgaatcatggagtcttaagctaggacgggcaggaaggaagtaaagccagtcgggggctaataattcagtgcctagcatatagatactcagttaatgtttgtagatcaggaaaaaatgaagccatttgtgaactgattgtcccaacatgttccagatagcaaaaaagggataaattggggatcataaggtagaatgtctgaatttatttctttagaagtagagcatttctgagtgtgattatgagagtggaaaaggttattggaggtaagaaagagaaatatatagtgaagtcactaggctgacgcaggtcttgggttggaaaggaagactgaactgtatgctaaattactcagtgactaagggatggcgacaaagaggatggggatggtgagcagaatggtcttaatctcagagtagcagagctttttgcacaggacaccagccccacctgacagaactgtccgggggtacagtagagagttaaacattcattggaaggagctgaagaaaagactatgtcctttgaggggagcctagtttcagttaagcctggaaggggaaaataaccattccttgaagagatagaggatatagagactacagtggaaaggtttggacagagaagctgtaggaagctgattctagaaagggaacatagaatttggagatagagtatgggagaaggcagataacagatgactgaaaagcttactaaattttgttcttggattgttcttaatgtgaatggtagttacacattttcaattgtttttcttccacagtcagtgggaagacactataagataaatagaggttacaacttaaagttgtatggttgcaagttgtcagaaaaaaaaaaaattaaaaaaatctcaaactcaaactgcccacaaaagtaaaaggaaacaaaatagtatcctaaagaaagaaaaagtattttaatgaatcaacaaaatgaaataaaaggataaaggcaaaattaaatccttaaatatatgccatataattaagttgtattaacgtattctaaattctgatttaagaattactcctaggaaaattgccaccacactattcgtgtttactgtatttctttccagctggttactttagaaaataattcatttatgttctgtgggagaatctc

SEQ ID NO: 126586 - DNA, 1059 bp, Homo sapiens
cttggttgttagactggaaaacatatgtacaaatttgtatttacagattgcaaagtagtcattttctttgcagacgttttttgtgattcagttatgtatctttatcagactataagatgtttcagaaacaaaagtattacataatcttattaaaacagtttcttataaaaatgttctcttttagattacctctctagtgacccttcagctgttaaccctggttggccatgacgatcagcttgatggaccaaaatacaaatgcacagtgtctctagacttcatcagagctattgcaaggtaaaatgtcttgaattatgtaatgatatactaaatataaaaattagtgttttccaaatgtgatgtcattagtcatgacatttaaacatgaaaaaatcatctatttaagtgccaagaatgaataagctgtacgatagaatgaaccttctcaaatttacaaatgatgtaaaactgggagaaatagctaatatgttagaggacaaaaatcaagattctgaaaaaccttaataggctggaataaatgatcccatagtggcaaggtaagatttaatggacagttggctacagaaaactctcttgtattgaaataagatgggagagagctggcttaagtcctaaattttttagctgactacaaggctttaaaaatcctgacttaggtaacactgatagaaatatagtgtctaggtcaggggacataatcattctactgtgcgttgtcacaggcagatcaaatctagtgtgctgtgctgtgtttagagttttcagagagacaaatggatacatactgaaggggcacgaggagagtggtagaatgaggaattgtgtcacatccctgactgaaggacagagtgtgagagaaaagccttaggaaggacatgtgaactgtcttaagtgtttcaggggctgtcgtgcaaaatgaatgaagctaattctgagtaattctagaatgttagaagttctggggaagaaagtacatttgtcaaaatgaaagctgtctaaaaatacaagtttccttacaaagaggtgttcttagtgtta

SEQ ID NO: 126587 - DNA, 1046 bp, Homo sapiens
gtgttaaaatgtttaatcaaatgtgatttagaaaactcatgaggatatattctcttgtatttatccacaaatctcctctttccactgttcgttctttcacttttattatttccttttgtttgaagaacttccttttgctcttctttgaaggtcatctgctagtgacagattcttccgttttaccttgttcgagcatgtctttatttccactttattcatgaaggatagttttgctagatatagaattgccagatctttcgtcaggattcttctttaatccaggggaggaatgagcctacctgggtagccttttgccgctcagttgtggattggaaagtgctgggcttggttcacctttcgctcttgggtggggaattctaagactcgcaccctctatattgtttctgtagccctagggtccctaagcagcccacctacctctttctacctttcagagtcctcttttggtcgcctcttatattatttccaggatttatagttgtacttagcagggaagaataacaaatatgaatctatgcatcctgtctgggtgggaagttcttctgtatttatcttttttttctaaccctctgtctaggctctttgttagtgtttgttcctgaaatgtgttccttggtaattcaaagctcaattgaatgagaagccttctgtaaattagtgctaaaaaaagattacagaatgttttaccattattatttagagagcttttttttccaacagagattaaatccttctaagtcattaatttatttactgcaaaatatttcaatttattattccatgctggaactacagactttgtgtaaatctccccctgcatttggggacctaacaacaggaatgactgttgtgtatctcttttctctaagtcacagatgtgtcactgaataagaagggtcgaagttaatatacttagccatagaagactatgttaactcttttctgtgtatcttcccattcattaaaatttcaggcctactctcattatggatttctacaagtttccaaactaagaaggctatttg

SEQ ID NO: 126588 - DNA, 1968 bp, Homo sapiens
gtttctagtttttagtttagctaaatggagaaattatctctgaaccgtctcattttctctccttcatttacttggtcaagtctagtctatttttcctaaatacaaatgtctcttaaacattctcctttttttccaccctcactgacattaccttaaatcagtagcttccttattaggcagttgcaccagctttctatctggtctccttgtcactaggcacttgctggttcatcatccatacggtcatcagcataaatcttgaaaaataaatttggtctttcttttctggttatacttttttttgatgagttacattatttacagaaccaagtctacattcaatagcatttattgcaaggtccttcataatctggccccaatttctaccacttccttcattcaccatatataccattcacaataagctgtttcctctctgaaaacacactaattttaaatgtttttatattgttgcatgtactttccccttacaactatcgagctctctttttacgcatcatggtccatctcccaaatgtcatttctcagtgaatctgcactttgcctccctcccttttagttcattttcttctctatagtcagataattatgtttatgcatattataatactaacatagcactcattttatgtcattaccattttatgtgtttgtctccaactaccctgatgtttgagggcatagacgttgtctgttcatttttgtatctcttgcacaatgccatccatgaacatgagagtcattgattgaatgatctcccattctcctaacaggcatttatggtcttcatggttgctaaagatttgcaggcagtttgcatgctaaaaagttccagagattagaggctttatcttcagttgctctgtgtataaacatacatgctactttttgtttatctgagcatatttgaagactagcaaaccactctcctttttttttttttgaaatgaaaatttatggtagtgatttaaagttgaactgctttgatgatatttgcctatttctgccatgtgctgcatttaccacctctgctttgtgtgtgtaaaaatgtcagttgaactctcaatatatgccatgaaccgtcaagtctcctgaattcagatcaaatgtggtgcttgttgggttgtgtggaactcatacactgaaatttcatttgttaagttcatttatttaaataatttaatatgtttcagattgtgaagctcctccaggacaagcaggataggatatttcttaagtcaatggacatataacaacctatgaacgtataaaaataatgagcatgttaaaaattaattacagttgtaaattgattttcttttgttggcagaaataacagtttattagccgagaaacaggttcacactgtttttacatcaagcatttccagctgaagcttgttagtagctgcctctcagattaaggaaaaaaaaatcctcactgtggtacatgaactcctattgttacaacataaataatcagctcatcccctacacagatgagaacaaaggacataacagtacacagagcaaagattaaacaaatattgtataaccccatttaggatgtaaatctaaaaatattgtacacagaaagagatttttgtttttttatttttctttgtgaattcctcagtcataacgtaggacctagtcaaaggaaaaggaatatatactgtggcttttgagtcagatagattgattattttaagctaaggtgaaataaaatatgttaagcagtgtcagaatgctgctgatgtatgaaagctagggaagtactattctctttgataacaggatgcctcagatttttaggggatttgtttaaactgaggaggacaaaaaaataacaatttttattttgaggaaaaacatcagtggaaaacatgactaaaaatttagtagtaaaaccactgacttttaatacagttttttaaaaacaaaaaca

SEQ ID NO: 126589 - DNA, 1005 bp, Homo sapiens
tatttcgtacctggaggtaaattgctttttattagttataatgtgtctatatgagatgatcatgtattatttttgtattcacctgttttaagaatttattttatagtgatatgctatttttatagctggatttactgactaaataattgtttaaacttattttgtgtataaattgatcatgtatgatatagacattcagaattctcctgaagcaaaagtttatttccattgtatttcaaatctaatctattctataatgaagttataaaaatagtaactcaaggactctttaaagtttattaaaattccaattgagaataataaatttataatagtactagcagcaatattgtattgtagttggcattattctgaatttcttcattctctattgaattttaaataaaattctattcattagtctcacaagtaagtgaagagaatagtagcacatttaacattttatgttaatgttcagatttattgaacttaaatatgactttaaatttttttttagattattattttagtcttacctggtttttacctttagtacaattttgcagtcattatcttgggtcatttttaaaattttcattccagtaagataaatgtagcccttctatgtatgcctgaacttcatgggtgacaaagcattaattctggtatttcattcttttctcctttcctttctgctctcatcataagatagaatggaatacatgcagtaaatgggtaaagtttataggtattctttctaaatttttaatttgatcagttatgattttgaagaccatttgtcagcttttaaagaaatagtattgtctttttttccagaaatatattaaagccaagttatgctttttaattctttttttcttaaaagaaaaaaatatgggaatttccgaattatctgtttcattctttttatagttctatgtctcctcttactcattcttacctcccctacccaaatactcttgtagttaggtcagagcaatagga

SEQ ID NO: 126590 - DNA, 1061 bp, Homo sapiens
tatggtggctcatgcctgtaattctaacactttgggaggccaaggtggggaggattgcttgaggccaggagtttaagaccagtctgggcaacatagtgagaccctgtctttacaaaataatttgtaaaaatacccaaacattgcggtgtgtgcctagagtcctagctactcaagaggagaatctgacataggaggatggcttgagcccaggaattcaaggctgtagtgagccatgattgcgctgccactgcattccagcctgggtgacagcggaccttgtctctaaacaaaacaaacttaaaaaaaggataaatcatgatcatatcagttaaacttttaacttagagtttgcaggttagatttgttagcatttttaggggaactatatataacaaaaatacattgttactggcagttttgtagtacagaaagtgagtgctctggtataagaagaaaatccatgtttttgttttgttttttacagacaagcaatcatctccttgggccaaaaccatttccactagacagattattagcaatattatatagtatcgtggacagcagagttgctccaacagcaaatattttttcccaggtaagcttaatcatagattattatctgtcatctttgtgggattcttcagatagtagagtcaatagaattccaggcattcagatttttgttcaacatatgttactgttttaactatataatgaaccatgtttttggtaagtaattgaaaattacgtatatagaatctttgggggtatcactaaatttacatatgtttacaagtataacctcatggcaaataatttaatttggctctttttcaataaaggaatttttaaaattaaataatcataattatcttgctaattaaacaagtggcttgatgaccaagttgatgaattgtaatttaatgaaaacaaaattgaaaaatttttttttgtaacagagtaatctacaatgttcttattcctcatctatgtactttgcagatagatgtgcttttattaaaaaatgctgttttccagaataattaagttctcagaatttc

SEQ ID NO: 126591 - DNA, 1048 bp, Homo sapiens
atgctctcaatcagtgtttattatgtgaactgtgcttaactaaaatgccctccgtcagcgtttattatgtggattgccagacttatgggatgaataaaaatccatatctctggaagtttcatttttatagcaatgtatatgctgaactaaatcaatataataagctcttttaggaaatgtcattattttattttagaaattctttttttacatgcaaaagtaattttatatccaatccaagtctaaacgaaattggcctaaaatatgttgaagtctaatatatatacaaggtgataagaagaataactatttaaaaacctgagatatacagattagtattatgtgtgccatgttttaaataaataacgttttctggttttgtggaatactgtcttttcaacttaaaatttgttttccttaattgcagcatcatggaaaaatcaagaaaaccaactttctaaaaaaacacgaaaaggtatttacattttaatttctaatggaagaaacttaggaaatgaagataatataggaaatagatacatctgtaattgtatttgtcatttgaatataggaacttatttgtgttgatatggtaccgttatactgtaatagaattttgttatattgaatatagtgattgaatgcacatttaggtgagctgctgctggagtttaaaactgagttgacaaagttttttagtgacttagtagatgaagaagtttaccctggattatttagttaaatacagccaattgaatacaggcattttcctcttttctttcccctttgaagcacccacaacaaataaaaaaggtaaactcataaatactaagcagatgagagacccccagaatttgcaattgcatggtaggtagatattgaggtgaccaagcagattagagaaaacgctaaaacctaagcctcaaacttagctaatttggccttaggaatctggaaaaaagcttagggattagaagcactaagtacttttgaaggtggggtcagataaggttgaaactggtgaaagaagcatttagactatttagat

SEQ ID NO: 126592 - DNA, 1106 bp, Homo sapiens
gtgtttggttggaaaaaaaaaaaaatctgtagacaagtggaccctcacagttcaaacctatgtcgttcaagggtcagttgtttattttgattagccaaattgtgtaccagttgctgttaacattatgacactttagtgttattacaccatgcttagatctgaaaatctaaaattaaggtaagaaagtttggctaaagcgaataatttctttttgattcttcttctctacacttagtagaatttggaagatttttctattttaaatcattgttttttatgaagtagaataggaagaaattattttaatgatttggttcttagttttctgttatctagttatatgttatatagttacacatttatatatatctttttctgtgccttattgaattattttgatatgaaatacttgggaacaaactaatatatatatattttttttaaataaatggaattagtatgtttttaaccagtttgcttaaactgctgttcagtagaattccagtgttgattcatggaaaactactaagtagttataattagttaattagtactcctcaaactttagaatacatagagtttctagagagatcgttaaacatagattcctgggtctcatcctcagagattctgatttggtatgcctgagatggtgccaagaacttgcatttataacaatcgcaggtagtgctgccaatccaaatactttgagtcatacgaaactcaatgatgtttagtttatgagaatgttcagaccttagaaaacaacagttaattatttgtgcttgaggtttttcattatatgttttatggttctatgtgacataaatataacctaaaagaacaaattatgctttgttactgtagggaagttcacatttttaccctgcagttttgataatttgaatctataaaacaaactaataatagattaacgggaaaaaaaaggcatacaaatttattttttaattttaatttaattttaaatttaattttatattaagttccaggatacatgtgcaggggcgtgcaggtttgttacataggtaaaatgcgtgccatggtggtttgctgcatctatcaacccctcacctaggtattaagcc

SEQ ID NO: 126593 - DNA, 1171 bp, Homo sapiens
tgatattgaaatgggaatatcaaagtattattgccattcaaatgggaatatcaaagtattaaactgttaaggtttgctgccaatctcaaataagatgtttgtatttctgcacttacaaaatttttattttggaactgtgagaggttattgtataattactacatttttttggatgagcagctctcatatttgtgctaatgtatcttcatttttttagtcactacattaagatgtatatttatattgtgattatgacatctgtacgaataatcagactagacttgtaaagcatattaagagtgttgaaatcttcatttaccatatacttgggttaagtaccatgttgcgcttatatcttttgattttataaatctcattttctttactgtaactcatacagtaccaattaccagcccttgtgtttcttattttcttgggggctctatttaatcttaaatttcatagatcctgatgattttggtctttggaagaacacaatagctttttgtgttgctgaatagctttgtggattaagactgggctgtcatacagagatgatacttgggattcagagattataactgtgaagtataagatggttagcagtctataaaaaaatagcattccatgaccttggcctcattaacactatccctctgaactaatcagctgtaaacataccttaagattaacacatttttgtctgtttccaccagaacagcagtgaaataacaccttctgtcatagccaattagctgagtttttttttaaacagcaacccaaaatagatggagtctttattgtcattaatttctcatccataaaaatcccaaaataaaaaagggtaagaggaaaagtgataaaggattttatttaaaaaaaaaaaaaaaaggctctgtacctgtgtcagcactgttcatagttcagtttttcatgacccattttaagtactgaaaaattatttagaatttaagaaaattattaaaaaatgttgatattacacatttcagtcaagttgaattaatgtaagtaattacagaattaaatttttaaaattctataatttaaatttatagatttaaaatttaaaaagtaaagatacaaagcagcatagatgaaagtttgaggacaaaagtaaataaaatggtcttactaattttagtgagtatag

SEQ ID NO: 126594 - DNA, 1022 bp, Homo sapiens
ttctgagccctccatcctgttccaacctctgcctattactcagttgctataacagactaccaaggactgggtaatttataaagaaaagacatttatttctcacagttgtggaggttaggaagtcaaaggttgaggtccctgcatctggcaagggctttcttgctgcctcctctcatgatgaaagtagaagtacaagagaggatgagagtgagagcaagaggtggcagaagtcccttttataataaagccattctctcaataacccactcccttgataacaatattaattcattcatgaggacagagcccttatgacttaatcatcttttatgcagcttctcttcccaatactgccacactggggattaagttccaacacatgaactttgggggacatagtcaaatcatgtcattttgtaaaggctttgtaaatgcatttctttttgttttgtttttttgttttttaaaggttctagataaagcagagtatctaagagatatggaagcaaatcttttgcctggatttcttagattacaagaattggtaagtaatgtgagaaagtgctttctccccacaacttaatcaatggattgtgttgtaaaagtttttcattttgctatttgataggtgagaattagtattttaatataattttagtttgcatttcttttatcagtaaagctcagtgtttttttcatagtaaaatcagttggtgatttgatagcatttattcttcaattattttagctttttctctgtaattatgaagtcactgctttctattaaaagttttagatgttgctagaataaatggcagagggccagactttaaaatctcaaggattttaaaattttctttgcatttcaaaataaggataatctaaaataagaatagcatggctattctggatcatctggatttctaccttataatcactcagtgtcagagtttacttttgtatttcagtttactcttgtgttggcttcacaaagtacagtaagtcctcacttaacatctcag

SEQ ID NO: 126595 - DNA, 1176 bp, Homo sapiens
cttgggattacagacatgatccaccatgcctggctgatttctttataagaattctttataggaaaatacaaatttgctttgaatttccataagaaagaaatggcaagctgaaagaaataattgaagtgagtttaatgaagggacagttttataatggaaattttatgggaatcactaagggatgatggtacaccagggcctttaccacctccaggcctgaagggaccatagaaaggagctgttattggaaccaaacaagaggtgtagccttagaagaggggctgtccaacttgatctttggtagaagagtatccactgccaagctagggccactgaggggtcatggtgggagtcaaggaaatcaatatccaaacttctctcccaccattctcccttagtctcctgctggttctttccattggcttctccatccagagacagaaaataagagagtccaggtgatgtaattctgtagctgtcaggctcttggggcatggggtgggtttggtgggatatagatttagaaaggcaaatggagactatccagcacagccattattgtgtttgtgtgttttcttctttacttacagtgttttggttttcgttttcagctcccacatgtgtttgtgaattgtgttgaatgctttacattgaggctgcttttggaacaaattttaaacaaattgaatcatcttagttcttcagaggatggatgttctactgaaataacctgtgaaacatttaatgactttgttcgcttgtttaaacaagtaaccacagctgaaaatcttaaagatcagactgtatatattgtaagtaatttcatttgattagatcatctcttatcttgaaaactgataatttattagatcaattttcatatatttgttttgagtctcattatgtacagtgctctgtgccaggtgcttttagtatacagaaatgtattaaatatattccttatccaagggaagcttcatttaatagaaaaggtatgacacatacatacgactacatgcagaatgtgataagtgattgtcaccagatgcaaaatattgactgtgtgtgtccaatacagcttcatgaggtattagcatttgagacagacctaaatgaatcagagtattctaggaagaaattgaagtagaggaatttcagatagaattatataagtaa

SEQ ID NO: 126596 - DNA, 1127 bp, Homo sapiens
cagggtctggaagctacagcttgttcgtctaatcaaggctgttgcctgtttttgtcaacgaagctttatttgaacacaattgtgctcatacatttacatattgtttatggttactttcatgctacaatgacagtagtgagtaattacaacagagaccatatgggccagaaagcctaaaattaaaattcggtatctagccctttacagaaaatgtttgccaaaccctgacctagagctttcttgtttatttcggcctgcctggtctcctccattagactgcagcctgcttgagaacgtgtccatatttcccccagtgcaacttgtaatgcactccatacagtgagagcattggattcctgattgaatgacaggcattcatccaagaaacatttttaagtgcaccagatgagcagcaaaacctagagattatttatattttatgtggtgaaaaggctatttctatgccgtttcttctcaatacattgatttttttctttgttttactccacaaggtcattttaatgtaatttttaaaaaaaccttcaaagtatgttgagatttttaaggagacatagtctctttgaggaaagggactatctagttcactgttgcagcctccatcctactacagtgcttggcacagagatgctcaacagacattagtcaaatgaattatgaataaatgagcttccttttctggttgcaaataattttatttaaaatatgttgtttgaaaacatatgtacacttgaatttcacaatgttcatagctccatggttaattaaataacaccccggcgtatgtttgtgtggatgatgccaacggatttgcagggagatgatctaaaaagcaagcattgataaaaggagcccattaggccaattctgtatattgcgaagaacccctcccactccagaacaaataatagtattatgattaagatgaatataagcagtctccgtttaaaaaacaggtagtgtttcagaattgtgtttgtatggcaagactttgacctacatttccttacataaacattctcagaaggaatggctagattctactccaaagaaattattgtggggaaagggctttgtttggaagaaaaggaatctgggttcaatgattc

SEQ ID NO: 126597 - DNA, 1127 bp, Homo sapiens
cctctccagaattctccaggacctgaggagtcatggacctgtcttggccaaatatctcctgattataagaccatttgcaaacatgttttattttccttttaacacattatgtggacagtctaattatccatatgggcatcttcacattctactgtccttttaaagaaagatcgtggtgtatagcactttcctttggaatccatgttacatctgttttctgaacttttggttgttcacaagcccacacctgaagaaaagcatgcctagctggaaagaaggtcatggcctctcatttactttcttttgaaaggtatttctaaatgcctggctgactttgatggctcaatttctccacctatccctttttacttattttcaatcatgtataacctaacagaagataatacatgctaagcggtcttataagcatactaattgatattacgaattcctctccaagtggttcttaagcatcaaaatattcaatcaccaatatgttatccaactctatatattcttaaacaagtagcagtttgtacaacctgtctttgaagcattcagaccaaatgaaatgctgctgaaaggaagcctgcttcccaaggcaggttaagcctgcttatcagtagtatcagctattctgagccatgtgtagctaatggcattggaaaggccaagtccaagtttgattcttcaggcagaaggtcactggttgaaattcattctgaaaataaaaagtctagatttttaaagtttctgttggatataccaatgtcttgttttaatagctgccatttctttaatgcctaatatgtgtagagattgaatcctcacagcagccctgcaaggtagacaatgttaccactttattagagaaattgaggattgtgtagctaattactttgccagatatgtgaaggtgcctggatgtaaatactggtctggttccaaatcccacatcctttgcagtccagttgctgccctccctctgtgatgttcattctccccatgcatctatccctccatcttccatctctggagcttccttcaacagacttccccttcccaactcagaagtcatagctttaaactctctttcccactctattgaaaacttccacaattgaatt

SEQ ID NO: 126598 - DNA, 1032 bp, Homo sapiens
tgtgagtgaagccatcttagaacctccagcccagcccagtcattagctgaataccatgcatgatgccatgtggagctgaagaattgccctgcggagccctgcctgaattcctggtccatgatattataagcgtgatagaacggttgctgttttaggtaattaagttttggggtagtttgctgtatgataatagataactggaacaattttcagtaataaagtcacaaagaacatgaatatttaagtggcagacagaggaagcaaggccttcaaagcaaaataagtagtaaggaggaaaacaaggagagtgtggtgtcatggaagccaaaagaaaggagtacttcaagtaggaaggagtggttatcaatgtcaaattctgctgaaaagtagaaaagtatagggactgaacagtatcctttcgatttaatgccacagatgtcactggtgacattgaagaaagtctgataagttcagaagatggtttgcaatgagaaggtagaggcggaaggagaaagtaactatgtcaaggagcttcatgatgaagaaagagggtagatgcaggttgagaaaaggtttttattttacagttagtagatgcgcaaatttcagtgatgttgggaaaaatacaaaatgcaggagagggtgaagagaggcactgggcaaatagatacagtaagtattctgcagaaagcagaggggatgtcccagtgtgcaagcagaggaatttggctgacacagaaggagggacccctcttccactgtgacaggagagatgggaaaaatgatgagatagaggaagataaatatgtaaatgtgtagcagccataaggtgatgggctactttatctgatggtgcttatttctcctgtgaagtaggaaacaaggttgtgcactgactggttggggagttgttgagataggacatttaggagaagaaaaaagacctgaaatagccactgggtgggacagtaggggaccaagcagagaaacaaagaaaatttgtatccttgggaatggtacctatttctgtgg

SEQ ID NO: 126599 - DNA, 1044 bp, Homo sapiens
attacaggtgtgagccaccacacctagcctatgttgtctatagttttatcaaggacagactaaggtatattggaattaaaaaaaaagtagattttaaccatgaaggtttatttcttgctcatctccatcatgggctgactgggggctctgctccatgctcctcatttggggatgtatacagaaggagcagctaccacctgagctgctctgcattaattagtctctaatgcagaactaaagatagctaaggaggcctcatttggccattaaagtttctagcctgatggtgacatgtgccacttctgctcactactcattgactgcaacaagtctcacagccccacccagccactaagagccaggaggtacaatcctatcatgtgccaggaaggtgggaattcagaaatgctgggtgaacagcattagtgatgatcacagtggcccatgcagtgtgcatctcctctttctttttcctaggagattgctgactttggttagttttctatctctcctccatgctgaccattaatttaggcaaagctaatcccattttctgacaccaggagtggactttgatgcacttaagccaaacaaaataatacaaactaactgtgattgtttcaggaaagaagacgagatacaattcaggctaatgagatgccatgcaaggtttgcagaagcttttgggaaactttcttttcatttttttaggatatgttctgggagtaactcccctgctttccctggatgtgtgcgagaaagcataggcatccactttctgaccaacaggagacccagtctcaggatggagcagacaccatgcatggtagagcagagagacagatacaacctaggtccttgatgaaatgattggccactggatcagccacagttaaagactgcctacctttggacttctggttatcttaggccaaaaatgtcctttttgtttaaggcactttgagccgggttttctaagacctagcagtctcaaccatccaaactaataagctgaattaactagatttcctgtcatgtccttcc

SEQ ID NO: 126600 - DNA, 1051 bp, Homo sapiens
gtgtaaacattttatagaacaattatcaaagctatattggacttaaatattggtcatgaatgtatgcacaccccataggtagctgccctccttgggcagcttttgactcctatgccaaattttaaaataaaggccgtggccaggcgtggtggctcatgcctgtaatcccaacacttcaggagtccaaagcgggcggatcgcgaggtcaggagatcgagaccgtcctggctaacacggtgaaaccctgtctctactaaaaatacaaaaaaaaaaaattagccgggcgtggttgcaggcgcctgtagttccagctcctttgggaggctgaggcaggagaaggatctgaacccgggaggcagaccttgcagtgagccaagatcgcgccactgcactccagcctgggcaagagcgagactccatctcaaaaaaataaaataaaggccatatgtttaatcacattccccaaaaggagaacttcataaggcactaatgagtaatgtttattttacgaatgattttacgggaaaaattacagaggatgtttaaattgcaaaaatactcctccccttttttctcctccaccgccccccaaaaaaaatcctttgcagttatcacctaagctttttgggtgtgtgatttaaaaaaaaaaaaaaaaaaccacaagacctaccttaacaatttaagtatgcagtattgtttcttctcagctgcccagtctttgtaattcttatttcttatgcagaacaatttagcatttgaccctactatcaccaaaaaaaaaaaaaaaagaaaaaaatatatagcagttgagggcagtatacaagcttagtaagtatattctggtacttgcttaggaagtaggaaatgtgatcagattctgttctctaccatatgacactgatttgcaaggccccgggtacaggactactggtaaaaagaaccctgtaacttcctgtcacagagggacacagcaatatatataaaacagcatctgccgtaaatctttggggaacgtcttactagatttaaccagctaattttactaggtatt

SEQ ID NO: 126601 - DNA, 1019 bp, Homo sapiens
tctcccacgctggagtacagtggtgcaatctcggctcacagtaacctcagcctcctgagtagctgtaactacaggtgcctgcaaccacacctggctaattttttatttttagtagagacagggtttcaccatgttggccaggctggtgtggaactcctgacctcaggtgatccgcccacctcggcctcccaaagtgctgggattacaggcgtgaaccaccgcacctggccaaaatttggtactttataactcaataattgcaaccagaccagctaactttttgaaaacttggggctctgtaatgttcagatgaaggtaaatgtagggaatagaccctctttagattgagggagtaggagttttgacatcacaggtcgtttggacttaaaggtatgaatttgaaagtagtttggttatacatgtcctttgcaacctagcctctctttcattagcggaattaattttggtggagggattcattcatattgttagtatgtatcgagggaggcattgtataccagaaggctttgaactggttgggagaagtgttcttataagaacagggtaattattaatcataataatctttgtcaaggtgcctaagtaactcccttatgtaatagcagccagtgattagatagcttcacatcaagcaggttggatttgttccttttgaatcaaagaaccctttgcttcataatctaggtcttgtgtctcaccgaatcctttataatatagaataaatggttgaaaggaaaggctcacattctgtattcctgaaattcaaataggataactttctcaaagttttaggatagaccaaataatgtatgtccatgtagctctaagatatgagtcaacaaagcaaaataattatgaaactcttgtgggatttttggtagagtttttatggagatccagtgtatatgagaagcaaactaaagagagttgccaagggttttagagccagtcaaattcctagactttaggatttgttgaatgaattgaatggaaaccag

SEQ ID NO: 126602 - DNA, 1090 bp, Homo sapiens
aattacttttctttgactgccttcatacattcatatattctgcctgggcaatttcatttgggcctattatgttccaatacctctccaattttcacctccatcttagctctgccagcttcagtgccacaggtaggcaatgtaaaagtttactggggaccacaggctttctgagctcaataaaaatactaagcttggtacttgttttttaagaattttcttcccccatcccctcacaaagattatttgagtaaattacaccccaacctccttttccttgtttttgttgaaattattgtctcttaactttggaacattgcagttgcggtaagcttactaggttcacatagcatatcttctggtgtgttaaaattaaaatgcacaccatctcaaaagtgctatgccatttcatacctttgtgcttttgtcctgctacctggagtgcgtctttctcacttctggataatacaatttgaaccttttctttgcctcttgaaactgcaaaatccctactcgcaagtaaatgtgtcattctttatgttgataacccagcctagtgcttgacacttgatgggcattcaggtatacatggttttttagagattgataagattaactgtgcagtctataaactgtaaatactggcttttaaactcttttaaaggagctcttttgataaacaatttggataagagatgaaaggttagggaggctccaggcaaggcagaagactgctgatggcccagagatagttctgccccaaaaaggtgggaagaagaaaaaaactgagctggatatttttaaggaaatatattttatagcatttttctttaatgcctagttttgctgcaagcactgaagtttatcctgcatttgtatttcttatttgaaaaagaaatggcctttggggtttgttttgttttttgttcctttgtaagcacactgcaaaagcggcgttgtcagcgttgtcttttgaggtatcaaacgtgctttcagtcagcaaatatcttgtatatagtaccattcctaataaactaaattggttatcaacctaatacaaacggtacttcatacaacttaagcctaaactaga

SEQ ID NO: 126603 - DNA, 2509 bp, Homo sapiens
ccagcgctgggtgaacccggttggggtgtcactcgacgcccactaggggctgaggaggctccagtgcgcaggctccgggcaccggataaaagcggagctggcgagtctagtgctgtctcgatggaggagcaagaaacggaagaggtcggggggagaagcagccggaaaaatgcagccaccgtcaacgccgcctccctgccaccgtgcttcggggtaaaaagctgccgttgccgtcggtgcagttgccgtcgctgcctcctatacttctcttggcctcggggaaggatttccccaccggtgggacaatgtgcggggaggggagtgggaattcctttatatggcggtgattaaacgagggagggacagacagtgatctcgaagaaaaaagggggagaccaaagaataaaagaagggtttccccactaaaatgacacggcgattccggctcttgttttgggggtctttccccgaaatggtttccgtcttccccttgccccgcagcgacccagagcgctgggggaagcggagtggggagaggcagaggcggtctcggcagccaatcagcgcctgatgtgtcctgtcgggcgcgtcgtggttggctggcgatgacctcatcctgcagcagcgggtggggccaaagccgtagggggaggctgttgcaaaggtagagagggagaagtgacgatggtgatcgttgctgccgcggccgatatggaacccaagcagtggcgaagggaatcgcaaggctcttccctgaccattttctactgtccctgcgcgaggtgagggccccggctcggcctctgcaaaactttggggcgctggcgcggaggaggagacaggatttctcccgtgacttttgtaactgcgtcagggcaagatggcgctgggtctctttggggcgcggggggagaggcacgtccaccgccgcagcgcatgtgaccgggctgcattcctgtggggtttggctccgacccaggccggggcgggggaggggacagggcttgggcggaggagactgtggtgcggtcggcgttggcggcctgaagaggaagagatgactgttggaaagcgttcccctcccccatacggcagaacagctgcggctcccaggggaaagcccccgcaggacagtcctcgtggggtgtgacggctgttggtggagaaggtttggcgccctattttcttatctgcctttctccccgcaaagtatacttatgtaaggtggtagttccctgacgtgggactcggaatcaactaggagtccttgagggcctctgggaggcctagcgaggggtagaccagcttctgggggtacaacgtcaaggaggatcgattactttctgaggaaacagtttctcagattgaaatagaaaagtatttccaaagtttggaaacaaatttaaaggtgtaaataacacccaggaacactttaattgctttgaaaaggcataagcagccatctgaatttaagggcccttttcagactcttccttcctcctgtgattcctgttctttatttcagttttctgtctgtacatcccttaagaatatagttttgtcggtgggattcgctcttttgtgcccaggctggagtgcagaggcgagatctcggcccactgcaacctccgcctccccgggttcaggcgagtctcctgcctcagcctcccaggtagctgggattacaggcgcccacaaccacaccctgctaattttttctatttttagtagagacggggtttcaccccattgaccaggctggtctcgaactctcgagatccgcccgtctcagcttcccaaagtgctgggattataggcatgagccaccgcgccgggcctgctttttttttttttttttttttttgcactgggcattagtaatacggaataaaagccgtgttttaaactgtattaagttgtaagacttttcagtactttcaagtctgctttctttctgttgcccttttgtagtttttaaaaataaaagatgcaattataagcacttccggtgaatattattccttaaggttcctgcatcatcatgaaatttgaagcacttttatagtagtacaaactatacttttagcttttgaaatctcgataggagaaaatatccagcagttttaggggctattttggcatattcattaaggtagactaagtttgtttttcgtttttcccacttagccaaactagttaaagtagtcaaaactagcaaataatttttaaagggcttctccttttgggtggtgtagagggtggggagttattcaacaaacacatttgcagccaaaatctggcctacttcttggcagagcgcttatacttggtgctacgagaaaatgattgctggacctgaaaagaacctgaggtcaaggttgtgctatttccttaagtcttagttgtaggctcttggtagtttgaaaacaagattgggtttttaattcatttgtgtatccttaaatcctcactagtttttgtggatttcttttttcagttataagcaact

SEQ ID NO: 126604 - DNA, 1135 bp, Homo sapiens
caccgaataccgacacttcctcaaaccttcggtggattgttgaatgcatctgttgtcagaaagacagagattccgtccccctcaccgcctccagtttgctatcttcgagcctccgcggagaggcaacggcgggcggcagcccacaagcaaaatggcgccgggcagcttcatcccctccccctctgcccctgcggagcgggacgggcgtaccccgtgcacttgccgccgccgccgccgccgccgcggccgccgccgccgccgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacaggttagtgcctgtcgtctccatgggagttcctggggcttgcggggttggggtacttgtgtttcaagggggagggaggtctctcatctttatccttaagctgggggagccgacgttgactctcaggtgtctttgccggcgcaagacgttgcttgcttaaatcgaatttattctttcttctccctgaccctagaaatggagcattatggcgggttttagggttgggaaaggggtaactggcagttaaacccccttgagagtgggggagttagggagggggcgcactcctcattggcagcgggttaaggccgcttgagtgaagacggaggcttgtgactgttagtagggtttgtgtcgaagtggtcccaggagctgccagcgctcccttttctcaaccgcgtcttgttcaggtgctgaaaagccatataggccccattttcttcttccatttcttgacgggcagtctctggtataatgtgcacatgaatacgaagggggtaagaagaacgccctgggcatctctctttgtggga

SEQ ID NO: 126605 - DNA, 1250 bp, Homo sapiens
tttggtttaatccaaccatcttttattcaatatgccaaagtagattaaaatgtttagtaactgtataagtatcatctattttatatgattaaatgtttcaatctagagtaagacatttcccaaccacctcttgacccattttgtggattttggtttttgtattgtgttttagcttaaattttagggagctgtacaaacaagcttaaacctgttacttcattgggtgtagagatgccattatattttgccatccatttttcccatgtatttaagctttccttaagaattttcaaagtttattgtgtatttggtaaagtgaagcttcatgctgcctttaacaatcgtcttacagcatactatcatcattatgtaagttaaaagtaaggctccgattctggatttttttcctcttcaaatatgcccatttacctattataggattgtggaatttagtctgttttaatagaccttaaataaaaacattaccataatagggtcttgaatccattttatgctattttcagaaacttacagactgagactgaaaattaaatggtgtcaggtgtcatttaactgaattttttaaagtgtgaaagattagaattcactttcgtagtgggagttctttttgggttgaactaagcagtgagatgtgagtgggccattaatgacatttaatgaccattctgattgtggagcaacggaaagatgagtgcttttcaatccagtagtactttaaaaggttgaagagtatacactgtttcatgattcttttattccattgtaaatattttagagcagcatttacttcatatggtgactgtatcaactaggttgataaggttctagcctacgaaataattagagaaataactggctcaaggattttctacataccagtgagcttcatcatggaagactgagcacacaaccttacttagaatatttgaaatattttattataaagtgaaatgttggtgggtagtgggcgaaatttgtgtagggttttggggtcagtactcatttgtattttgatctgagcaagtatttaagtccagatcattcactgctgtgtaaagattgtgcatttattttaaaggctgggtgattaaggtctgtggttcagaagcttggtactttaaacttactattcaatatacaaaatcagtgtattcttaaaaatttgatttatgtggccataggagggaacactgcctgtgcccgatggttttcttcatagagaccttggt

SEQ ID NO: 126606 - DNA, 1626 bp, Homo sapiens
agagcctacattttgatcatacatcctttcgttgtcagtgtaaatgaaaggatctctctgattccagtttaagtgtagagccttgacaggtctccatttcccgtcaactctgtaagactgataactgccctacaattttggctcgtctgacttcctcacagcttccagagagaaatcattgccatatatgcccccagtaagctctaggacttcttgagtctattgaggcagtagggagaaaagctaattaataggagaaaaatttcccctcagtacatatcttagtggtcttagggaaattataatttcttaaattggcttcttaatttccaagaataatgtactcgttttcattcatcaatcttctaaagaaacctgtggtttaatttttaaaggtgtgttttatgtaaaccctaacagctctgcatttctggaagctactactactgggacttaaatgtgtacaaccatagtgtgtttaaaatgtgtaaaactaacagaactttgaagagctatcaaaactggttaggaaatactagtatgcagttttctcaacagatgctattttatgtttactattttaaaaatattttaataatgtgtaaaagcttttatctccaaaggatttgtttttagcagatggtaggtgcttaattatttcttggatgtgaatcttttattgaagcaaacacatttacatctcaaatatgtagggtgatcagggactgttccctgttatgtgttagaataaatgttaaatacttgtattctgtgagacttgtttcccccaatttcatgatagattatctatgagactttttaatattgaaaatataattattttatggtaaaattaatttttatgttgactggcaaattaacgagtggaatactatttgaaatattactctgtgaatgttactggcttttaggctgggtttaaaattgaagtggctcgtatttactacctgttctgtaatgtgcagatgttgggaggagccttatttttttcttgacattgaaagaataattttttgtattacctacaaatttacttaacatggaggaacagtatttgttgttgaaattgttttctacactaaactggaagtggatggtatttaactaaaaatcttgcaattgctattaaacaatgagtattttgcattatataaaataaacagtattttactttgtataatataaaatgagtattttactttatataaaatactctgtttaatagcaattgcaatatttttaatagcaattgcaagagataagaattaaccatattatgatgcaaacaaattgtttttttgttattgtgaacttccatgctaagtgctacattaaaaatcaaatgaaggtgacccagagtaagttaattagattttaattcatatctttaaggataaaagaagtttttattaaccattggtaactaggatgctttttacttaaatcagagtcaggaaaagcagttggtcttatatttcacgagataacatgttttcacttgatatgaaatcagttctttttttccctcatgaacagctcataattggattttatttttggacagaaaaactttttttattgttaggtgaattttacagttttatt

SEQ ID NO: 126607 - DNA, 1286 bp, Homo sapiens
gggaggagggaaatgcttaaacaatactaagaattccattctttagagacaaattacttagaagttgatagtgacatattgaaagggttgttgattgttggattattcaggtgatgaagatgatggtaggggccatggcggctgagggagaatgagtcttaaacactgaggaggcacaaaagattgggtggctggatataataggaaactggaacgaaagaaggagaagagaatggcgatactgataaaaaatagaatgaaagaagatgtgtggaaaagaaagtttcactttgaaggcttgatttttgaagtgatggcagatatagatatacatccaatagatgagtgggaaaagtaaatcaaacagaaatgaaaaattgagtccaagattgatgggagactaataatggggaggactgagcctgggggcaactacattagtaacagtggcaggttttgttttttcatgttcatttaaaggaaggaggagagatttatgtgttagaaaaagggaaattgtggtttaatcaataataatttaggtgggtatcctagccactgaattacaggctttgaggtaatatagaaatacctcagttcttgctatggagtcaaatagatgatctaattgtggaagctatacatttagcagctgttctagaacaatgtctgtcaaaatataaaccagtagttaatgtaagtagtgcattctttaggaggttaagaagggaagacattagtgtagaacaagttttatagctggagaagtcttttgagataaagtctagtcaaattgttatttacaggtgaggaaacagcccttaggaggttgatttgccagatatcttaaaactatctaaaaaaattgggaaggcttcaaggaagcattggttcttgaaggtctaatatgatttttattgggtgggaaagaaaaggaaaagaaaattagtgaatttgaagaggaatgagcaaggatatgccaacaatagcaaaaaagacttgcataatcaaaggagttatagattggattattagtatggaacaagataacctgataaaatgtcaacattaggaacttgactggaattactgtgaactacactttttttgaataggtcaaagttatgaggaaactagtggcttttgaagtataatattctgtccaatgttgtaaccagtactaaaatagagcactggtgtgaatgcccttttagttttttgataaggcattcaggccacatctcagacctactacatgagaatctctagggtaaggcctaggaacc

SEQ ID NO: 126608 - DNA, 1010 bp, Homo sapiens
ttaacacggtcttaaaggcagcttcagtcttccagtttttctgataaactgttttctactttaattgctttttttgccttttacttcatttttcctacttgagagtcttgtttgtttttattgtttttgttttggtattgttgcctttgctaaatctgtttttaatattgtattaaaatttatttttcagttaaacatttttaaatattaaatttaatattgtatcccagtgtttctttttccagtttgatttagtatttagctttgattgttgcctttacttgtgtttacattcatttgtgtaaaaagggaagagtaaatttatccttttaagaattggctgctttgtgtgagtcactttggttttaggtaccatgtcagttagaagtaattataattttatgccatttaaaaatagctcaaaactcctatgttcacttggtttctaggtctattctggataagcaggttttgtgaagacatttattctttcttggacctcagatttaccagacatctcatggtatttccttttctattatttctttaatggctgccatttattctcaatgtattttgtacatattttacttgtcagctggatgaccagttttttgattcacacataagatgtgaaacattgtgttaattgttaaggttgtgttaaaaaccttttccctttatttataacttttttttttttttgagacggagtctcgctctgtcaccaggctggagtgcagtggcgcgatcgcagctcactgcagcctctgactccctagttcaagcgattctcctgcctcagcgtcctgagtagctgggattacaggcacatgccaccaagcccaggtaatttttgtatttttaatagagacagagtttcaccatgttggccaggatggtctcaatctcctaacctcatgatccacccgcctcggcctcccaaagtgctgggattacaggcttgagccaccatgcccggccagtttttgactgttttttaaactcac

SEQ ID NO: 126609 - DNA, 1692 bp, Homo sapiens
ttaaaatgaataatttttggttcttcactaaatatgccgtagtaatcttcttgtggcattctaaattcattccctcagaaagattgtgatttagaaacttttcttttgatcatgatcacataactcaattccagaaaaattaatgagagagactctaagcaaatttcaatttatattgagattttaataaagaatgttttcttcatgttattttacttactgttatagtgtgactgttgcttttttgtctccttttcttttaaacagggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagagtaagtatttaaattggttacataagcaaaaaaaaaaaaaaaacccttctggagctagaaagtaggaagaagtataagtggaaaatattaaatttcttctttcctagccattttttaaagtaaaaaaaaaaaaagcgaagttacctttctttctcaaacactgagaacgtgattgctatctttgttttccttttaaatagcattaccactaatattcattattggattgaggtattgacatgacttattttgactccaaatttctgagaagcgatacattttttaccaactgtattttcctatagtatttgatattgttattccagtgtcactagagccacctgctgacaggagtcattaatttgttggtgcttgggttccccccacccccagcaacagatggagttttgctgtgtctcccaggctggaatgcagtggctctatctcagctcattgcaacctctgcctcccgggttcaagcaattctcctgcctcagcctcccgagtagctgtattacaggcgtgtgtcaccacgcccagctaatttttgtgtttttagtagagatggggtttcatcattttggctaggctggtctcgaactcctgacctcgtgatccactctcctcggactcccaaagtgttgggattacaggcatgaaccactgcgctcagccggtgctcgggtatttttagtttgaatttgtataattgaagattctaaaatattttgtatataatgaaacattttcagaaactttttacttgttcttttttcatccagtgcttaacatttttgcttgtgatttcttgacacttaatcgactatgaagaaactatttttttttctgctgcttttaaagtgagtgttgatttgtttgtactaattggaggtgctttcatttaagcgtggctttgtttttgtattcaaaagcctgctttaaagtactgtccttgcattgtttacaactgttctttttttgttgtttgttttgtgacagagtctcactctgtcatccaggctggagtgcagtagggcagtctcagctcactgcaacctccaggctcaagggattctcatgtcttagcctcctgagtagctgggattacaggtgcatgccaccacacccagctaatttttgtatttttagtagagacagggtttcaccacattgaccaggctggcctcgaactcctgggctcaagcgatctgcccaccttggccccccaaagtgctgggat

SEQ ID NO: 126610 - DNA, 1047 bp, Homo sapiens
tggagactcttcacaatctcctttagaaccattagataacctcagtttgtatctcctctttttgctgattctggcacacagcgcttacaacagcagccactgagagctaaattgagacttcgtgaagggatgacagtatattaagaagcagttgactgtaaaaaatgttttttatgctgctagtctcatgactaatcagaatataaccactaaatatccttaaactaaataatagtgcaaatagtactaagttctaatgtaaagttttaataggaggtaggataaagattgtcatgaaaaatttttcaagtgatgttatagttttgtaaaataaaggcacagaaacaaatcatgttattgagtatttgcaagggagagattaattttagtgtgaactgacctcagatgtaggttcacaaccttgttgatcaataggaattaaccaagtagagctcaggaggattggtaagagtaaagaagttgggaaagtgatgtatgtaaaatgctaggccagggagcttgtaagtcaacaacagtgggcaaattgtatcagtagttgatcagtctccatcatctaagaccagaattgctcatcttacagatagctgtttatgttttttttcaggtataaatcctggtttattttgaaacttcctattacttaagtttactgacatttccaaggctttattatattaatatctggtcacactcaacacatgcatatatttttgaacactgaaatgcatacttcagttccatttgaggtccatatagattctgtgtgttttagtcttgcttaaattatttctactacttctttgcacccctttgctagttttctcagtgccgtagggtttattaaataataattggactctagtaattttttttaatgagagagagggaaactatatttgaaattggattgggacatttattttacttaaacagaagtttgcttatgacacataatctagatgggatatatcttatctatagtgtatccacctgctgtaagtagatactgtatttgtatagccatta

SEQ ID NO: 126611 - DNA, 1029 bp, Homo sapiens
cagcaggagctgtgctgtttttttgttgttgttttttgtttttgttttttttgaaatggagtgttgctgtgtcaccaggctgcagtgcagtggtacgatctcggctcactgcaacctccgcctcctgggttcaagccattgtcatgcctcagcctgccgagtagctggaccacaggcatgagccaccacaccctgctaatttgtgtgtgtatgtgtgtgtgtatgtatgtatgtatgtatgtgtgtgtgtatatatatatatatatatatatatattttttttttttttttttttttttttttaagtagagaacagggtttcaccatcttggccaggatggtctcaatctcctgacctcgtgatctgcctgcctcggcctcccagagtgctgagattacaggcgtgggccaccacgcccggcctgcagttttgaattccaaacagtaatggataagcatgcccactttcccaagcctcacaacagagtgtttgacagacttgcatttttgccagtttaattaggtgagaaatggtaatctcagcatagttatggtgtgcatttctcttactttgagtgaggtgtctctatgtggttttgtttccctttgatagtagtcttttgccagataatttttgatggggtaaatatctgatgatgaattcagtaaaagttggttaaaaagttaccattaggaggccgggcgcggtggctcacacctgtaatcccagcactttgggggaggcccaggcgggtggatcatgaggtcagaagattgagaccatcctggctaacatggtgaaaccctgtctctactaaaaatacaaaaacaagagttagccaggtgtggtggcgggcgcctgtcgtcccagctacttgggaggcttaggcggcagaatggcatgaacctgggagttggagcttgcagtgagccaaggtcgcaccacggaactccagcttggcagcctgggcaacagagcgagactccgtctcaaaaaacaaaacaaaaaacaaaaaaacttaccattag

SEQ ID NO: 126612 - DNA, 1063 bp, Homo sapiens
ggtaataatggaatagattcaattcagtgtcatacatttgctttaagaaatttaatttatgattttaattacatgttaacattatgggtttttttttttcagactttttgctttaaatattctgtttgaaaaaaatactggtttcctaagtaaattattttcttggccattcactgtggctcacatctgtgatcccagctctttgggaggcaggggtgggaggatcacttgatccaggagttcaagaccagcctgggtaacccatctctacaaaaaattaaaaaattagcccggcatgatggtgcaggcctgtagtctcagctactcaggaggctgaggcaggaggatcccttgaacctggaaggttgaggctgcagcaaactgtgattgcatcactgcactccagcctgggtgatagggtgagaccctgtctggggaaaaaaaaaaaaaaaaaaaatcagagtgaaatggagtcatctatctggcatctactgctactattagattgtatgtaaactgtattgcaagggattttgtatatattttatactgttggtttttcactgagaacattaaataaattaaaaagtttatcacatttaagacagatctgcttcatgtatttgataaataattatgctaattttttaatgtaggaatttggataaagagagggcagtgctactacaacgccggaaaagggaaaatatgtcaggtaggtaaaaaggacctacactaaattaaaattcgtgtgattgagagaataaacggttctctcaacttttagttaaatgtaaatatttttagttaaatgtaaataccttgttgatgaatgttgattgtacagagagtatgcaatctctggtatagatttcaagtattttttttttcacgtattatagaataaatatgtactttgggaaataaaatggaaatgagaggaaaataaataatttaaatcagccataattttcctacacatagctaacctgttggtttaaaaaagtaaaatatgtttgttcttcagaaagatatgatccattagtttatcatgtagaatagt

SEQ ID NO: 126613 - DNA, 1010 bp, Homo sapiens
agttaaaaaatgtgcttatttagaaagatggagacgacaatactttgtcatatggaatgctgttttatttcattgtttaaaatagaagtattaaatgtgcaataatttttattttgtctgaagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggtacgtttttgcttgtttttaggtgagtggataggatagcggatagggaactgaattttataggagaggcaggagagtgagaataatcgatgatagctaaaaaggatctagcagaagttttttatttttaaacaattaaacttacttgaacattttaacgtgttttaaagattgaagcagattagagaagaaactttgcaaactgctttgaaatcatttaatgagattagtcactataatgcagaagcaaaaataaaatagaaagccttcatagttttctgtactaccaggattgtattcctttcacttgtctgtctgacataatccacttagcttttcttccccatgttttacataacggttctttgcctccttttttttttttttttaaaccttgctctcttgtaacgtattgtctacacacaaatttatttatttggatctatattgctagctgtaggtttgtatttgttagtcactctaaatggagttcacactttttagggggttgagggggataggaattaagtcttaaatacatccttcagatctggcagatgagtgggctctcgatacatgtttattgagtaaatacagctctgtttaccacagtgcatattacttaaggcccattatgggctcaaatattacttgctagttgcttagagaattaaagtaatatcattattttactccctcccaaaacatgtctta

SEQ ID NO: 126614 - DNA, 1025 bp, Homo sapiens
aagcgaggctcctcgcctctgtctgaccccaaaacataagtttgtctggggtcacagaggtcagctgtatgctgttactatagttttctggcttaggtagaaaaggataacaaatttctaaaattgtcacattaaataggatgtggggagcatgttacagtgtatcttttgtccctgtggtatttattattccacatttctggaaaagaaaccgttaaacagcagtttctagtttatattatgttcttttgtatagattgccgttaattttgtgtgtgtgtgtgtgtgtgtgtgtgtgtgtgtgtgtgtgtgtgtgtaagtccgtaagtccagatactaaagctcagtttatgattttagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagaggtaaatacatcatttgtccaaaaattgtaaagcagttttatattgtgaatttttagttaaactgaaaacaagcaagtttatttaatctcaacatttactctgattttagagccatatacaaaagaataagaaaattcttaaatctgcaaaagatttgcctcctgatgcacttatcattgaatacagagggaagtttatgctgagagaacagtttgaagcaaatgggtatttctttaaaaggtatattcatttattttcccatgttcattttctgtaggtaaatattgaacttttggctgttttacctagatgttgtgattatatgtactttttttcctacatgatcatttcagtatttaaagctgtagtgtggttgaacagtgactgatgataatttttgaactacgataaactaaaacaacataaaaaaatgc

SEQ ID NO: 126615 - DNA, 1051 bp, Homo sapiens
gtctcgctctatcagtgaggcatgatcatggctcactgcagccttgatgtcctgggctcaggtgatcctcccacctcagcttcccaggtagctgggactacaggcacatgctaccatgcctggcctttttttttttttttttttttttttttttttgtaaatacggagtgtcgccatgttgcccaggttggtcttgatctcctggactcaagcaatccacctgcctcggcctcccaaagtgctggaattacaggtgtgaaccagcatgcccggcctaaaatgttaatagcttataatgtttctttctttgtagaccatacccttttgtgttattctactctaaatttcatgggctagaaatgtgtgttgatgcaaggacttttgggaatgaggctcgattcatcaggcggtcttgtacacccaatgcagaggtaagcttatagaaattttttggggagatgtgggtgctgggggtgtgttggaatctgagcaataagcacaaaactcaggtcactgacctaagacactttccacctgttggtgcattttatactgcccagcctgtttttttgtgaaaatttatgtgataactggctatgaagtcttttttttttttttttgagacggagtttcactcttgttgcccaggctggaatacaatggcacgatctcagctcatgtaacctccgtcttccgggctcaagtgattctcatgcctcagcctcccgaataggtgggattacaggcacgcaccaccatgcccggctatttttttgcatttttagtagggacggggtttcaccattttgaccaggctggtctcgaactccggacctcaggtgatttgcccatctcagcctcccaaaatgctgggattacgagtgtaagccaccatgcctggccgctatgaagtcttaaaaattactttgcaccttgaagaaatgatgatgctccttataagaggaaatattggacttccttttttttttttttttttttttttttttttgaggcagtgtctcactgtctcccaggctggagtgtggtgtca

SEQ ID NO: 126616 - DNA, 1015 bp, Homo sapiens
tctcaaaacaacaacagcaacaacaaaaaaccctaagatgccaccagttataagactcctgatttcagagatgctaaaaggtgaaaaaaaagaattgatgaggctgggtgcggtggctcacgcctgtaatcccagcacttggggaggccgaggccggcacatcatgaggtcaggagattgagaccatcctggctaacactgtgaaaactcgtctctactaaaaatacaaaaaaaaataagccgggcatggtggcaggtgcctgtagttccagctactcgggaggctgaggcaggagaatggcgtgaacctgggaggcggagcttgcagtgagccgagatcgcaccactgcactccagcctgggcgaaagtgtgagactcgtctcaaaaaaataaaaataagaagaattgatgaaatatagtatttttattattattattattattattattattttgatgccacattgtgggctctaggggttggggtggcagtggatagcagtatatgattgaaaaaccttcccagttgataaccaccaatagatagttataagccttgtcattaatgacatattttccaggttgtgtttgtgaaataatttgaaaagaataattttcaaaattgtaagctgatgcttctgaaggcagaaagtaatttatggtaatgtacaattattttaacttttaggtgaggcatgaaattcaagatggaaccatacatctttatatttattctatacacagtattccaaagggaactgaaattactattgcctttgattttgactatggaaattggtgagttcaagtctataaatgtaatctgttgtttgaaaatagttccataatgtccctgtaataatttaggtattgtcattacttttatagctttttatttttatctatcatgaatcagttaaaagtacttgaaaaccagaagtttagtatcagcctctattacagcattgctacttttcatttctacattttccttaattattattgtaatgtaaa

SEQ ID NO: 126617 - DNA, 1048 bp, Homo sapiens
tattatagtctagtctggaatttttataccaccacaacataaacttcatgagggaaaaaactttcagttttattcattgttgtagccctagctcctaggggaataaaaaatggtgggcaaaaaagtagaccatcaataaatgagctaactgaatgtttataacaaccacttgaggaaagatagacagacagatacaggcccatgaatgtgaactgaatgaagcttccctgtagttcaggtaatggatgatctggaggccttgccctgaattgtgcaggattccccacaattttctcggctttcatccttcacatcaagtattccacgcaagtataatttgagatgctttgtgaaaaagagccgtgaccagtttactgtgatgagcactatactatattcttccttttcagattaccagtgtacatgtgtttaaaaacttgacacaattgtcagattttcctaaacttgtatacccttgcagtttcttgtggataacacctttgacccccacagagtgttattcagtggaacagactctgtgggaaaacactgcagaatccatgctgttactaaatgtctctaggaaaacttgactgacttcatttagaaaatcactttagaatatgcaatgctttaataataaaataggataagtttgttgccagaaaagtcatctggtgacaggatttgagatgttatccaactccctgttctgtcctccgttgatgctgattttttttgtaaggtcctgttttctctaattgtagagactgggaattttatttctaaagataagtaattaatgacattgtggtgttagtgaaagggaacctgtttattatttttttcattttttttgagacggagtcacactccgttgccaggcctggagtgcagtggcacaatcttggctcaccgcaacctctgcctcccgggttcaagtgattctcctgcctcagcctcccaagtagctgggattacaggtgcccaccaccacgcctggctaattttttgtatctttagtagagatggggtttcaccatgttgg

SEQ ID NO: 126618 - DNA, 1127 bp, Homo sapiens
ctttggaaaggatcagcacagccaaaactgaagttaaaactgaatgtaaagatacacagattgtcagtgatgctgaagttattcaggtattatttattcaggtcgttttattttcttaaacactttaaaataaaatgtctatacttgcattaattacttataaggaatttaaaataatgtctattagctttttaatagcatttttcagatcctatgggagtttcagcttgagataaaagactatatattatctctgttctttattatatatcagaattcaaaaattccagaaagttggcttctgaagtagaataatgctattatatttaaactttatatatatgtagtataaaaacttccattcgcttgtattttgaattaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaaggtatgattctaatgaatgtaagaactgtttttctaacagtttcttatattaattatattgttgttttaaaaattggatttttaagacctcataataataagaggcagtttttatacttgcagattttaaaactaagaatgagaattccaaaactgtaaaattaatataaatgtttgcattactgtgaagataaagttacattcagtttatcaggacttttatggtattgcaattcatgatttctttaaataagtttgtctactttatgtacaaaatatatacttctctgaaactggttttagatgtgttatcctttatatttttataaatttcattgtataggtagattataagaattaaatgtgaagaaattgatttccacagaatgtactatgaaaatttgtaagaaagagtagttttaggtgtaattattaat

SEQ ID NO: 126619 - DNA, 1108 bp, Homo sapiens
atatataaatgtgcatatgtatatatatatacacacacacacacacacagaaacacacacattttaaaaatctacccatccttttttccaaaggtaaccactgtaaacattttagcatcttttctgtccctctctgtatatagaactccattcctaggactgcagtagtgaaacacatggagtctggagccagactgccaggagggtgaatcctggctttgccatttacactatgaccatgagcaagttaagtaacttttttatatctcaatctttatctgtaaaagaagggttgtgatagaacctagttctataaataggattgttatgaagattaaaagttcaataacatacataaagctcttagaacagtatctggcacagaaaaagtgacatgtattattaaactgaatgaggcctttaggggaaatcatgataatttggtactctgtcaaacagtatgttgtttaaaataacaaaatctgcaggcaaaagaggctttttaagagaatcagataggatgtagaagcctacatctcagaccagggatttaaataaatttatcgtaccacaactttgttaaaagtttaataaaaggtagggattatgtcatatttgtaattgagaaagtagtttcacttcttttaagcctgaggttttttcttttcactttacaaagttagaatttttttgtccattgttacaggcaaatattgggttgcttaagctatggcggtgcagtaaggagagtacagacttttaattagaaacaactgtgtttagattgtctctaatgaaacctgcgactttggcaagtaaattatttaacttgtgctattaaaatataatcctgggttcatactagaattttactaaatgtacatgtcatggtttagcagcatgcctacaaactgtactgaattaggtaagaacaaagacagaataaatgaaatttcaaagtaaagtgtgtgagaagtatacattcatgatctacccctaaacagcataaggattaccacactttagtatctctgccccaatctgctgtactccagtcagagtgggagacaaagagcagcttcattaggatgttctgttatttctgatc

SEQ ID NO: 126620 - DNA, 1008 bp, Homo sapiens
ggttgttgtgaggataaatgagataatgtatgtaaatcatctaagtacaatgcctggaatatagtaggcatttggtaattgttaattatttgttcagaatcaattaaaataattttcctaatgtaaatatagtaattctctttagacaaaaaagaatgcattggttctgacataaaaaacaagaataaaagatttgctttttctcatctttcttgcttaaggtttctctattagaataccgtaagagacaacgtgaagctaggaaaagtggctctaagacagagaactttccactcattagtgtatcaccccatgcaagtggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggtaagcccattgtgaagtatgctactctggaaaaaacaagcttttgttcaagtattcttcctatttgttgttctcccaaggctaagctgatagtgcttcgtggtcacaattttaaaagattctctctgctaataggattttaagccagctgtgtatggcctgtgttcttaaatgtcgattgtatttattccttggtaatttattcatactttacacacacatatcctctccaaagaatttttatcagattcaacaattctgcagacttcctttataacccctaccagttaccttgaaagaacaaccagggttagtgcttcttcagaaggaataggagcagctgcatataggatggatcttggcaaatggcaggcagccacactcactttgctccttggtcccctttccacctgaaagcatgcaatcctgatagcagtttgttaggggcatgttttggtacctttggtaacctgaagtgacattctcaatgtcaatatatt

SEQ ID NO: 126621 - DNA, 1023 bp, Homo sapiens
ttgagtccttcaaataaggataataatctcagttctgggagcagtcagcaaaataagattaacttttttttttttttttttgagctggagtcttgctctgtcgcccagtctggagtgcagtggcgcaatctcggctcactgcaagctccacttcccaagttcaagcgattctcctgcctcagcttcccgagtagcgcccgccaccatgcctggctaatttttttttgtatttttagtagagacggggtttcaccatgctggccaggctggtctcagactcctgaccttgtaatctgcccaccttggcctcccaaagtgctgggattacaggcgtgagccactgtgccctgccaagattaactattttcaaaggttaacaccaaagtattttcccagtagatcaaaagccttggtctgacagtacatgttgactatgaagcaacaatgtaactagcagtagtttctttcaatagaggataatgtgatttttctttgaaaggactgcctcaacttcagtggaacaagtcagagaaaggagttatcagagagctttacttctcagtgatcaccgaaaagataaagatagtggtaagtgagcttgttccttcaccagaaagtggaatcagttaatcactctgcatcctcgttctttgcagctctaatgttctctttgggtctgctctgcttcatctctagggggagaatcaccatgtgtctcatgttcaccgagtcatgttcagtcttcaccttcatctcattcaaatcacataccccagttgcaagctaagggcccagtcccttctttcagtgaacttatggaaggtcagtaagcagatgaccgataatgttattcttaacaaattttaaaatcagacaagagagcctttataaaaagttggtttggatagtagaatgtatgttgctttgtggtgttaaaacagtgtttattgtgtaattttatacttactataggtttcttctgctttatagaccctgatcctgaaaatccagaacccacaacta

SEQ ID NO: 126622 - DNA, 1123 bp, Homo sapiens
tatcatttaaaaggaatgacatcttcatcctggttcatgaagatgtaataatctagtatggcatgtaaatcattggaaactaaagacaaggaatgtgagatttatctttttttgatgattgacatttaaacagtcttatacttggtttatttatatctgaacagtgtacaaggaaaatgaaaaggtattaaaaatcaaaatggtttgagggagcaagttcatttacccaaatcaatttatccttaggttgggtatagaaatttcaattataaaattgaaacttgctattggagttcttcagagtgaggctcaaaaacaggtttcattgcttaggggtaaaaaggcagagtaaagtgaaagaaaattatttcctcaacttgtcttcaataaaaattaacccagagaattcactttaagctcacgctcataactttttggaacaactgaaaaatattggccttttaacatcccaagcctccataattgacgtatccaggatgttatttcctgccccccattaaaattaatatttaggtagtattaaataccaacaagaataaacctcaaggtacacaaaatgttccttgaatgtatataatttgttttctcttcatagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcagacacacgttcgtaattcatctgagcaactttcacaaaagctgccttctgtgccaacaaagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacacctcagcgagagcctcaaagaaacttttatccagcagcacagaaccttccagccaatactcagcaggcaacttctggaacattatttacacagacaccctcagga

SEQ ID NO: 126623 - DNA, 1124 bp, Homo sapiens
catcaaatcagcatcagatctgccagaaaaaaacagctggaatgttcacttacaaaataaagatacctaatactggcttaacagcacattttttaaaggaattttaaaaagcaaaaatgagaaaaatacaacgaaagagcactggtgttttttatacaaaggttcatgtacaagctttaaaaagtaccttaacaggtacatatgaaatatacagtttatcttacagaacatttaaaaaaatgtttttggagtccattttaatgccaccctgacccatggtaattgttttgaaatgttggtggcacctgtgctctgtgaattggaatctgtccaggcactggagatgcctgctgaggtccttgaaccccatgtggcagggccacagagccaggatgaggacagaaccctgaagcagtaggtgttggaatactgtttggtccttggggctggagatgaggacctgtgacaggtaatggacaatgtggccctgttccagaaggctggtgctggggtcccggtcccaaagtggtatgatgtgtagcttgtgagggatacggtggtacagttggatgagcactcgaaggaaaaagtggaggtccttgatgaggtgggtggtgtaaggcttgagctgatgtggtatgatgcccagaagccaaaacactggaaggtggcggcggagggggtggtgggggtgctgaatttacaacatgctggtgttgtgcttgtagaccttggagtcctgtggatggatggggtggtggatggtgatgaggggcaggaccaggagggggtgggggtgggggtaagtggtgtccagcagtttgagaatgaatatgcgacccaggggtgaccgcatgaacaggccctactacatgtgctacagagtgttgctgatgggaattcggctgttgtacaaggtgcggtcctggagcaggtggtggtggaggaggaggggggactacggcagcagcagtttgatggtgaatggtagggttctgagagggcaaaaaatgccctggagtcacgtggtgtcctggaactgtttgctggcttgtggtgccaggaagtgcttgatttggtcctgatgtaaacacagtttgttgagaaagactacctttgagctg

SEQ ID NO: 126624 - DNA, 1429 bp, Homo sapiens
gtatccctcacaagctacacatcataccactttgggaccgggaccccagcaccagccttctggaacagggccacattgtccattacctgtcacaggtcctcatctccagccccaaggaccaaacagtattccaacacctactgcttcagggttctgtcctcatcctggctctgtggccctgccacatggggttcaaggacctcagcaggcatctccagtgcctggacagattccaattcacagagcacaggtgccaccaacatttcaaaacaattaccatgggtcagggtggcattaaaatggactccaaaaacatttttttaaatgttctgtaagataaactgtatatttcatatgtacctgttaaggtactttttaaagcttgtacatgaacctttgtataaaaaacaccagtgctctttcgttgtatttttctcatttttgctttttaaaattcctttaaaaaatgtgctgttaagccagtattaggtatctttattttgtaagtgaacattccagctgtttttttctggcagatctgatgctgatttgatgctgtatgatcttttttttttttttagttaaattcatttagtgaatgttctattattttatacatacacattaagtactcagctaagtaatggcactatgaggattttttttttctttcctgtcagcagcagttctgtgaatgcatcttaggtataaaaatgcaatacagatttttatattttggtgtggacatggctcattttgttttaccagttatttgcaagcaaaatgtaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatctttgtgaaagtagtacagtatatgacctttaatttcttttttattttaaatatactgtcacactgaagcactggttgggcattttaattcatgttaataaatcacaattatgtcagttttaccagattgtcctgtacaacttctaagatcgggatctgtgtgtttctacagaagttctagttttcaaatatagattgtaaggagccttcaattttctttagcgactactacctcagcaacaggaggcagcaaggggctgttcctgtggtggtttctgtttgcatttttgcaggagccataggaaactactgaaatgattgtgctgggtaaattaaggatctggcatcatacaaaatgaagccagaccactaatgcattacagtagttcttgaatacaaggtacaacaactgtttgaaaatatgggtagtttgcccaaaacaggaaaatttgtcttgggtgtaaaaactaaagaaaaaaggcattattcctagatctctca

SEQ ID NO: 126625 - DNA, 1235 bp, Homo sapiens
tttcctttctgtagtccatgtgaaatcttcatggaaaatgacaagcagtggatcacatatgtgtttatagcagatacaggagctggctatctagaagttggcagacagaactgcccaaaggcagagaaaaggtggatataagatcttccgagtcataaacttcttaggtgaaaaccgatttactaacttgcttcttcccatacctggaccatacataactagttaccacgataaagtaaggaaactttccattggagtagagaacttcttcagtttctatccatagttcaggttatttcctaaattctccttttttctcccccttttaaataacttgaatgaaattttggtagaagactgtattttagagtatatacttcatcaaggaatcaaaatgtataagattctgcagttcacacaaaagcttctgtatgcatatttctgtagtaggcacatttcaagccagtgaagaatttaaaatgcttagaaggacaaaccttttaagaagaatatttttatttcacatgctagttacctttattctgtttgaaactatcaggatagatgatgtaaaaccatttcttctcagacaaatgtttctttactaaataccataaatagaattttgttggacaaattgaggatggcaaacttggcctatatgttcttctaaaatttgaagctgtgattaggattgagccctaagtgagctgcgttaatgtaccatcattagctaattttcaaaaggaaataaatagaggttcaaagtgtaaaaacatgactgaatgaggtcacgcagtcattttagtgtttactttctctgatgcacagaatttgtatcctgtgccaaattatgtcaggtaattggatgatgaaaaatatgttgattgataaaacagtatcattattattggatgtacttactgaatcctcagaggtagaagacaaaggctgggaaatttttaattttttgaagattaataattaataactaactagcattttatattttagcaataaaaacgttcacttaagaggccattttcatttcactgagagatctaggaataatgccttttttctttagtttttacacccaagacaaattttcctgttttgggcaaactacccatattttcaaacagttgttgtaccttgtattcaagaactactgtaatgcattagtggtctggcttcattttgtatgatgccagatccttaatttacccagcaca

SEQ ID NO: 126626 - DNA, 1938 bp, Homo sapiens
gtctggtctatgttacccaggctggtctgaaactcatgggctcaagggatcctcctgcctcagcctcccaaacggctaggattgcaggagtgagccactgccctcagccctttattgcagttttgacttaaaaataaccttttttttctcttatgaaatgaccattacagctcgtaggccatttactagcttgttagtcattctgttatgtcaaccaaagctgcctgtaaccgacacttttcatactgcagctagcacagtttgtgaagtataacttcaaggtttacaaattaatgtcctaggatcttagatcttacaacaaatgcgtagacatgaatggtgtttgatttgggttggcctcaagtttgcaaattttacggaagatcccaggttgaaatgagagtggcttgcttcaacctttggaaaagaaaacactctgggcaaactgagcccactccacttacttaaagaagcttagaactaatgtgaatgaactattaattaacctctatttagatccaccaggcttacttgaaatatgccttggtcatatgtacatgtaatgattattgcttagtggggaaaagctggtgttctttgttgttgctgtacaagtgttgagcaggtggttgtccgcttcactgaaaagaacctgactggaccaacaatggggaatgcagatttggagctttcttgacattggcctgttttttcccctgtaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtg

SEQ ID NO: 126627 - DNA, 1042 bp, Homo sapiens
ctgtttctgtctgcgcgggcggtggtagtgtctgcatgcagtgtactgattaaactgtcgtgtgtttctgttttgctggcaatgtttcccaatgcagatcacatagcattgatcattgaactgctggggaaagtccctcgaaaatacgctatgttggggaaatactccaaggagtttttcaccagaaaaggtaacggtatttatgcaacactaattttcagcatagtcttctcccaaaaggagaaattgtgcattcgtgattgggcagtggagaaagatctggagtttcacaactggggaattcttccgaagaaagctctcaagaaataaacctgacccatctgatacctggagtaagaattttgtaagagaacagccttcctaacagcattttttcctcctccgcttctctcttttactccaagttaccaatctgtatattatttataaaaaggagtttaggtgattgttaaaagccagctagacttatctttccatttcatggactctctgtagtagaacagaggtggcctagagactggacttagggaacgtccagggacattgcttttggtctgcctgggttatttctgtagtgggtgtaggcctgtgaaatgctgcgtacctcacattcttaaaaatgacatcctacattcccattgtgttatgccacactgtattaaggtgattattttcatgttgtagttcttactgatcttccaactgtttatttgcccagtatagtccccagttagtaatttataaaaacacccaagagccctaggagtatttttaaaagaactccttctaagtgctatattcttttttttttttttttttttgagatggagtcttgctctgttgcccaggctggagtggagtggcgcaatcttagctcactgcaacctgtgcctcccaggttcaagcaattctcctgccgcagcctcccatgtagctgggattacaggcacaccaccacgcccagctaatttttgtatttttagtagagacagggtttcactgtgttggccaggctggtctc

SEQ ID NO: 126628 - DNA, 1065 bp, Homo sapiens
gtgtgaggtgtcggtgccagggaccctgatgtcttgtggcgtccaaggaactgtgtgtcactgagagtgatcggcccccacagcagtgttctttctaccttcatgttccttgtaataatgcatcagcaagctcgatctgggccgtgaagggatggattgacaccatgaagagccgccacaaagctgcagacagggggacagcaaggctggcttgttctagggctgacctggacccgaagaaactggggataaaaagagaaaggtcaaggcagtgcccttggcgtcctgtgggcagcccagtttgctcttttctggagtattttccagaggtggagaacaagcaattttagttctgtcaagtttaatttacagtattccaggcctaagtgatcattccactactcttgaggaaaggagactgaccctggcaaacactgtgctcacacatgcaaaccacctatcccgatcactaactgtcctgctgtttgctcatgccagcaaaaacccgggcagctgacttgttggtgaatcccctggatccgcggaatgcagataaaattagagtaaaaattgctgacctgggaaatgcttgttgggtggtaagtagagttttctttctaaaacctttggtcttgattctgtgtgcgaagacactttttgaatgtctgtgttgctccgtggtaatgcagcctgttcccttccagcataaacacttcacggaagacatccagacgcgtcagtaccgctccatagaggttttaataggagcggggtacagcacccctgcggacatctggagcacggcgtgtatggtaaggacggctgtgccctttgctgccatgggaattggctcgttcctttcacactctggatggggctgagtctctctgaggcatgcgacctcagtttttctgactgtaagggtcatccaccgtgggctgggtgaggggaaggttgctgccgcaggcatcttaagaagtggaaggatcctcctcaggcgggccctgggtgtttggtgtggttgtgggcttgtgagagagacatggtctcttcttaaggccctgc

SEQ ID NO: 126629 - DNA, 1200 bp, Homo sapiens
tcattaactttttacctaactgtaatgcaccacaagtctgtttctgaagattatagagggtagaaatggaagtgcaactttatttagaaagagttattttcccttaaagctaactttttcttataagagcaggccaattactaaatgaatgaaaaatgagatttagaaaacctgaaggttttaccccaaaagccaagaggtgtttaccaggtggtacataagcatattcaaaatgtattttattgatggagataagtacttaatgaggctgtattaaggagagtaacaagttctaattcttgacccatcaaattcttaaggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaaggtaagtgtttcttcccatcaactgtctgccatcgctgactccagggacgtgcctttaacaaatgctgtgaaggaattggctggaagtggccaagccctgtgtgtgtgtactgatcagttttattacttttatactcctgaagaagtaatgtgatttaaataaattttctatgccattaggctatttcttgctctctgcataccaaatcttatttctgaccagttttcatttttaatatatttagtcagcagcatcatttgcaaaaaccttccagttttagcaacttacacctttctagaatgtgtagtttagtttaaaattcgtatcttcttccatctaatgtcattatatttagtttagtttagttttgttttgtttctattcaagaaaattatgc

SEQ ID NO: 126630 - DNA, 1082 bp, Homo sapiens
gtgactcacgcctgtaatccctgcactttgggaggctgaggccactagatcacttgaagtcaggaattcaagaccagcctggccaacatggtgaaatcctgtctctaccaaaaatgcaaaaactagctgagtgtgctggtggacgtctgtaatcccggctactcaggaggctaaggcagtagaatcacttgagcccaggaggtaacggttgcagtgagctgagatcacgccactgcactccagcctgggcgacagagtgagactccatctcaaaaaaaaaaaaaaaaattagccgggtgtgatggtgtgcacctgtagtcctagctacatgggaggctgaggcatgagaatcacttgaactcaagaagtggaggttgcagtcagctgagatcacgccactgcactccagcctgggcaacagagactctgtctcaaagaaaacaacaacaacaacaacaaaacactatttttactgagacagctcttgatttggaatgtaagttctggaacaagagggagctttaataattaagcttcctggcctgctgagaagctcaagttgtttcccatagttcttccctggcttgagctgcttgaatttactgattgattgaaaggttggaggctgtcattgccagtgctttgcaagtcaggtaaccatgacgggaggcagacaaaagctgtagctttttcttttttccctttgcagcataggcttatctcttacagttcatgttgtcttggctgctaagagcttcatatgtgagacccaaacacacagtgacatacacctgctcgggcacctgtttcatttttggcattgaggagctgggatgttgttactttgtatatagacagcagcaaataaaacttgcaagaggagcttctcctttaaggccaagagaatttcgaacttcagttctcttagagtttgaatggtgaagacttactggatttaagctatatccctctgagggcaggacctggtagtagacctagtacgtgatatcagtcagcactgctttccctttgattttatcgtaagccttaccacaaagtggatctgtctgggtttgggattt

SEQ ID NO: 126631 - DNA, 1017 bp, Homo sapiens
acctgagtattgggatatctttatttctggggcggggtcggggaggtggtgcagtgaagtgtggactgtgcttctcactcttcgacaccatgatctgtgcctttgtgtgttgtcaggcaagcatggatactaaagggctgaggctcctgggactgcctggggctctcttcacatctcctttactgccatcagggtgttgtttagatcatggacccagcctgttaagcttttgaccctggtgtaggggtttaatcatgtgattcctagactatttgctgcataccaactgcagtatttgatttaaattatagaaagcttgcaaaatagattccaaatatcgatgtacatctacattgttcatttcattatattttaaacaaatttggtttaatgactgtgatatgtattcttttccattttcttaagtgatctgttggtgcttgagcttgactgtgtttgagatgtattagtatttcattttagataaataagagaaatggctcagtatgagtaacttctgctgtgacttcaggagtcactcatttgtttcagtggcataaacttactctagatccttgtgattaagaagctctgattaatagtttttgaagttggatagccattaaaagacaataattatttcactttgcaattcgaatgacctacatgaaggcatgtgtctgttttctgctaaatacagattttgtttgattttattttagtgagtacggctccacagcagaaacctgtaagtacttacgcatattactttatatgcaccatgttaaaagagaccgtttattattgagttgttcaaattataaaaaagttgtgtatttaaagggtagacacatttataaaagctgtgtatcctcaaataggtaagacttaatgtcttgttaattttttttttttttttttttgaaaactgagtttcactctgttgctcaggctggagtgcaagtggtgcgatctcggctcactgcaacctccccctccctggttcaaacgattctt

SEQ ID NO: 126632 - DNA, 1614 bp, Homo sapiens
tattttaacacctgttttgttaattatttctcatagtttcaaatgttgaatgtttctcatgccttttatagatcatatgaaaaagcaaaacaataagtgattgtgatatagagaggatatatttgtttgtgtataaaaccaaatggaaaagctaactgacatgaacgagaatgagtagttatttttgacttggggaacacttcctttggcaataccatacatatttaaaatgcatgcacatgcacacacacacacacacacacaatcccagacaacgtagaagtgaaaatgctgcatttcagaaaactgactttagactaaagagatggctttactgatgagtacaatgatggtaaaggtgcatgtgataaagcatttgaaataaacttgctttgtgacaatgggaaatacagtctttccaaataatctataacatgaatttaaatacatatgtacttgaattaaacattaaatattataagcaaacatttgactattttatctctattcctacaagtttacaaaattttggtgggagccgttgccaaataatacttgtagtttccaaaaaattacattaccctgtctgcctcagatggtctcccacagaggtatctaatcttttggcttctctgggccacattggaagaagaagaattggcttgggccacacataagatacgctaacactaacgatagctgatgagcttaaaaaattgcagaaataactcatgttttaggaaagtttgtgaatttgtgttgggcctcattcaaagccgtcctgggctgcatgtggcctattggacaggcttggtctaacacctctttcttcttgtggaattcatgtgttctttgaaattctgttaccatcttctccatgtctgtgatgccctcttttcttacccacactgaacctttttttttcctgcttcatatagcatgtggtgaatcttatatcagcacacctatcttcattgctttggtgcttttctgcttgctgcttttcttcttctaatgtgtaagttattttaaggctgcctctccaacgcaatacatagctaagtgcttaagatcctgggctttgtagacagtctttgttttgaaggatggtttagttactatttagttatataccattgggtaagttacttaatgtttctcagtctctggacgttgataataattagtttgttggctgcattattttacgggttgaagtggcacatagtaagcatcagtatagcctattattaaattttgtcttcatggtatttagcacatcgtagagatccaggaaatatttcttaaatgagatagtagaagtttctctaatgatcttttggtagattgaaaagcaatagcaatccattgatgaaatattagtttacatttcaaaaatcttatttactggttaatatatttgcattgttttaaacagtatttaattctgtccctttgtttaaaacaaacaaaaaacacccacaaccgcattttccagtggcaactactagtataaatctttgtagtctttttctttttacataactgaaattactaaaataatcagtctcatttaccttattataactggtgcagcaaaggtgttcttaatgt

SEQ ID NO: 126633 - DNA, 1281 bp, Homo sapiens
atgctgctttgctgttgtttaccctgcacgattcagcctttacttagaagcttttgtcatttgtctggttgggggagtatggaatagttattttgacagaggagctgatttagatatatgccttgcctttaactctaggttattttgctcatgagttgtgtcaaacttaataataatgtggcttttttagtgctctgtcagactctactgctgcttttattgcctgtttataaacatttaaatgttttcccctaaatcagtcttaagacttaaatgtttataatgcacctataaccaagcaggaaaaatagaaatatcttgagttaattgccctggatggtgcttccttacgttcttcatgtttggcttgtagctttaccacagcactcagatgtctcatgtctggttgtagaccctatccccattcggtctttgtgataactctgcttatctgtcaaggtattcaagttttaaagtatgtatcatggtcacagcaaaagctttgtgccctcttctaagtttgttttttcatttttctagttagaagttgaatttgagatttaagtagtatttagagttccttttagagatgaaaactatctgggctccagaataatgatcagtttagactgttcgctcctctgagctttgagttgttttaatgaggaaaatttgtttgatgaactagaatatctgcacattcttctcctaggaattagaacatgtcattgagccaagtaaaggtgtaatgtgcttttcagaatgtactgagaagattgcataatttagtgtatcttttattagtagacttgcagtggggagtaggaatatgcaggatgttatgacaaataataatggttagattttctattctgatttttcctttaatttttcaaaataaaaaatcatctggcagcctacagaatggtatttagaacatcacacctttccagacagggtttggtcagaagctaagtttgtgggcttttgagaggtgttgcatttgatgctgctgcagtatcttgggtttctagtcatctttcagaaagctggtcatgtatggcattctggcctctggccactctccaggcccagtgcctgtctttacacaaacttgacttcctagtatcaccaactataatttaaatccttaagctgatgtctgttgctttggagatgttatgtcacattctgcatctctcagcactgcatgaaacagtgttcccaaactagtcttttgattctatctctatatttgtggaggtggttcattgtgtcttt

SEQ ID NO: 126634 - DNA, 1024 bp, Homo sapiens
agaaaaaaaaaagaaaagaaagatgataattggaatgtttcactaatcattttgttgcagaaattcttactcaatggatatataaagtatcatttctataaattgtttaaaatacttaggccagtgctgcctaagtggaatttctgggcagtctgtcttccactgatggaagatagtataatatcagtaaaacctatgagcattttaaatgtggctaatatgattgaaggattaaatttttaattttacctaattttaaaattcaaaaaccactcaactttttcttttcagatgagaacgccagtgaactgttattttaacctttctttttaaatttagaaatgaagattgtttcctttattgttctttagttcctaaatgaatattgcttccttttgccctttgtttcctaagctccaccctactctgtttttgtttttttaaaattcttttgccctttctatcctgacagtattatattttacaggcaagagtttatttccttcattgtaactcaaattagtaatttaaaggaaactgcactcagttatttgtccttgtataaagttattttgagcattttttattttaaggagctgcttaattttctgtcatcatttaaggagaaaaatattcagttatctgccatcatattacttgcctggtgttatatcctctttttaatgttctactaacataaaacagttttaaagtaaaaggagtgtagtttcttaaatgttcagttttaaagggaaagataaattaatatagacgaactctgtgttgtctgataaaagagataaaggtcagtagagaaattatggtttatgatggtagtcagctccttcttccccctcaagccacgacactgaatttagcctcagtttgttgttgccattcagtctagctagagcttacaaaaaatacaaaacccccaaatttggattcaaatttcaattcttgtacccatcaccagacacacccccacatggtgattactaatgattattaaaatactctttgg

SEQ ID NO: 126635 - DNA, 1008 bp, Homo sapiens
gggttctggtttaatatttcattcttaagtgacaaaaatgattcactgagccatattttttagggctagtgaaatagaaacagccaagggttgcatatctgtttattacagcctgtgacgtgattacccaggcttctcaaattatctagtatatttaattcagatgttcaagatttcttgtttgtattttattttgctaaattgaaaatcatcttgtagaaccatgctagttctaccttaaaaaagaaaacacccctctgctttaaagaaatggtacttcctgctttcataaacagtcatgtgcatagtttagcaaggcctgatgcctctggagctttttccctttatagcaccattgaatcccagtcctaacagaagtactgcgaatcttgtggcctcattctgaacaaaagggattagagaagaaaaatctcttgatataaggcttgaaagcaagggcaggcaatcttggttgtgaatattttctgatttttccagaaatcaagcagaagattgagctgctgatgtcagttaactctgagaagtcgtcctcttcagaaaggtacagctacatctcttgcatgaacaattaatggtgtagcattgctaagaaacaaaccaggacatatttttttttcttgtcaagtttgctatataacgtattgtcctgcatgctggtattgtgctgtattgaagatgtgtattggggcaagctgttctgcttttgcaaagggtgattgatttttttaagaaaaatagtggagcctgatcagctgcagcatgcacaccataacacagcagaccgctggttcatgtgtgacagctgttgaaggctttaaaaataatttagctaaaaagcagaaaagaaaaatcttgcttttttaaagggaaatgctgtgaggttttcttcctatatgttgaggttgctgctctacagaattacgaaggttatttgtaaaatgtaggttaaaaatacttgattttgggttgtaataaatatttattctt

SEQ ID NO: 126636 - DNA, 1068 bp, Homo sapiens
ctatctcctgaccttcgtgatttgcctacctcagcctcccaaggtgctgggattacaggcgtgagccaccgcgcccggccgggaaagatatttcaaatgagattgggggaactagcctgggatccctcaaacatttcaggtttggtacggcaatggtgttgctgttcactgagatcaggagtatataagaagacattaggcttataagtttatgggttcaattttagacatcgcattcaagccatgcagagactgtctaggtgaaaatggaggatatgtggttctgggttgtaggagagaatattgggctggaaactaagttaccgttatcatcaatgccctgtagttcttgatggcaagggtgtatgtagacagaaggatcagtgagtgaaaagagggtccttacaggtattaccagcatttaagggctgcatggaagataacggtcttgcaaagtacccagagttagaaggagaaagcaaatgtaaaagcattaaaaaaaagccacaaaaacttatgtcctcctataatgttatttagcagttaagaaacaaaattatgactaaaaataaaagcaaccataatttaaaatatatttattcaaactacacaggaactgcttgcctgttttctgtgtgaaataagcaagtgtggtcttgaggtgggagtagggcagatggtaaaggattgattaaaggctgagatgtagaaggagctgttgagtgtactgtcaagcattttcagattacatccatagggaatacaactgttaaataatcaggttgatggacttttttttgcactcactggtctaaatgtatacatggagacagtgggtgctgctttggaagaaccatgaagtggtgggcaagagagtcattttagaattgtgaagatgtgtcattttaaaatgacaagagagtcattttaaaatctgacttgtaaaagcagactggatctctatatcaattaatgtaacaaaatctagaaggttctaagatttacatgcaaatactattataaagcatattagaggaaaattggatgaaaaatttaaaaactttggtg

SEQ ID NO: 126637 - DNA, 1248 bp, Homo sapiens
tattcatccgtctttttatacttttttttttgagacggagtcttgctctgtctcccagcttggagtgcagtggtgtgatctcggctcactgcaacctgcagctcccgggttgaagcgattctcctgcctcagcctcccgagtagctgggattacaggcatctgccaccacgccaggctaatttttgtatttttagtagagttggtgtttcaccatcttggccaggccggtcttgaactcctgacctcaaatgatccgcccacgtgggcctcccaaagtgctgggattacaggcatgagccactgtgcctggccttcagttctttgagagagagagagagggaatttattgttaatttttttttggaggcttgagggtcctttgctgaggaaggaacttagataaaacatacttgtattacgctttaagaccagaaaggtcagtttctgtgtttatccaaaagaacagcctatgggactattgggtgggttttactatttgggttgttgaagttcttggaaattttactgtaggtctcagcaacagtaatcttctggagaagatgaagaatgtgattgcctccagtatctttttgccccttagatttcccctttataaattcatgtggttcagctatgagatgatctgaggatcagtctagttctaaaattgcttggatctttggttaagtgtatctggaaatgtatatttaagaataaattaatgtagctcaattgtaactaacattagattgactgtaacaggctgagaagactatgaaggtgtcaacaaccagtgtctgatatgccaggctgtctgaattgaacattcaggtgcctgtcgttagggaagcaatggtctcatggggactgaaacaagtaatttatatattttagtaatttggtaatgcaaatacagagacgtagaggaggtgaacttaattctgggaatgtgtttgtgtggaggtaacatttgggactgagattagaaaagtgagttgggtagctaggcgtggtggtgcccacctgtaatcccagctactcggggggctgaggcaggagaatcgcttgaatttgggaggcagaagttgcagtgagctgagattccaccactgcactccaccctgggtggcagaacgagactctgtctcaaaaaaaaaaaagaaaaaaagaaaaagaaaaaacgagttgggtgtacaagggagacgactgaacggtggtattccagggagaggaaactgtatacgaaa

SEQ ID NO: 126638 - DNA, 1058 bp, Homo sapiens
atttgtttgtcatagtctaaagtggctccagataaatgtaaggcacgaattaatttttaaaaatcttccttatgggccagaagtggtggctcatgccttcaatcctggcactttgagggggccaaggtgggaggatcggttgagcccaggagttcaagaccagcctcggcaacatagcgagaccctgtctctaccaaaaaaaaaaattagccaagcatagtggtgtgcatctgtagttgtaactactcaggaggctgaggtagaggattgcttgagcccaggagtttgagatcccagtgagctatcgttgcaccactgcactccagcttcggtgacagagcaagactctgtccctctaaaaaaaaaaaatatatatatatcctcctcatgtacaccccaaacaaaattaagtttgtggatgattatgtaaagaatttggcaagtgaaaggaagtttattaaatttgccagaatgattcccattgaaaaaggatgtagctctaattatttaggtagaataatctgcccagttattatgtctttttaaatttccacttgacaaaagtcagggtcctcatgcccaggtttagtgatctgaatgacaaaggagcatatcatgcccacagcttctgtgtgttcttatgttcccctcactcctaggattctaggttgattcagggcggctccgtttttctcctaggatgtctgtatctttgaagcaccaccccatgggacatcattttgagtagagttactggtaatctgctactcctcatcagggttccaggggcttggcttagtgctgtactgatagcccttagttagtggtctgggagccttaaacttacagtgtgttacaacgtagacaggtgaagcattagagctcctaggccattaactgaagagttaaaaactgttcatcttcataaggagtttgagtatcttttaaggtgtgagtaaaaacaagaataaaagagttatgaggaagatctgtaggttggatgcaagagaatgaatgggggaaatcacagtgaattgttggctttgagggatgtataa

SEQ ID NO: 126639 - DNA, 1820 bp, Homo sapiens
atctcgctgtgtcgcccaggctggagtgcagtagcgtgatctcagctcactgcaacctctgcctccgggttcaagctattctcctgcctcagcctcctgagtagctgggattataggcatgctccaccacacctggttaatttttgtatttttaatagagacgggttttcaccttgttggccaggctggtttcgaattcctgatctcaagtgatctgcctgcctcagcctcccaaagtgctgggattgcaggcatgagccccaccgcgcctggcctcaaataattattcttgagccacttagcatgttattgtccttgttgatttttctcttcatttacaaacctcataacctgctcctctatcctcatttatcattgattttgcctggctttctagaatttctttagtattttctgtcaactttgtcacttttttcatcctttgcagattttaagttttcacttggctctagatttgtattttattgaattgttagactgtgtgattattaatgagagagtgacaaaggattttgatgggtggggataaaagttagtgataattggggatagttttttgaatgttcagtttaccaatgatgatttttatgttttgcagaatttctgcttttctgtgaattctcataacagaggacttcagtaatgaacactgggataacagggactcccttttaaggctagactggccttagcagatgttggtcagttaatcatccaccctcctagattacgcagaggaattgctttattcttgcacctttgtgaacattcacttatgagtcagtcagttttgaatcaggacctcaatacttggcttcagatagcagtattagaaattggcacctgagccagaaaagcctttgcgggccttttgcatttcagcgagaagtctcttaaaaataccaagttgggccgggcgcagtggctcacgcctgtaatcccagcactttgggaggctgagctgggtggatcatgaggtcaggagatcaagaccatcccggctaacacagtgaaacaccatctctcctaaaaatacaaaaaattagccggacgtggtagtgggcgcctgtagtcccagctactcgggaggctgagacaggagactggtgtgaacccgggaggcggagcttgcagtgagcggagatcacgccactgcactccagcctgggcgacagagtgagactctgtctcaaaaaaaaaataataataataagttggagacaccaagaagggctccataagcgtgtatcctgaggcagtagaatgtgtaaacatgtgaaatagagagaagaagcagttaattggtagtggcaggagaagtagagttaggatgggagaggtgttgaaaccctagaatagtggagcattaaggtggagaaccatcccactgaacacctggaaatattgatttgggagctgctctgacttctgaagaagcgtgtggttttgaagcctgctgaggcattttcctcttaacttctaggtatattcttgcagtattccctgtcatttcaggcaaccttaacacgtatttgtttcttttcttttcagacagattcttgctctgttgcccagagtggagtgcagtggtgcagtcttggtaaactgcagcttcaacctcttgggcccaagtgatcctgccatctcagcctcctaagtagctgaaccacacgtgcatgtcaccatgcttacctaattttttttttttttttaagagatgaagtctcactatgttgcccaggctggtcttgaactcttgggcttaagcggtccttctgccttgggctccttaattgttg

SEQ ID NO: 126640 - DNA, 1015 bp, Homo sapiens
aaataataacatcttaatttttgacttttttttttttttgaagacagtctcactctgtcacccaggatggcatgcagtggtgtgatctcagtcttcgctctcactgcaacctctgcctcccaggttcaagcgattcttgtgcctcagcctctccagtagctgggatgacaggtgtgcaccaccacacccggctaatttttgtatttttagtagagatggagtttcaccatattatccaggctggtttcgaacttctgacctgaagcaatctgcccacttcagcctcccaaagtactggggtacaggcgtgagccactgcgctcagcttaatttttgactttgtacatcccaatatcagtgaaccaagtagtttcagttgtctgttaatatctggtatgaaaaaactgtctcttaagattataaaaatacttattttttctgaatattactctatgatataatctgtaaaatttatgtattttatcagtaaaataaatgatattcatatattaagaataatgcaggaaaagctttaaaacttggcctcctgctgaacacagcattgggtttcaccttgagtttggtaacagctcacagttatctaagaacttgtgttacttctactgtctacttgacagagtcagggtaaaagaggctttgttctgttgaggggctggattaactattaatgatactttgtcatagtgagaaacctttagatagttttcagagattggtttcaccacatttcattgctaacgggagtaattgtgaggctaataaaattagaaatttatttaatacattgttgtatttagttctcaaattttataccgaaacactggtaacaaacagttctggtgaactgtgaggttttagtgtatccatgcagcctttaggctgggtggtctgagcttcctctctgtcttcttgcttgttggcttttgttcacaccctcctgggggtagggggaatagggatcccacttttggagagaatgactcacttttcttgc

SEQ ID NO: 126641 - DNA, 1012 bp, Homo sapiens
taattttttatatttttagtagagatagggttcactgtgttggccaggctgatctcaaactcctgatttcgtgatccacccgccctacctcccaaagtgctgggattacaggcatgagccaccccacctggccttgtttgtttgtttacttacttatttatttattttaagttcagtgatttattttagcaattttgttatgttgtaagatcctactatgggtggaaatagaagggacagactgaatttaagtttttaacgctagtctctttagaatgccagttgtacaacttccataagacttcctttttaaatgatagaatagtgtgagaagaatttagttgttatttttttcctttaatataacactctcagaatcccaacagagcattgctttgaccttgattaaagtgtgaattttatttaaaagtgaaaattggcattttggaggctatttataatggtgtgatggcagtgtttttgtgtagtacccatttgaaagccatataaccacaaaaggcatgtattttaaatggggcatcctttggtaagacaagattatttaaaatatacattttagttacacaaataatatctgtaaaaaattaaagtgcaaataaaggtagatcttcctgcctatgtttcctctttctacactccatccccagaataaggaatatcattttatagttattttttatttttattttttgagatggagtctcactgtgtcatccaggctagagtgcagtggtgtgatctcagctcaccacaacctccacctcctgggttcaagcgattctcctacctcagcctcccaagtagctgggattgcaggcatgtgccaccacacctggcaaatttttatatttttaacagagacggggttttgtcatttggccaagctggtcttgaactcctgacctcaagtgatctcccctcctcagcctcccaaagtgtggggattacaggcgtgagccactgcacccagccatttcctagttatttaaga

SEQ ID NO: 126642 - DNA, 1053 bp, Homo sapiens
aggcaatagtctgtctgtaaggaataaaacagaaaaacaatagcaagcaaaaagcgctgtcccaatatggcaccattggtgcagaagtagcagatcttcaggtgcgtttcagaggccctgagaatatctgagtagtgccaataaggaaaagcctggagttagccaagaaactttatattatgctcttttttttttttttttttttttttttgagagtcttactctatcgcccaggctggagtgtagtggcacgtctcactgcaacttctgcctcccaggtttaagcgattctcttgcctcagcctcctgagtagctgggattacaggcatatgccgccacacccagataatttttgtatattttgtagagatggggttttgccatgctggccaggctggtctcgaactcctgacctcagatgattggcccgcctcggcctcccaaagtgctgggaattacaggtgtgagccaccacacccagcctaatttactttttaaccagacatgaatagttcaatttaggatggcttaaataaagttaagataggtaacctttcaactcatgaacatatgactgtcaagaatcattgattccttgaagtgttggtagctgaggctcatgtgtatttcagagaaggaaatatggaagggaacacgtgagagcaacgggaaaactaggaggtgactaggccatcattttgggataaacagcattccattttgctttggcacatctttcagttattcttctgtttaaaatatttgaaaattgtgaatttttaaatgtatttaatacaggaaattataagcataaagaataataaaatagtcaatccctaacttgagaaatggaatgctaccacaagtagagatattttttctttatattcatgctgttaatttttcctctcgctttactttctgtatgttttttattttctctgcctttattttatttatttgagaccccctccccctgaaaaaaaatctcgttctgttgcccaggctggagtgcagtggtgccatcttggctcagtgcagcctctgccccc

SEQ ID NO: 126643 - DNA, 1316 bp, Homo sapiens
ttcaaaaattaaaagaaactagaaaaagtatcatgtataaagttcaaataccagcatttaaatttctctgaagcaatttacggttcagtaattaagcaaaagaagagatgaagactttatttaagataagaagcctattaatatggattgcactatggagtaactgttcactgagtacttggctccaccaggatgatagtttgaaaagggcttcatactcctttaaaagacagcacatccaccaggataagatcatataaattaacactgattcttattccacatgcctgtccatttacaaagctcaagaggcttcataaagtatactaaactgtaacattttcaccttttattaaggcaagtttgtgaaaataatttaatacaactggatctcttcatgaactttcaacttacaacctttttaatgtaagaaacatacaaaaattattttataaaaagccacctcaataccagaaaatggtaatgaaagattttgaacccagttttactttttaaagaatgctctttccttgtctcaaattccaagtgctactcatcatccttagagccagttttgcttaaatgcttcacaacatcaacccagttccagcctcgaggaagttctcctttgtgatctgttttgtctgccagcttacgcttctgggcttttgaaagttattcttttttgtcttttttcttacttgatggggctgtattaggagtttcaattgagatgatattgcttatcgatgttgtggaattaatgggattgtgattctccatgaactgctcttattgtctttggcatattcaaacaatgtacaggtcatagcggttccaagattagcttctactgcttcctgtaacttggctaatatactctgctttacagctgatgatacggtgttgttaaaaaaaaagcgttcatagatagaattggaggtgtttggggatatgtttctgtccaggaaatctctattaagaaggctttgggatcaccattttcacctatcctatattgaaaagaaactgaacttaattcccggaaactttcatctccttcataaatagagcgtaatgcttctagttccatctcctggtcctcgttggcactcgtcacaccggttgcggggcgcctcctgagtggacggtgcttgcaacaacgaagacaaagcgagggcagcggcccagaggcccggcgaccccctttggcgccttggttgtgggggcggcacagtcttggcactggcaggtgccaatcgtgcgtgcccctggcctcggcagcgcccagctgccagcggtgggctgtgggctcg

SEQ ID NO: 126644 - DNA, 1539 bp, Homo sapiens
cctgcctcagcctccccagtagctgggattacaggtgcccaccacctgtaaaaatacccggctaattttgtgtttttagtggagatagggtttcactatgtgggtcaggctggccttgaactcttgacttcaggtgatctgcctgcctcagtctcccaaagtgctgggattacaggcatgagccacagcgcctggctggcaacaggatttttgttaaataatcatcctctgttgtctccaagattttagaaatcccagaaaacatggaaacctatgaaaatatgaacttgacctaaagtattttgaataatatttattgctgtggttctagatgcttctaaagtttagactagaggatagtttttatctttgttaggtcaggatatttagctgtgtaatagtttggttttaaagctgtatgctttttgacttctatttaggctaagaaggcttttagtctttcttttagtgaagagggtgtccctagtctgagggcatctgtaggcagcatgtatcaatcagtgattgtagcccggggccagggcagccctgcggttttcacagtggattgtctatatatcatctgtttcaagattcctgtagtcatgatactaaaacggaaaggtggaccaaatattttgtttttcagtttatcagtttttctttgagtcatctaagtaaggctcgggatactgtctaatgggaaatgaacagttaagacaaaatcagggcaagtctttgggcaagacaactctgtttactttagtatgcatacatgcatagcctgccttgttccaaaaaggatttaaggtggcactgctgtgcactttctgtggtttatggtctgagacttatttataaatacagttactagtttcaaattgaaatgaatctggcttccaaatggtgtgtagtgtacttaccccaacaatgctgccattgtaccccaaggtcttctttaggatttgaatatgttcattggtcataaatctttatcctttgatgttagaatcaatttttggaaccagctaaaagtcattaagtgccgagtttggtgaataacctggataggcaatctgggttgttagagcttttggtttattgtttttgactcatggactgtgagccaaaataggatgatgaaactagtttctaagccacagttaactccttgttaacattcagcagtcttgaacaatgggtccaattgactcttggtcttgtgctacattagcagtgccattgagatcaaataaacaagttaacattgtcctcacttgtgattttgagatggatgttttcttgggtttgtagtacagcaaagtataccattgcaaatttcatgttttcaggtcgtaatgaaaacttttgaagtcaactctaccgattttctcaaaatatttctgtttttttcagctgttaacaaaagatccaaaacagtgaacaggttgtaactgctctttatcacttggtgaaaatttcttccaaacgttttcactagcttttcacatagtttgaccctctgccacatattcgtgt

SEQ ID NO: 126645 - DNA, 2624 bp, Homo sapiens
tgctacctatgtttgtcttcagtctctccctgttccctgaacttcagttggttcagctgttcccctttccagtacctcatggggtcttagactcagcagtattcctcccaggctcatctccctagccttacacctttgtgttccatgttttctctgctgcagcctggcgcctctgtgttttcctttctgtttggcttagacctactaggactcatatcagatctcacccccagagggaggatttccctgactccttctcccccatgcgtgaggagttcctttgcctacctctgtcattgtgcagaccacagtgcttatggcattatgtctgtgtgatttttttctcctctactggcttatgagcccctcagggacataaactgagacttcttgtttatgcttgtgtaacagagtgtgtggcccagggttggcaccagtatctgtctgcagaatggataagtaagatctataatgtcacaggaggcaaactggtggatgtgggctggatcacttctgtagatgtgatcatgtggttgacagtgctttaaaattggagatattttacatgaaagtctctatggtttccatagtctgaaaaaaaatgtgactatttggccactctgggtcagcatgctttcatgatagttgttcactaggtatttttggtggtttgccacagattggtgtttttgtaaaagatggggttctggtttctggcatgtttttgcagttctggctttctgaatggctaattaaggatagagccttaatgcagatactcatgtgtatgtgtagatacacatgtatatgctaaaatatacacaaaatgctgatgaattgaattttcaaggcctttagctgaataactatcctaggatactttaatgatgaaggctcccataaaatgaaatgtttagtgactgggaaagtttatcattctgaagtttgtagattccttaaagaaaaatggacatattgtctgtacttttaatgtattttttttcttttaggtaaaatgagcttttttttttttcttgtaaccttcagcaaatatttatagacttgcctgaagaagtttttaattcctttttgaaattaaagattgagttttgttgcttatgtttggaattttaagagcattaagtaaatagtattcttgtgagtgtatgcaaagtttgtgtgcactttttttggagacattatggtccataactcccactgtatttttataggggagtgatcacaagcacatcgaagcaaaggactggggccataggaaatgaagcagcactgaagggccctaagcaggattctgcagtggtgtgggttgaggattaggaaagtatgaggggtaggagacctagtaggggccagaaatgatgacggctccaaccaggatgaaagattacagagagagaaatcctgtttagttttcgtggagttttaagtaatctaagtacttatgttaattatgaaactgtgatactgtggctgacaatatcctcttaataagctactatgtagattgaattagacaaaatggtaaaatagtctcatagctctctgtaggaaaagaatctttagttgaataagcagaaaccactttccaccttgtgatacattaaagctttaggtgtcgggtgctttaggaactgcagaagtggtcttgccaattggaaaagtagtactaccataagaattttggattatagtttcttggtagtcatgagaatgaaggttatattaaagtccatacaattatatgaaaatgagtacatgcccatcattctttaaggaaatcccctccctctgttggttgccctaaataagagttctaatatacagggctttccaatttttataaataacaactgcctgaacatttttgcacataaacacatccagcctgctcaagaatgggttttctagagtgctcagagaacataatcttttcaatgcttgggaggtagcataagagaagggagagcagaagaaatattcaggtgccaactcagtctgttttacagttggttgttggcaaaataaggtcagagtttgtttccagcatgtttttgaaattccccttagtgcaaacttttccatgaaaacaatgtaaactgttaggacctccaggtagagcagcaaaaactctaacactaaactgctaattttggggtatatttgggtgacgaacccataactatagtagtaaagctatcagttaatattactaagttctcccattttgccaagcactttgcaaaaatactttcgcatatgttattttgtgttaacctcaccacaatcttaggagatacatgatggaatccagaattagagatagaaagtaatttgaatttcaggagctatcttttgagtccaagtaatgtaccaaagctcatactgttcatcaccattgtatatcccacttcactgttaagttactatgatgattataaaagataaagcgtatgttatttctgattataaaatatatacttaaagttaaacttaggaaattcaaaaatgtggaaataagggggaaaaaaccccacccacagtcttaccacttatacacttttaacataaacttacctggattctgtaggaagtcatatttacta

SEQ ID NO: 126646 - DNA, 2013 bp, Homo sapiens
tattatgggtgtgtattgatatttcattatggttttcaattgcattttcctgagtaatgatgttaaacatcattttttttttttttttgagacggagtctttctctgttgccagactggattgcagtggcatgatctcggctcactgcaacctccaccacctgagtacaagcaattctcctgcctcagcctcctgagtagctgggactacaggtgtgtgccaccgtgcccagctaatttttgtatttttggtagagatggggtttcaccatgttggccaggatggtcttgatctcttgacttcgtgatctgcccacctcggcctcccaaagtgctgggattacaggcgtgagccaccaggcccagccaacatcttttcatatgtttcttggtcatttgagtttcctgttttgtgaagcgcctttttaagtcttttgccccctaccctttaaaaaaaatattgtgtcgtaagtttttcttactgatttataaaaatttgtagattttcagatgacttctttttcggatgtatgtataagttatgtatctttctaatcattatggatatcattttgtaatctaaaagcaaactggaaatcaggagggcattctaaactggttctggaagaaccagtaattctccaagtaaaataagggggcagggcaaggaccttccatgccgaagaaacactgcagttggtgtcaacatgtggggtttaaaatggcgtgtagtcttggaatgtcaagcaggttagtagggctggagtgcagggtgtggtaagcaataaatagggctctgaggaagtcaaacgaaggactggggagctgttaaggggtacacactcaggtttttagaaagattcctttagctattgtgtggggagttgcttagaggccaggggctccattgggaggctattgcatgaggcttcaggagactgatgtatattaaggggccagaatccactagacttagtgtccagtttaatgtgagaggagagtgggagggttctaggattaattccatgtttctgaattagctaaatttatgggtggtgttgccattttttgcaatagggaatgcagaatgtgtttcggaaaaattaatggtgactttggccaggcttttctctttttttcttcttttttttgatacggggtcttgctctgttgctcaggctggagtgcggtggcgcgatctcagttctcactgcagcatctgcctcccaagttcaagcaattctcccacctcagcctcctgagtagctgggattacagtgccactaccacggctggctaatttttgtatttttttttttcagttgagatggggtttcaccatgttggccaggctggtcctgaactcctggcctcaggtgatccaccctcctccgccccccaaagtgctgggattataggcatgagccaccgcgcccagcctggccagcctttttgaggtctctatataaattcctttaagagctgtttggtcagtgtttatagctagagcactgggaagagctctgttgagggtgatatatattgggagttgtcaggtatagctgatggtagggaactggctgaatgaaggtgcattaacatgtgaagagaaggctacaggtagggttggtaaaggaggagccagagagatgggagacccaggagaaagttgtcttacagaaaccaagggaatacagcatttcaagaagggcgtggtcagcagtgttagtctgcagataaaattcaagtgagatgagccttaatcttggcctttgcttttggcagttagaaaatcattagagactatagctggaactatcttagcacagtgttttaaaataaaagcaaccttgcagctgtaaaagtgaataggaagatagagcagggtcctttttgttttgtttgtttttcttaagattagttattgaataagctttttagtgtgtgtgtgtgtgtgtgtgtgtgtgtaaaggagaaaaggtgctttttattaaaaaaaaaaggggggtggggg

SEQ ID NO: 126647 - DNA, 1031 bp, Homo sapiens
agcttgcagtgagccgagattgcgccactgcactccagcctgggcgacagagccagactccgtctcaaaaaaaaaaaaaggttgctatgtggagaatagattgtggggatgggggtagtagtggaaacagaagtggcctgcagtagtgcatgggaaaccgggtgacgttgagtgtgtgaggagtggcacctgagaagtggtaaaagaatctccaggagactagtattttcagggtaccccgaattttacagacagctctgacaggttaagcccacaatagcttcgtttggatcagaattcaggtctcttgaagcacggtttttgctttttgattaattttccagaggaggaaaaggagtaataggtataattttaaactattaatatgatgactggcaaacttgaattatgtgactgtgggtctggcttggtataatatgatttacttttgtcattatctacttttgtatatacaagcaggcttttaattaattttagttcatttcaaatctgtgagcttttatgaattgagccagttcctagaggctacttttatggtacactggaaattgtagttgtcaggaataagattaagattatttagtgggtcaaaattttaatcctgttagattgtcctgtgagtttagtttgcttattattaattgtgctgctttgtgagtaacaggcagaacggaaggactgtagtgctgtttagtcacaaatcttaggaattagctacatcacatagcttgggataaatttttgccttatagtatgtttatatggaggtacaatttttaaaatatctctttcatttatttttttcataacttttattgggatatagttcacataccataaaatttaccttttaaagtaggccatttacagatttttagtctattcattaaattgtgcagccgttatctaattctataacattttcacttccccagaaagaaactccatatttatttcccagttattctccattccccttccccctgcgttggcaacaactaatttacatt

SEQ ID NO: 126648 - DNA, 1395 bp, Homo sapiens
ctgtcatctgcctttttgtgaaagttcctgggcagaatttctgtaaccattcagcaggttcacactcacagatctcttacttccatggtctcattctccaaggccccctaggaagtggagtctaaggaaagcagcacagttctttgtatttgcttagagattatgtgactctcgctggtctgtctgcagctgccttcattttctgactgttttctttcttgccttgcagaaggcaaatacagggctctgaaaatggatttttctctacccccttctacttacgccaccatggccattcgagaagtgctaaaaatggataccagtatcaagaaccagacgcagctgaatacaacctggcttcgctgagcagtaccttgtccacagattagaaaacgtacacaagtgtttgcttcctggctccctgtgcatttttgtcttagttcagactcatatatggatttcaaatctttgtaataaaaattatttgtatttttaagtttttattagcttaaagaaataatttgcaatatttgtacatgtacacaaatcctgaggttcttaattttagctcagaatataaattagtcaaaatacacttcaggtgcttaaatcagagtaaaatgtcagctttacaataataaaaaaaggactttggtttaaagtagcaggtttaggttttgctacattctcaaaagacagcaggagtatttgacacatctgtgatggagtatacaacaatgcattttaagagcaaatgcaacaaaacaaatctggactatggataaataatttgagagctgccacccacaaatataaatacagtactcatgctgactgaaataataagacatctacaaatttataaacaaaaagtgattgtcattatcctgcttatgtactagattcaggcaagcattatagactttttggttgcggtggcttttgcatttatattatcaatgccttgcaggaacgttgcattgataggcccattttatttttttattttttttttcgagacaggatctcactctgtagcacaggctggattgcagtgcaatcctgcaattctcaatcttgcactgcagcctcgacctcccaggctccagtgactctcccacctcagcctcctaagtagctgggagtacaggcgcgcaccaccacgcctagctgatttttgtatttttttgtagagacgggggtttggccatgttgccgaggctaactcctgggattacaggcatgagctgtgctggccgggtttttttttcttgatgtaaacgtgtacagctgttttattagttaaggtctaatttttactctaggtgccttttatgttcagaactctttccactggactggtatttgctcaaaaataaataatggtagagaaga

SEQ ID NO: 126649 - DNA, 2080 bp, Homo sapiens
tataaaaaagactctacatcaggtgcgcgggtgagccagatggttttccaaggtctcttatttttatacatttatttataactgcctcttccagagagagtttgaagcctctgtatatgctgtcttccaactctcagcccatataaaatgcagtttagcaactttggatgaaatggccttttgtagttggcttgggaaccttacaccacaggtactatgactggttgcaaaaataactgaaaaattggccaaaccaaagctcagtacaccctgtagtcctagttactaagtcactaaattttgattccagggaacagattttggattataaattaaggtgactaattttattagggcagtctaactgaacttacattgttactctctttataatctagttcaggataacttgactgacaagctgcatttcaactaactttttgtattttatattagttcaagaagcctacagggaaatgctcacagctgacaatcttgatattgacaacatgagacacaaaattcgagattattccttgtcaggggcctaccgaaagatcattattcgtcctcagaatgttagctggtgagtaatcatctagaatgagatagaactgaattaccatataagttgtaagcttttgcttcactttatatagagtcatgtactgcacaagaattttcagtcagtgacagattgcttatatgatggtggtatcataagattataacaccatatttttacttaccttttgttttttttttggtttttttttgagacggagtttcactagtcacccaggctggagcacaatagcatgatctcggctcactgcaacttctgcctcccaggttcaagcgattctcctgtctcagcttccagagtagctaggattacaggcacctgccaccacacctggataatttttgtatttttagtagaggcagggtttcaccatattggccaggctggtgtcaaactcctgacttcaggtgatcctcctgccccggcctcccaaagcgctgggattacaggcacgagccaccacacctggccttaccttttttcttttcttttttctcttttatcttcttttcttttccttttctttttcttttccttttctatctttttcttttctttcttttctttttttttcttaatagaggcaggttctttctgtcacccaggctggaatgcagtggcataatcatggcttcctgcagcctcaagctcctctgctcaagcaatcctcccacctcggcctcccaaagtattgggattacgggcatgagccaccacatccagcctgtgccttttctatgtttagatgcacaagtacttaaaccattgtgttacagcagcctccagtattcagtacagtaacatgctgtataggtttgtagcctaggagcaataggctatagtctgtaaccaaggcgtgtagtaggctataccatctgtgtttgtgtaagtacattctgtgatgtttacacggtgatgaaatgcctgacaagggttagaacatgtccctcttgttaagcagtgcatgactgtactttttcagtgcttacaacctagcatctaagtgtttcataagtgttagttattattgttattactactattgttaccactactgctactactttgtatttttcaaatcatcaagaagtaaatgaagctaagccgggcacagtgtctcataagtaagcccggagactccagaggctgaagcgggaggattgcttgaggtcaggagtttgagacaagcctgggcaatatagtgagaccctgtctctaaaaaaagaaaagaaataaagaagctgttttgaatataaacagttatgggaagtgagttcatttacattttattggcatcactgaattattgaagaaatgtgtagagtgaacttttttcctatttctaaaaacttagatttgcttacagagctatctctgagcaaattaccttacttagaattagctgtgagttccaaacaccgctctggttgttttaatatcatgtttctagagaggaaaatatacttatgttagttcgtttaaaaatactttatt

SEQ ID NO: 126650 - DNA, 1055 bp, Homo sapiens
tttgtagagatggggtttcgccatgttgtctaggctgctctggaactcctgggctcaagcagtctacccacctcagcatcccagagtgctgggattacaggcgtgagccactgctcctggccccagcttaatttctttttcctttttttctttcttttttattttgagaggagtttcactcttgtcacccaggctggagtgcaatggcttgatctcagctcaccgcaacctccgcctcccgggttcaagcaattctcctgcctcagcctcccgagtagctgggattacaggcatgcgccaccatgcctggctaattttagtatttttagtagagacggggtttctccatgttggtcaggctggtctcgaactcccaaccttgggtgatccacccaccttggcctcccaaagtgctgggattataggtgtgagccaccgcacctggcataatttaagcttttaagtcactgaacctgtaccaacttgtacttctgacttgcttagatgtatataattttagaagattgagttcataacaatattgcctattttcttaatttattgttcacttgtgaatttacagccacagccacctatattgaggaagatgatgttaataattactctatccatgatgtggtaatgcccttgcctggtttcgatgttatctacccaaagcataaaagtaagttccctgtatggggaaaatagttaaaacaagtttaacataatgaagctactatttcaagcatatataaactttggttatttatgacagtctcccagaaagggatgcattcacatggaaaatttaaattaagaaactctacctctgaatctaaaataaaagttgaaattataaaataaaataaataggtcaggcacggtggctcacgcctataatcaatcccaacattttgggaggctgagatgggtggatcgcttgagctctggaattcgagaccagcctgggcaacctggcaaaaccccgtctctactaaaaatacaaaaattagctgggcctggtagtgcacacctgtggttccagctacttg

SEQ ID NO: 126651 - DNA, 1369 bp, Homo sapiens
ggagtttgagaccagcctggccaacatggtgaaaccctgtctctactaaaaatacaaaaattagacaggtgtggtggtgtacccctgtaatcccagctagtctgtaggctgaggtgggagaattgcttgaacccgggaggtggaggctacaatgagcctagatcgtgccactgcactccagcctgggcaagagagcaagaccccatctcaaaaaaaaaaaaagtacagcactttttatatttagaatatgttttcttgcctatttttttccttccctccagatacccagaaataatcgcttaatgtatattcatagctaccaaagctatgtgtggaataacatggtaagcaagaggatagaagactatggactaaaacctgttccaggggacctcgttctcaaaggaggtaaaaaggcagatgtctttgttactcagctaagctagggttcagttagttgccactagtggctttaaaatccatcctggctattaattaagaaagagagatgtggtgaggcacggtggtacacgcccataatcctgacactttgggtggccaaggtgggtggatcacctgaggtcaggaggtcaagaccagcctggccaatatgaagaaaccctgtttctactgaaaatacaaaaattagctgggtgtggtggtgcatgcctataatcccagctactcaggaggctgaggcagaagaatcgcttgaacccaggaggcagatgttgcagtgagccaagatggtgccactgcactccagcctaggtgacacagtgagatgccatctcaaaaaaaaaaagagatgtctagtaagtttgagatgaagggaccatgcaaacttacattggctagtttgtatctgtatttttaaagaaaaaatgtatatctggtttgagtaagcacctcgatctcgaactccccacctcgggtgatccgcctgccttggcctcccaaagtgctgggattacaagtgtgagccactgtgcccggcctgagtaagcacctctctctgggcctcccttttctcaactcaaataggatttgggctaaatggatggctgaaatcactttcgaaacttcgatctaggtctagcaaataaatacacctctggatgtgtcttgttagccaaccttaaagagtttcttcaagtcactgggcgcagtggctcacacctgtaatcccagcactttgggagccaaggcgggcagatcacgaggtcaggagatcgagaccatcctggctaacacggtgaaacgccgtctctactaaaaatacaaaaaattagccgggcgtggtggcaggcgcctgtagtcccagctactcaggaagctgaggcaggagaatggcgtgaacccgggaggc

SEQ ID NO: 126652 - DNA, 1033 bp, Homo sapiens
aatgttacgggtaagcattatgttttccattttattctttttttgaaagttcttttggcacttgaagttcttttacatttcaaatctgtatcatattagattttctgcctacttttaagtttaatgagatgatgtaggaccaggtgtaatggctaatacctgtaatcccaacactttgggaggccaaggtgggaagatcatttgagcccaaaagtttaagaccaatagtgagaccccatctctacaataaattaaaaacttagccaggtatggtggtgtgcgtctgtagtcccagctactgtcaggatggtgggaaagctgaggtgggagaatcactagactagagcctgggagtagagcctgggaggtcaaggcttcggtgtatagttaatatgatttgttgactcttcaaagatttgtgcatataaagttttatctttatgcaaaatttagtaaaataaatgttgtttaattttagagctatactacaaaattcctggacagaagtcatggatttaatattgaaaccccgctctggaggtgagaataaaattcatgttaagaaaataaatagaatgtatggctaggtattcatgaaattgctttgaataaaagcttttgtgcaaattgacgttgttgtttcagtattttatttgtttttacaataaaagtataagtttatttatatttttcaacagttgtatatgtatatttaagatttataatttatatcctattttagcttttttttttttttttgataaggagttttagtcttgtttcccaggctggagtgcaatggcatgatctcagttcactgcaacctctgcctcctgggttcaagtgattctcctgcctcagcctcctgagtagctgggattacaggcttgcagcaccatgcctgggtcattttgtatttttagtagagacagggttttaccacattggccaggctggtctcgaactcctggcctcaaatgattggcctgccttggcctcccaaagtgctgggattacaggcatgagccaccat

SEQ ID NO: 126653 - DNA, 1039 bp, Homo sapiens
agtaatctgttgggtaactcagacccagagtagccagacagagatgtcacattttctgatctgtgttaacacgtttattaaactttgatctgcccttccctcgctcttaattttattttattttttatttttattttttgagatgaagtcttgctgttgcccaggctggagtgcagtggtgccatctccgctcactgcaacctccacctcccaggttcaagtgattctcctgcctcagcctcccacgtaactgggattgcaggcatgcaccacctcacccagctaatttttgtatttttagtagagccgaggttttgtcatgttggccaggctggtctcgaactcatgacctccagtgatctgcccgtcttggcctccctaagtgctgggattacaggcatgagccactgtgcctgggccccttccctcactctttaaagaatgtaataaatgataaaattagtgacatggaatttaagaattgtcatttacttttaaacaattaagaacccctctagggtaacctacagtgggaatcccatcaataaatagttgggttcctaaatctacttctggaatcctgttgcccagcagagactctgttacataaactaattattcgcgtgggagttagaattgtggtagttacaagctggaagttatctaagcgtccatgttcttccttgtctttcagacccttcatgttagcaaacttaggctttgagaggtctgcctgaactcatcaattgcttggctttagtttgggagtagagttttccgggcttccagtccattgtttcagcatctaaactatgaagttgcattcatttttgtgattttaaaagcgcaaaatgataaaaatctatatttcctctgcctctttgaggaggttaaaaagctcaggtgaaaacagacttgagttctgaggcttaaattactcatctgtagaatggagataataataccaattcacagaatggtgaaaatgaagtgagatgatgtttatgctacatctatttttatgcctagaatatagtga

SEQ ID NO: 126654 - DNA, 1049 bp, Homo sapiens
agaaaaagcaaagcaatagttacttgtctcactatcaaaaaaaagataatcacaaatagcattttggtacatgtcctcccatatttaagtaaacagatctctttttggggaagcatttactatccttaaaccttttgcttcatctcatgggtacagacagtgcagctttgagcgtgaactaacatgcccattgtgaagggattgagacaaggaggctgcacctgtagaagagttttctacttgttcactgtttgcctctaaaacattccattgttaatgtctaaatggctgttaacccaccgcataactaccgggtgctgtagaagtcctcagtgtaaacttaaccatgcgatcatttgcatgttcacctctaaagcactttaatattataaattaaacattgctcttttgtgctctttatgctgtgcatttggacagaggtcagaactgcagcaggtaagagcatttggcatttcatgtagataaagtgaaatgccaaagattttgtcacaagtgctaagtatagacaactttgcttaactgatagtgagctggaaggaaaaccgaaaatgatattcctgctcaacagttttctgaagaacttgtgaggaattcacaccaaggactaaagaaatacttgtaatacttttctgtccaagacagaaaaaactcacatatttatcaagaaggaagggtgattcactaagcatacatgctatggcagttttctgaaatggtttatggagtcttttgttcttttcattgtaacttatcactaacttaccaaacagtgcttttgccttgacaaagccaggtatccaagtaccagcttcggtaccagcagtatcttaagcctctgaagataagggattcatgagttcatgaaaaaggattatttttaaaagaagaggactctttctaggaattgttgtatgaaacattttttcagtttttctttcatggagttacagtaatcaaatgaactagatgtgttgtttaagtaacaactgcagctctgtgccacacaggactcatgaatgttattgtac

SEQ ID NO: 126655 - DNA, 1110 bp, Homo sapiens
tctcactttaaaaagaagcaagaaggaagtcagattggatcaactccctcttgtatagagaaccacacttcttgggcttgtggtgttgtgacatttcttcaaagatggactaaatctctgccatctctcccacctcctcatggaaggccacccctggcacagatgggcacttaggagcctgcattcatttttatagaccccactctccccaagctgagagtggcctaaagtgaacacccctaggaaaggaggaagagctggtatccaaagattattgttcatggccctctaccagcgacagcttgtcctcctgagccatcttgcctagcatttgaatgatttagcttttaaagtatcattacaaagctttgtaatttacagtttttttttagctgtattactaccagatcctgatagaaattgttattatgcattatctagcagattcacaatattcttaacctgaacttttctcagatagaactgtgcatcctaaaacatagatgtggtggattctaaatcattgttcccaaacaccacaaattaccaactatttaaactcagacattattttatgtgttaagccagtctgatagggcacattgctttacctaccaaaatgtatatgtgatttttttttaaaataccatctaaactatcataacattactgataaattaatttatattttgagacagtatacattccaaatgcttctaagaacatagtttttaaagacttatgtaaaaaaaagaaaattctgccatgtgataggtacaggttctctatactttctgaaatgaatggtccccaggagggatccctgtatgtaggaatccatagagactcaggaggaagagctagacaggtacaaagaagctctctgggaaagactggtgttatagaatccacaggaatagggaatcccaataatcagagtgatcaatggactaccattgcttccattcctgtggcaatggaaaatgctacagataggtccagcaagataattactctgaaacctgtctatcagtttagcaacatggaagttgttggtgtcttttcaccggagcattctagtggaatgatgaggttggaaaccagtttaca

SEQ ID NO: 126656 - DNA, 1012 bp, Homo sapiens
agaggttgcagtgagctgagatcactccactgcactccagcttgagcgacagagcgagactgtcaaaaaaataaaaataaaagatttttgaaatcgtatgcaggcacttttgttattttgcgtagttaataaggtgagcagtgtttttactaattcactgtattacttccctatttaatgtttgttaacttggtggtattgctatctgttttttttaataggttatcgaggacaccaaagagaaaagaaccatcatccatcaggctatcaaatctctgtttccaggattagagacaaaaacagaggatagggaggggaagaaatacattgtagcctaccacgcagctgggaaaaaggctttggcaagtaggtgtctgtgagcagcttcctcctgccaggcagccgtgagcggcaggccccgctcctcgttagccttgcccgttcgtgttcaagggctactatagtgctgctcagagaacaatattgatcatgtccctccttcagagagggtgagtattgtcacttcagatgccagcgcagtcctgcagcctgcctggcaaggggcattaggtcttttatgtgagtaaagatttgctgaaattatagtagtgcctgagagagagtcttagggatttgatatgttccctgaagagcagagcatactgagtggcaattcaagaagaaaatagaaggattattgctcattctgtgttcttcatggaggaaagaaagctttcagatgaacaaaaaacgcttgtcacctatcccagtggcacattttttgcaaggcccctatatatatatatatatatatattttttttttttttttgagacggagtctcgccctgtcgcccaggctggagtgcagtggcacgatctcggctcactgcaagctccgcctcctgggttcatgccattcttctgcctcagcctcctgagtacctgagactccaggcacctgccaccacgcctggctaattgtttgtatttttagtagagacggggtttca

SEQ ID NO: 126657 - DNA, 1037 bp, Homo sapiens
tggcctcccgagtagctaggactacaggtgtatgccaccacgcccagctaatttttgtatttttagtagagatagggtttcactatgttggctaggctggtcttgaactcctgacctcaagtcatctgcctgccttggcctcccaaagtgctgggattacaggtgtgagccactgcacctggccttgataaactcttcagatatctgaattgtttataagggaaatatgccgagggatttatattagaaatagggatcaaattcataagcaggtagagcacagttatttttctgtctttaataatgtgttatttccctgaggtcttttatgataatctctccatttccagctttcctttagagcttctgggattttcttcatctctaaatttttttataatggcctatttttattctgatgtacattgtctttttttcaagtagtttcttcttgctagaattagcatccttacattagctctgtttcttggatactatagtatagcactatcactctgagtgaaccttgtttctctagcttttcctatgttgtaaatgtcattcatactttagtgttgtgaggaaatctatttcattccttccttaaaagcagtactcctgccgggcatggtggctcatgccgtagtcctagcactttgagaggctgaggtgggcagatcgcttgagctctgaattctgtgaccagtctgggcaacatggcaaaaccccatctctgtttaaaaaaaaaaaaatcagccaggcttggtggtgagcacccatagtcccagctactcgggaggctgaggtaggaggatcgcttgagccccgagaggttaagattgcaatgagccgtgattgtaccactgcactgcagcctaggtgacagagtgagactcttttaaaaaaaaaaaaaaggcagtactcatattctgtttgtacatttgaaattcttctgtaatatttgtatatatatatatatatttttttttttttgagatggagtcttactctgttgctgaggctggagtgcagcggca

SEQ ID NO: 126658 - DNA, 1033 bp, Homo sapiens
taggaagatccctcctgcggcagatagccccctgccctcgccagcagcccacatcaccacccccgttccagcatccgttttgcagcctttcagcaaccccagtgctgtgtatcttccttcagctcccatcagctcgaggctcacctcttcttacataatgacatcagccatgctctcaaacgcagctttcgtgacatcgccggacccgagcgccctcatgtcccacaccacagctttccctcatgtggccgcaaccctcagcatcatggactcaaccttcaaggccccatccgccgtgtccccgataccagccgtcatcccttccccatcccacaagccatccaaaaccaaaaccagcaaatcctcaaaagtcaaagacctgtccacccgtagcgacgagtctccaagtaacaaaaaaaggaagccacagtcttcgacttcctcctcctcctcctcctcctcctcttccttgcagacatccctctcgtctccactgtcagggcctcacaaaaagaactgtgttttgaatgccagttctgctttgaactcctatcaggcggcccctccctataacagcctgtctgtgcacaactcaaacaatggggtgagcccactcagtgccaaactggagccctcaggacggacctcgctgcccggcggccccgcggacatagtgagacaggtgggcgcggtgggaggcagcagtgactcctgtcccctctctgtgccctcccttgcgctccacgcaggggacctctctctggcctcacacaatgctgtgtcttctctgcccctctcttttgacaaatcagaaggaaaaaagcgtaagaactcgagttctagtagcaaagcctgtaaaatcactaaaatgcctggtatgaatagcgttcacaaaaagaacccgcccagccttctcgcaccggtgcccgatcccgttaacagcacctcctctcggcaggtaagggacctcctggcaccgccttcaccggctctggggggcagggggagctgggcagcgcccctgcttagccgg

SEQ ID NO: 126659 - DNA, 1854 bp, Homo sapiens
gaggaagggggagagctgcttttgagttatagagtcatttgcagacttgcctgagccctaaaccagccaaatgtcaccttctctgaggctgcttcttgcatttctgtctgctagccttccggttgccctaacatcataatcaaatgtttattaaacatctgaatgccaatatttcatccacatattttaagagagatagtgtgctttaaacattttgtggatccctgtctcccccatctatttgttagcccaaatgcctactatcctcatactaaggagaaggaagaggatgggctcccctgtctatacactgatagtcgaatcaggtatgtaggcatcctgtgtataacgtaaaacagccatgtcataagtccaaggcaaaatgtaataaagcaggcaatgggtgtgccatgggaattcacagtgggaagatcactcagatgagagccactggaaatgagagtcttgataagggaaccaggagagagagggggaaattgggattgacaaaaagaagaaggaaggagacaacagggagaaggaacagcaggagcaaaagcttcaaggtggtgctgtgtcccaggacagcctacaaagactgattggaggcagaaatgtggtcgagactgggaaacgaaggcatttagcctggctggaagcaaagtggctctgttgacatcagataggaaaggtgggacctgggacaccagcacaagcagtttccattactatcatgagaagcagggaaccaccaagttccttgagaaaatgtggctgataataggacaaacagatggtcctgaaaagtcaccctgggtgttggttgttgtttcttttttttttttttctctgagacagtctcagcctgtcacccaggctggagtgcagtggcacagtctcagctcactgcaacctccacctcccaggttcaagctattcccctgcctcagcctccctacgagctgggatcccaggcacgtgccaccatgcctggctaatttttgtatttttagtagaaacggggcttcaccatgttggccagactggtctcaaactcctgacctcaagtgatccgcccacctcagcctcccaaagtgctggcaatataggcatgagccactgtgcctggcattatttgtttcttaaccaaaaatgctggctcaatcccagaagtagaaaacgtagccccttctgtgccacagaaaattgaatgtagctattgttgagttgtaatatgaggttctgcagaaaatccagagctcaaactacagaactgcagaagtatttttggcttcagtacggtttgcttctttgagtaaaactgtgcccttgtatgtttttatgtaaatgttatttttctctgtatagtttatattagcttattaacctgtaatcaaaattaaaatttttttttcctcacagttttgctcatttgggagtcgcctcatgggacgagggtactatgtgtttgatagaagatgggatcgttttcgattcgcactaaactccatggtagaaaaacacctgaattcacagatgtggaagtaagtgagcagcttttgtgcaatataagatccaagctgccccacagttacctgaaacttaactttctaaataaatgtcagtggctgacttttcatagaacaaaatgattctgaagtcaggatgcttgattaattcttaaataccagctcttcttaatggtttgcctgaaggttttgagaaacacgaatgatgtgttacatgctttgtcttttttggagaccatttttgtgttggtaatctcctaaatgagaaggatgttagataatatattgtctgtttacctaagttaaagggcctttttattgctcc

SEQ ID NO: 126660 - DNA, 1027 bp, Homo sapiens
gtgatccacccacctcagcctcccaaagtgctaggattacaggcgtgagccaccgcacccagcctgcatttttaaaaatcagagtaagataggcacatagttcaaaaattaaactgtgcttaaataattagaatgaaaacagttcctgtcatcctggaacatgtctttgctctttctgtgttcaagcgcctgtttcctggatccaagtgactgcctccttcttagtttgtgcctttaaattttgatgaagtacctctttcattagcttcctgtgaaaagatttgtgggaggtcaatatttagaatccttgcacacttgaaaatatttttattctactctcacacttaaattgataatctatttgagtatataactggattgaaaatcatttccctacagaattttgaagacattttttcattgacttgtaacattgaaaattttatcaagaagtttaatatttttctgattatcatttctttgcacacgtccagttttttttctctgaagactggggactctgaaagttcacacaatagtcactcttcttctttttttttttttttttttttttttttaaagacaagattacattctgtaacccaggctggagtgcagtggtacaatcatagcttatctcagcttcaaactcctgggttcaaatgatcctcccacctcagtctcccaagtacctgggactacaggtgcaagccactgcccctggctaatttttttatttttttacagaggcagggtcttgctgtgttgcccaggctgatcttgaacatctgggctcaagcaacctgccctcagcctcccaaagtgctgggattacagatgtgaaccactgcactcagctgatcactcttgatgtagctcattttcattcatcatactgggtactcagtagctcattcaatctggagatacttatcctcttctgggatgttttcctgtgttacatcttggataattttctccccactattgtctttattctttctttcttgactttttattaattgga

SEQ ID NO: 126661 - DNA, 1641 bp, Homo sapiens
ggccgggctgggggactagctgagcagcggggggagggggcgtgattcagcagtggcacattgtcttcaggggacaaacggtatctcttcctgagcttcacaacaggcgccttgttctgcccaaggtgctgtgttggaaatggccaacctatagggcccgggaagtggggagttgcaggatctatggggacagctcagcacgggcggtaatcagtcagccctgatgccacccctgacactgtgccagcctcgcaccccctgttgatcctttccagggcacagaactctctcccatcaaaactggactcatgctgcttgcttatagaaggagtataaataagtgataaggaaatgttctgataatgataagcgggtatggttcctcagcagactagatgtatcaaagaagacaattgtgtgtgtttgttcatttatttttcagtgttccagttcctgtagtcagtttagagaaaattcctaacctagtgaaggcagatggtgccaatgtcaaaatgaactccacaaccactactgcagtttctgcctcctccacctcgtcctctgccgtctccacccctcctttaattaagcctgtcctgatgtccaagtcagtgccaccttcaccagagaagatcttaaatggcaaaggaattctgccaaccaccatagacaagaaacaccaaaatggcaccaaaaacagcaacaagccttacaggagactttcaggtatgtgtcagtgtcgtcagggtctgactcatgattagactgaaagggagtcgcagccataacgaaggagtgatgtgctgttatcattaagcaggtctgtttcattttaagggggatgcagagtttacctgcaaacaggaaccccacctaaaaatgcaagggaaaaccaggtctcttcttccccgggcagatgaagtccctcactcagttcagtgcttagcgggagttaccctagcaacccaggaggcagggtgctctgcaccgacctactctgtagattccgagggtcttgtgagcaggtgattctgtgtatctgtatcatacaaacaggttgaactagccctggcttccatagaagcttcactgctgggaagctggacaacacacagggatctcatggtgcctcaaggcatgtgagggacagccccgccaacagctgtgctgcacagggacacacagcctctgtcctttggcctcgggagtttccaggttaattctgcagttgagtttacaactgtcgatcccccataatcaggttggaattcccaaacaggaacagtagggctggcagtgccgatagggtgctggggcggtctcttgtgggtctactccttggttgtctgagcagacacttggggtgccagaagaggcacacaggatgatggttatttgttagaggcccctatgtgggtaatgtttgctttggatcgatctgctgtagaactaaacgtggcagtttttactttctccaaaagaccaggagaagctataaacttcataacttcttcttacatcatgggcactccctgatggtggccagagaaagtaaaatacagtgacagccaccctgtgacagagaaactgtcctcgggttaagcttgatttttaagcacccaaggaattgtgggtaatttt

SEQ ID NO: 126662 - DNA, 1045 bp, Homo sapiens
tgacttgttcacagtcctagggcactaggactccccaggaatgtcaggacacttagcactccttattctcccagcaggtttggagaccaccttctgagctccatgccctgggaagccatgaataacagaagtacaagagagactaacagaccagcagggagacatgcgctggggcctcctgcttccagaaaattggagcagcctagaggggggcttatagagttatttctctgggaggcatcttagaaccagcagagagccccaatgcctaacatacttcaggattgcaggagacaacatgtttgtgcatgaggaggctggagttcctccttactcctcttccagaatgtcctatacagatgggacctttaaccactagtccaggcttaagcagtgcctagaatactagagatggagaagcaggtgggcttgtgaagtagggctgacaggtcctggaaaagggccattgaatctggccccacctcgttctgcttttcttcctcactgcctcacccagaaggagtcctctactctgcatgaatgtggaaggctgctgctcccaccctctgctggtgcttctgcctccaccctgtccacccctccttccacggtgggaccagaagggactaaggaagcagaagttttctgatggtgaccatgatttgcaccccacatatatacctttcaagtatcggtggatgagagcagatgctgggatcctctgtgcccttttggtttagttagagtttattgagagtctgctatgtgcctggcactatgctaagcacttggtatctactacctcatttaatcacttcaaatatctcttattatcttcatttgactgataaggaaactgaggcatggagccaggaaggcctgagataagttaggcagggcagccacatatgtttgtgtgggctttgcactgcatgagaccaccccaccaaggcaggactgaaaccagcactcactccttgccaggccaggtgtcctctttctcattcttagagtcctgataagctcactgaggctctgaaaccgg

SEQ ID NO: 126663 - DNA, 1079 bp, Homo sapiens
cggctcccagtgccaaggtgccagccctgcctctctctccaactccagtttacttttggaagaaggccccttggaaatcagggtgtttataggcagcatcctgactgcagctacaaaagcagattgaacccactgataagatagaaaccggctaatgacttgccaagcacctgccctcaaaagtgggggctgaaggagactccatgctgtcaagtgagtaagccaggtgctggcctaagcccaagtgtgcttacacaaccatggcaggccacaagcgactgtggtgctcaaagtctattgggagggggttagtcccttaaaagccatattggaaaattctcaacaagttctttctaaaaatggtgcagggagccaccttgagtatttgcagccggctcagccattcatgaggcatctgtgctaaggttttaaatacaggacactgatgctgcaagtatgaaaatatctccatgaataagcgtatggggaagggaacactgaatttttactgaaatgggattgcctgagaacctgatggattttatcttcagagagtgaggggagcaaactggagacaccagggttccccgcgcctatcagatttttgggatgctgacagctggtgtctgcaagctccctgcttggctgatctccaggactgcccctggagttgcacctggatgtttaaggaggctgtggggaagcaggtggtcttgaaacagtcagctgctgaggccttggcctggacttcctgtggtggaaatgcacaaaagtaaaaggatttggcttttcatttctttggtactggggccccccaactctttgtgattgaggtcttaggcaatggtatgagctgctgactggtacctgccagctgcctaacacctaaaaagtgtttcttcctctccctaggggagtcaggtgccctgctgaaatgcccacagacagtgggaaaggagaggtcccgctggctctttcagattcctcctatctgtagcagaatcttccaggattccaaggtggtagagcccagagttaagacaggggctctgaaaacatccccagatctgatgttttct

SEQ ID NO: 126664 - DNA, 1067 bp, Homo sapiens
agacactggtacagatagaaataaagcagtggtggcctctcttatcagcctgtggtccttaaacagtgtgctcccataggattcttgtaagtggactaatttaattcaggggcagggataaggctgagaactgcctactgaggaaagctactacctgtgtgtgtgtttttaatggacattatcatgtatcaggggaacttaatgttaagcgtctcccatgagttggcactgtggtagccaccttctacatgttatcaatcctcccaacacccatttattccacagtgaatagagtgagtgctcttgagggcaaaaccctgtgctaaacgctggagataaaagagtaaacaggacacctgccctctgggtgtgtccaggcacaggacacttagaccagtaaaccagtaattacagcgtgtgatgtgcgctaagatgagggactcagtgtactcgagcacctgtcctgttgtaactccatgatgtgggtattattgtccccattttacaggtaaggagactggggctcagggggttaagttatttccccaagtcccagagctaatgagtgacagagctgggatttgagcccagatctttctgattccaaagacagcatgtttggtcggcatttccagtgactcccgaagctcatggagcatgaaaatcacctcaggaccttttaaaaaatcacagatttgggggccctggccctgctgtccaaaagtaaagaagtggctgctgcactgtgtgttctctgatgtggaagtgcagcctggcacctgctctgcctcctgcagccaggatcctccctccacggggcctggcaagccatgaggccttagctcaaggcaccagggcaaaggtcactgatgctgcctcaagacagcgttgggaagattcggtccagctgttcaggtatttttatgtatttattttaaaatttcagcttttagattcaaggggtacatgtgcaggtttgttttggggggttttttgttttgttttgtttttttgagacagagtctcactctgtctctcaggctggagtgcagtgtcgcaatctcggt

SEQ ID NO: 126665 - DNA, 1082 bp, Homo sapiens
agcgcagtggtgtgatctcggctcactgcaacctctgcctcctggattcaagcaattctcctgcctcagcctcccgagtagctgggactacaggcaccggccaccacgcccggctaatttttgtatttttagtagagatgcaatggtgtgatctcggctcactgcaacctccgcctcccagattcaagcaattctcctgcctcagcctcctgagtagctgggactacaggcaccggccaccacgcccaactaatttttgtattttttggagagacaggtttcagcatgttggctgggctggtttcgaactcctgacctcaggcaatccaccgcctcagccttccaaagtgctgggattacaggtgtgagccaccgtgcctggctgaggttgtgcttttagagtcaaacaactccattggcctttttagttttatcattgttttctctggaagcgccatagagggaagcaaggagggccgggccaggagttggaagacctagggctgtttgtggtttgcagtgtggccctggccaaatcacatagcctctccaaatcccagtttacttgtctgtgaaaatgggaataataaagtctgccccttttaagctgctttgtgaataatgaagctgcacaccagcgtacattatcggccatgaggctgagacccaggattggacatcagaaagctttcctgggtgtgtaacttgggaaagtcacaggtttctctgaaccctgtttccctccttcataatgggggtaataatagccgcccttcccacctcacaggatcaaataatgtaatgtgcatgaaagagacataaactgtggggttttaacccacagaaatcctggggctactttaacagttgctgaccccaaggacagggctgattgaagactcacttctcagccaggtgcagtggctcacacctgtactcccagcactttgggaggccaaggcaggtggattgcctgagatcaggagatcgagaccagcctggccaacatggtgaaaccatctctactaaaaatataaaaattagccaggtgcagtggcatgtgcctgtagacccagatactg

SEQ ID NO: 126666 - DNA, 1043 bp, Homo sapiens
ccttccctgtggccactggggttggacagtgcccacgtgcactttcttccccactcaggtatcctatagctgattaactgggaaggtgtggggctatctagcatagctacaggactcgatccaaggtgccgctctatcatgatttgtatgggtggtgttttcttattgttgctgttgttttaaaaggggagaggttttgacacagaattattttatctaatttactcttcactgccccttccatttcctctgctttaccaaaagaacgttttaatgcttttgatgatattaactatttcatagttgtcttaagaaacagttatagttttcaacttctaatttaaaaatattaatattcttaccattacaaaaattcttatagattaatgagaaaaaatatactaattagagaatgggtaggagcaggcaaaatggaggaaactcaagtgaaaacattgaattttgagtgaaacattttcacctgaaaaatgttcaacctcactggcagttaagaacaaaagttacaacaatcagatagtatttttcacttatgaaaatgacaagtgtttagaaattactgtaatacccagtggtcatgaggaaaaagcaaagcagactttccgtcaagctgctggttatgtaaattggggctcccttcatgttgggcatttgactagatgtatcaaggacctggaaccaaaatttatgcttctcagaatttatataaagtaaataaatcaaattgcgtacaagcatgcctttaagggatatccactccagaattatccataatagcaaaaaattgcaaccaatatgaataacaaacaatataggctacagagtagcctctaaaataatcttttaaaaaatattttaggccaggcatagtggctcatgtctgtaatcccagcactttgagaggccgaggtgggcagatcacgaggtcgggagttcaagaccagcctgactaacatggcaaaaccccgtctctactaaaaatacaaaaattagccaggcgtggtggcgtccacctataatcccac

SEQ ID NO: 126667 - DNA, 1040 bp, Homo sapiens
ttcttgtggttggcagtgtttatacaatgcctggctgagctagtactgtataaaaggtatccagcagatatcatcattattattgtagatgttgttattatagcccaggtcaaggggatctagtgggaaagtggctgaggaaaaaaggatttcttcgaggtatttaatttgaaattgttttagcccttataggtgagaatgcacagaggagaagtgtgagtctttgttcccatagaattatttcaccagctcagtctggcagcctccaccttttcagttaatgctgacaatgtcaggcactctatcaggaagggaaagcataagtgtggaggctagaaagttccagagcttatggagagatctgttcatggctccaggaagaatgttctaataggtattctctctttgcttgctcctttaccttcttgctttgtcccatatttgtattctctctcactctctctctctctctctctattcactttgattagagtttggaagacttagaatatcttccttttgaatagggcctggtctggtcaatgatgtttacatgtcaacattcaggaatcactttcatttactctcaagctccatcacgtaagaaactccaaagccagccaggttaaaaaaaaaaaaaaacatgaaaggaggttgctaaaacttcagaacagcacacaatagccaacagagcctcagctggagggcaaggagggcgggaagagctggtgcacgcttgagtcagatgtttaccaaagattattgatggtctacttaatctgcagaggatcaccttgacgggagctgggctgcctgtcctgatttctgtccaactgtggaatttctgagtgatggcagattggcctcgccagctgcagcagctgccccgggctctgaggcccactgagaggcagtctgaggaaaggactgtagttgggtttttttgtctgttttgtttgtttgggtttttggtttcggttttagcatttactgactgagaatcccttatatgtgtttaggacttcatgatgtggaaagct

SEQ ID NO: 126668 - DNA, 1025 bp, Homo sapiens
atcccaactcaactactagacagttgtgtagtcttggaaaaatcattgatcgtcaatttccccaattacaaaatagggataagaatagtacataattcacaggattcttttacaagttaaatcagttaacgaatatcaagtgctgacaagtatatgtgagtgctagtgtgatttagttatattgctggtaagtatatgtgagtgctagtgtgatttagttatattgaaagcagtatcatgacatttgtgctagaccttgaagtattcatcacattttgatattcagaagtggagaaagggcactcctggtggtgggagcaacatgggcaaaggcagaaagacagacatacaatgacatatagagctgggagtttagttcaactgacacagcagtagtgctgaggggagcagcagcaaatgggcttagaaagccacttgatgtcagttggtggaaatccttcaaggccacacgaaagagttgagcttttgttctggaagtgacagagagccgtcctggaagatcttttaaatctatcttttcatacaaaggttgcccagtgtgatgtggctgtgagtagagcataataaccactcaccccttttaggtggttgtggttattttcttcatccctattcgtgtctgctccatgttgctggtgtgggcctctcattgtctgagtgaacattcaaaacaagtaagtaaccttgggccaggtcaccaaaaggattacatagtacagaatcctccatctagacattggaactcatggccccaagtctctgggccactctttgccattggactcttgtcaccttccagccacaaaattcttaaaagttcatactccccgcttacgagctttgagcaggaacctgcagctccacgctgttgttactccttccgccccttcattatttttatgttttgttttgtttaatgagaatttggggttagctatgacatcacccccacctccaattaattttatacccaaggcagcacatcttaggacacaaggaggaga

SEQ ID NO: 126669 - DNA, 1241 bp, Homo sapiens
actggcagttggatataggagtgtggacctcaggtggaggtcagggttagagagacaaatttgaggcccattcacacataggtgttacctagagccctgggaacagatgggattagagcagcttcctgacatttttcacatcatggctccactctgggtaaacagagagtaagaccgggactccagggcctcctgcccctcccaacaggcccagcatcgtcccaaaggccaaggggatcggttgcacctgccactcctttgcagcttcttgcattgcgtggccatgcagtgtgaagtaggggaaagagcccctagaacacagggcagctcgggaactggtcagctgggtgacaacagccgtggacccctctcagcctggttgcagcacccagaagtttcaaattatgtggtctctgaggacctttccttccagctgtaatgttatttgcctgtaagtcaagtggtacgaggcgtacaaacggaattcccgtacacggcccacatgaaaaaatatattacaaggatgttaaaagagaaagaggaaagagtgtaatcaattgtggagtgctcctctggggagaggaagttaatttcaaacttaccgaaaagttgcaaaaactgtccaccccctcccctatatatatgtgtatctatacagattggttttttaatatatatttatatttttaattttttcctgacccatttgagagtaagttgcaaaactgtatcccttcaccccttaatatttcaacatgtattttctaaaaacaaagatattctcttacataaccagagtacaattatcaggaaactaacatcattgattaaagcttattcaaattttgccagttatcccttagagcaaaaaatagttgttggccgggcacagtggctcatgcttgtaatcccagcactttgggaggctaaggcagatggatcacctgaggtcaggagttcaagaccagcctggccaacatggtgaaaccccatctctactaaaaatacaagaattagctgggcgtggtggtgggcgcctgtaatcccagctactcgggaggctgaggcaggagaatcgcttgaacccaggaggcggaggttgcagtgagccgagattgtgccactgcactccagcttgggtgacagagggagactccatctaaaaaaaaaaaaaaaaaaaaagtaaagaaagagttttaatcctggagtacatattgcatttagttgttgtgtctcttcag

SEQ ID NO: 126670 - DNA, 1049 bp, Homo sapiens
gaatgagggggaaattggtcacttaaaataagtttaaaaggcatgcaaaaaatgggaggactgaaatgcagcctctgacgatacacgcgtgggtgatgacatcataaacacacacaaggacacaaagactgtggagccaggagtctgcttacttttggagggaggtgggtggctacaagcagaccagacacatggagtggggtgcttggcaaagttctgtgtctccacctgcatgacggttacctggatgttgcccttcccatccctcccaacgcagagcatctctttcgtgtggtgttcagtgcccatgctttattttacaatacaaagcttttcttttaatgagtctactcagggttcacgtaaccaacagtctttcgggaatttcactttagggattaggatctaataataaaatgtgtctcacttttctcactaagagggaaattgaaattccagctggaaattcaccagtaggattgtctgacagcttggtcagaaattagagaaaaatttaaaaagaggaccagtggatggggcttttctaggctctggctacagaagactcccctggtctttatttttttccacgttcatttatacagtgaataatgtagttatcacttatagtaatggaataagcccttgcaaactcacctcctctaaacaaaaacaaggaccctgatggcagccatattgctccctgcctttcccctccttaccttgagtaatgtttaaagagcacagagatttgcttaagggaacccatccctgctgccagcacccatttcctctatacctgttgcccctgaaagtgccattctgaaatgactaccctagtggtgtgatttaggatgtcctctaacatccctccagctggggtatcatttctttaaggtttttttccctgttaaattcagtgcttctagagaaggaaacaccttaatatgaatgagttaggtgagagttccaaaagagggtaaaaccataaagagtatgactctggaaaccggcgatgagggcacaggaaggaagacccaaaaaagagg

SEQ ID NO: 126671 - DNA, 1481 bp, Homo sapiens
gttgataccattcagcaaatgccaacaaagcatttactttccaaagggagaaagcaagacaacaggagaaatgaaggcatctccaggagtggaccagagagcagccaagccatagagaagcatcaggtgtgagaatggaaaacgcagaagagacgtacaacttctgaaagatctcagaggactggcattgtctggagacggcttcctggaagaggagactccagcagagccctgaagtgtggacaagcttccattcactgcaaattcgtgagcacactctggtgtcaggatctagtaaggaaatgggcttgagcagagcagggggtacctgtggggttcttctcttcattttcaccaccacaaagctggtctaagctgccatcaattcccacctggacaactgcaaaagccttccagctgttcctgcttccactcttgctcctctacaattcattctgcacgcagaagtcagaatcaaaatcaaagttcatcatgtcattctcttgacttgtggcttccctttgctcttaagctaaaagtaaaaatcattatcatggctacaaagtcttgtgtggtctgggccacatcctgtgccaggctccctttcattgtctatattccagtcaagctggccttcaaaatttcagcacattgggtctttctgccacaggcccttgcacatacatgcttttccctctgtacatgtgattttctttcatccccgctttccaaagctaactctgactcatccttcagactgcatcttaatgattacttccttctggaagactcccctaattttcacaactagatgagctctcccttatatgttgaaaacaagtatttcttgtgtgaacagaaatgtttaatgtctgccttcccaactcagccacaagctctgtgaggatggggactcagtctttgcatccctcagagcctaacatagtctcagttaatacgtgatagctggagcgtgacatttcattaggaacagtgaggctagttgagaaattatacctcaccagtatataggagagtaccattaggaattcttaatgggatgaaaacctgaattcatgtctagaccctgccacctgctggctgtgctgttttaaataaattgcagatcctctcagagcctgtttcctcatatataaaataatggggatcctaacagccccctcatatggttgtagcaggaatttaattaaataatatatggaaaagcatttttttaactgtaaaaccatacataaatatcctttgtcacttttcccagtgcatgacacactgggtcattaaacatctattggatgggtggatggttggatagatggacagacagattaacagttagggggccagtatgagtgacaagaggagaacttggcatatggaaagcatgatggaagccagaaaaaggagagacttcccagaagtaggaggaggcttgttgattcatccacagtgtcacatgcagt

SEQ ID NO: 126672 - DNA, 1054 bp, Homo sapiens
agctgctgggtttcaaggagctttctatcggagaggcagcagaggggttctgaaagagccagaccctggagccaagctatctgggcttgaccttagctctgctattcactggctgtatgaccttcagccagtcctcatctctctgtgcctcaatttcatcaagctcaaaatgggggtaataatagtacctgtctcagaggttgtcaggaggataaaataagtaaataggactgcaacatgtaggagaacaccagacatctatacacttaaacacagcaaggcacttctctggccttgtgaatttcagcacatggcagagaagaaacaagctggactggctgaggaaagctcacctccagaggactgagtgggttaaccatgaattacatagtcattcccagagaggacgcatggcgggagagaagcagcaaggatcgtagctggatggatacatggccttggctggaccaggggctggcgagtataggggcttatggagggccgggttttgctcaggtggaccctcttgaaactcccggtgggcctcccttctacccccaggaaagctggaatcttgggggcttctgtgtccccaaaagcggattccagtggccagcatcttggaaatttttgtgcacttatttcacttgtatcagtcttttctagggtcatttactgatattatactttctctgctctggagtcattcccctgcaaaatcattcccctgttatctgtctgcctcaacacgggaaaaatccctgtcatctggaacccttgcttcctgcccgccgtcctgcctcactgcagtgtgtgggcagatctgctctctgctgcacacgtcttcagaaagactgaatttcgggctttcagagcaagcgtctttgaatccactggtgaaaggagacagcagtcatctgctggttgatgtttgccaaaatgtggccttagactgggatgaagtgatggctcctggcacggaagctggttccccctgggtgtacacccagcctgaacagctcctttaaaaccagaagcaatttgtcatcttttg

SEQ ID NO: 126673 - DNA, 1047 bp, Homo sapiens
acgggtatccatttataggactcagctgttgaagctcaagggtagcattaggcttaagcttaatcttctgtatactgtaatttacagcgctgagtaaagcattgtatgtacaactatttcagtcatttgccatgataaatagctattgctcttggcagagcagaaacgccatctatgctttccatttatgaatattgaattgtctcaggcaggcttttgccgtaagtttttaaaggggaaatccccaactaatcacatcactgcactggcccaaaatgtcatctccctgctacatgcaccagtcagatcttgatccaggcagcaattctgcagtgcacgtgtttctggtgaagcctgcacaaagcacttgtaacaattccaaatgcaagtcctgctaaaggctgcagttttacgccgaatgccacgagctgttagggagaagattcagctggtggcagaacgccactggcaaggatcaggaaaataacttagaggtgacaatctgatgcaggaaaaatggaaggggcatgattctgtgggattcctgatggtgaaaagatgatgccacctattgaaactaaggagacaaaaaggtaaaagaaaatgcccaggctataaatccctagggatctactcttcaggaactcagagacacttatgccttctaccagtcttctcttcagatactgtatgccctgctgactgggaggaagcaaagtggatattcaaataggacatccaggtagaatgaccatcttgtcctgggaaatcccttaggcctgagtcagccggtcaccctacactcaggcttccagaaatttcccgtcttcgcccccattccttcccaccaacaaacttcctgtgctcgggggactaaaatacttaggctggcattccttaatttgtctcacatttctgatcacccactatgggccaagcattgcctgagtggtgggataagagagtcaagcacgaacacgagtagagacagcaaacacacaaaatagtgtgccgtcgcctgtttttgaataccgtgaggtagactgg

SEQ ID NO: 126674 - DNA, 1076 bp, Homo sapiens
acagcaccagtgtgaaaaatagaatgtcatagtggaaaagtcatgaattttggagtcaaacagaggcaggttagaatcctaacatttacgggctgtttgaccttgagctacttatatgaccttctgagccttcttttcctcgtctataaaataaggatggcaattcctgctttgcagagttcctgtgaagaacacagaaaaaggttgtatcgttttctggcacatggtaagggaataaagaaaggattgtcaataaattgtggctattttttattaagttgaatgtttcttatgaaaaatgggaaaaccaattcagtcaagtgcttcctgccttcatttcttgccctgtctcagaggatgtgcacgctgaggtcagcccacagactttcgcctgtgattcatcttttgcttcccacactcttggaggcaagaaatgctggcctgaatatgattacatttgctaggagtcctgagggcttggctttgcaaatattggtttacattcacattaggcccctatggcagctcttttagaaatgccgtgaagctccagtatctctctgcgttccctgccgaggtccatccagcctgtgccatagcgtcctacaggggtgacatggagccccccgcccagggctggccacagtccttctgctcctgatcgtgtgccccatgctggcatcccagatgtagaaagcaggtgcaaccactgctggggagaccctttgcctggcatggaagtggagtgctcttggagccacgttctgtgtcaccccattagggatggcttcctagggtctgtttcctaagtctgtaccaacagccttttagacactttttaaacttctccccacgagatctaggatttcaagggattagtttgtttctaaagtcccttaggtgaatggataagcttatttaggaatagttgtagaaagggggaaacagaaacaagaagccttaccttgggagtcccagttccactctgcaggcatctctgtccctcgtagctgtccatcccaatttgatgcattgacatggcgtgtgagcctagtggttgagtgtaacctctctag

SEQ ID NO: 126675 - DNA, 1018 bp, Homo sapiens
aggggtccaagccccatggacgcagccttctcctaacttttttcaccccccacctgccagggctccacagaacattatttgaactttgttgatgtagaggagacagcatgggctttggaatgagacaaagcaattcacgactcccccactaactgtgcaaccttgagcagctcacctcatccctcttcacctccatttcttcatctgtaaaatgggtactctgcctgcctcagggggttgctgggatgatgtgactgatgtgaggcttaaggttcattttctcttcccttctctccatggcgtctttccccatcgcccccagctggatgcagttcttcgtgctgaacagccacaaaactctgttctcctgtgccacttcccctcctgccatgctgtcatgtgtgccacctcccgcttctcccatgggtgcatggcagtgttcaagatcttggtatactagtcatttaacttaaattgaaaaaagtgtgtgtgtgtgtgtgtgtgtgtttagccagtcagttatggggacttcagaaatttgtggttaaaggaaaactgttgcttactcaacatttctgataccaaattgtgagttttccataccaaggggattctctgcaggtaccaattcagtgtcctacgatttaattcagttccgacaataactacctgtagctggggccgggcgcagtggcttacacctataatcccaacattttgggaggccaagggagggagggttgcttgagcccaagagttcaagaccattctggggaacatggtgaaaccacatctctacaaaaatatttaaaaattagccaggcatgttggcatgtgcctgttgtcccagctactcaggatgctgaggtaggagaatcacttgagcccaggaggttgaggttgcagtgagctatgatggtgccactgcactccaccctgggtaacagagtgagaccctgtctcaaaaaaacatgaaccaaaaaaacactacccagagttagcacagaccccacaggtt

SEQ ID NO: 126676 - DNA, 1041 bp, Homo sapiens
ccagacattttctccccctgaaagagggtcaggagagagtctccccgagacttacaaaaaggagggctgcggccaagcacagcccagtgtgtggcccactggggtgctgccccaaggaaatggtgcatcagtaaaaccttacattccaattcacctttcccaagaatcctccttgttaaaaaaaatcccaggtggggttgggaactgctttccgtctctaaacatccttgatgtaataaattccttcagttggtcatcaacaaaccatggacagaacagataaagtccacgtggctgccccaccccggggatgaataaacagccatttggccttagactagaagtcacttaacctctctgggtggaagtttccttatctatagcagggaattggattagacaatttccaaagctgtaatatgctgtgagtccagcacagtatctcccaatctttttatttaagctgtattcccttttgatgaacataaaatctgaatgccctccttaccattaaggtttcgaagtacattctattgtgcctaaaaaaagtcaaagcaattataatattgaatatgcttttgcaaattacgcacatttcccctttctcacgttccgaatttctgacttttccccacctcttcagttatcattattctataataaaataaagggagttgagcttatccaagctctttaacagtctctctatatacaaattatcaactgcaaacacgtgtatatgtatgtatatgatatatacatatctacatatatataatctgtatctgtgtatatactgtaggcatattttgtgtttgtaatgtgtagaattcaggcttacggagcacctctgggagtgagtccaggactttcaaaccagcacaaggcaaagcaagggccctagaaagcgctataggaggaggtttggtcagaggccaagtcttctgcccctccctgcagccagcactgtgtcctcgggctacttgcttgatgtctcagggctttggtttccttgtccctaccatgggaagatgacttctg

SEQ ID NO: 126677 - DNA, 1060 bp, Homo sapiens
ctgccctctgccgcagcatgagccacgcacacgtcctatttatcacttgccaagtgtactgtgggcttgtgagtctcgccctgtctcttttcatgatctgtgagctccttgagggcataaatcatcgcattcatttctctgtaccccagtgtctggcatataatcaatgacaataaataagtgttggataaatgagtgagtagatgagggcagtgggtgagaccaacaacctcctgtttcccacactgagtcaccccaggttccccactggcacaagtgccactagctgccagccccctgaacttcctgcatatccaacttaccaagtcctggagcagctggcgttctccttcccaccccacagcactaagggccctggcaagttctcgcctgcccccaggaaggccggttatagagaaagcccttggcaccttagccagagctcatggctccctcctctagcacactttgccctttctgcctgtttaatcatgtcactttatgccatcccattctctaactgtctggctcaggttagcccttcactacatcagctcactctactgtccggctcgttcgttgttttaagtgtgtatgttgtcatcctagctgatcctcattgtagacaggagcttctgttctttattggttcttggacatttggtaaatgctacgccacgggtgtttattcataactgacctcagagttcttgttacttccctgcctgcctgtctccctttctcccagctgccgtcctctttaaaaaggtacaacatcctaagagttaagatccagcagccttgagttcagattttggctccagcattcccaaactgtgagactgggagccaatagcttaacctctttgagcttctatttccttatctataaaatggagataatgtcacccctgcaggtctgctgtgaggattcaatgaaacaatcaatgaacagcacttagcacagtacctaacgtggagtaaatactcaataaatgccggctgctgtgattgatgttttttcaataatattattttatcaataaatcttctccttaag

SEQ ID NO: 126678 - DNA, 1012 bp, Homo sapiens
tcttgcagactaaagccctgttcacatatttgttgtttaaaattgaaacaagtaagtcaccctttcttggttgtacatccccccacagcaactgccagttgacttccacaccctattttttccccagagctttcactccttgtcagaggtgttgaacactgcagtgcttcccacgtggcttctctgtgcctctgactctgttgctgggtcctcctgggcacttcctcatgactcacctcctccctctgcgagcgttcctctcagcttccttcactggccccttccctcctctcatcttcttgttatttattggtgttccccaaattctagccttaaccctgttgtcagacaacactgtttcacagggagactgtgcacaaccccagcttggcccccgcttgctcatgatgtccccactctgtctctctggccccagcttgcctcttggactgcagatcagtttctcacacttagtaggctgcaaaacaaagctctcctccccatatgtcctcagtctgctcgggctgctataagaaagtaccatagcctgggtggcttaaacaactgaggtttatttctcacaattttggaggctgacacccacgatcagggtgcccgcatggtgagtggacgggtgctcactgggcagagagggccctggtgtctcttcctttccttacaagggcactaatcccatcatggagctccacttttaggtccccatgtaaacctcatcattccccaaaggtcccatctccttataccacctcactgggtgctagggtctcagtacatgaatccagggggacgcagttcagtctctagcaccatgtaacctgcattcccatctgtcttcccctcttcctggtaggccaagccagaaagctctaagtcatttcccacagtggtcagttccaaataaatgtctcttgggtcctgcgtcctctctgtccctgcagccccagaccctgcagcagccctctcacctccagccttgttccagcaagctcag

SEQ ID NO: 126679 - DNA, 2627 bp, Homo sapiens
tttaaacttgcttttcatttaccctgtcaaaggcattatcccatgaagacataatttgagaagtatcttcatagaaaatagctctcattgcataagccatgaatacccttgccggtggagtccatgtattgcttctttagaaattgtcagtgctcacagctctcatctccctcagtgaattttctagcttccaaaccctgtactttttctcccaccagttctttcttccccttaagctctgcctccaacaaactgtggactgtgtgcatttagcttcagcctcttcttctataaaatgagaataataatggtttctccctcagaaactttttgcatggaaaaaacatgatattgcttacaaagtgcttagtacagtagttggcatagagtatgtgtttgataaagagtagtcattatttctctttgttgcctcctcagttcttacattcatattcacctgtctccctgaccatatttacctggtttatctgggactttgttgtattttcctcatcccatgggattaaaagcaagcacagcccctttccaagatgctgtgtgtgcctggagcctttctggttcaagatcttctatggacaactccacgccttgggcttcctccaggtcattctccctgtccttcagggatgggaagcattgatgtcacctggctgtcttccatatcagcaggactctgcttggttctgaataccatgttccttaactacttgtgcggtaaaaatgtaatttatgccctctaaaccccaatcctaaactgtgagccacatacaaggaagcaatatggcaagggcagttaagaacctaggtttggggccacactgcctgggtcaatccctgacccttggggcaagttatgtaatttttttttgtgccttggttttctcatctatcaaatagggataaaaattctgatctgtatttctgaagagtgcatttcaagcactctgaaaacaaagttgttttttttcccctaaatttgaggcacactcatttggcatcaaagtctgccctgaactgacatatgactatttattatgcactttatccaaattagtgtgattattcctatgtttcactgcagaaatattagtgtttctgattataggatgcagcccgactgctggggtgttatataatgtacaccatatgaccttactaaaacctgataaattcaatttgggaaaaccactaagcccaagagctttggataagggattgtggatctatagtagctacttcatagggttgttgaaaaaattaaacaagatacagtcatccttagtgtacacggagaattgcttccaggacccctgggtataccaaatccatgcttactcacatccctcagtcggccttgcggaacccgaatatatgaaaagtcagccttctgtgcaggcgagtttcatgtctcacaaatactgtattttcaacctcatttggttgaaaaactttggtatataagtgaacccacgcaattcaaacccatggtgttcaagggtcaactatattttgcataaagctcttagaatggtctctgaactgtgaatactcaataaacatttgctattattctcctaaagacataaaagagtactgtgtccatgagaatgagtggtttattttaccacagtaaaaatgtttgttctctttttaagtgaatggtttaaatgtttaatgaatgatataaaaatgaattttactgcctggatctaaaggaagtttgctgtttgttttggaaagaggctccaaatccaacaagagaagtcagtttcagcaaatatggatgccactttgactgtcagattttcttctgtattcttgacccagagcttgcttatgccagcaaagacagagtccccatcctttccttttcaacctcgccttccgttctgcatacattaaacacaggttggagtggaatccaaggtggccttactctgagatgttgtgcttcctggacacctgtagttcaggtggtccctgctgtcttgtgtctttttcatacctttgtcctcgatggcaaaccgtatcagctcttccttctatatcccaaaggtaaaatatttgtaagtctcttgtaaaatattacagctactatctttctcatcatttttcatccccagtctcaagcttttgccaaaatcatctaccattcagacttctctgttcacctgtataaaaaccatgggaaggtcctatttctccactgtccagcctccttctcatttagacctggtctgggtctaaccctccttgtctatttgattattattgctttgtttttttcttggtggccatgttgttttatcttctttgacgatcctgtgttttcttccatattgcattcttctgcaaaatagtcacaatttacattcctctgtgtctggcaaatcacaagactcccttattgcacatttttccaaatgtctccattttttaggtatatgtctatgtaataaaatgctattttcttagcacagtgctaaataatattacagtccagtaattcaagtttggatgataccaccaacattggcagagaacccaaatttgcacattagaaccatgcagtcatagaattggacagttgggaaggactccaactc

SEQ ID NO: 126680 - DNA, 1043 bp, Homo sapiens
gaagcacggaagtcagaaagggaggcttgtgctgggatagtaatggatgtggttagcagctgtgaaggtagagctggctctacttcctgaaggattaaaggtgggatgtgggcaagagaggcgtcaaggaagattcttagattctttgtctaagcaactgggtgaatgatggtggtataactacgatgggcagacttgtgtaagaagcaggctctggggaggagagaaatcagtagttccgttctggacatgttgaatgcaaagtggaaacttcacctttcaaagctttccgtggagaagtcaggcaggcagtggctgggtgagcactggaggaagggaagaggccagaactactccaagttgttggtgcacagaaggtgcaggggcatctgcaatgcccttgggggcaggtgtgttttcgaattcagaattattcagactttggaaaagtaatcgatttacactcactgaggtctggggcgtcacctgtcatcaaacacataaggtatttctgtagcaaatcgtaatcttcacacttaaacagattaataaagactagaaatagcctcacattagttcaggtcaggtgttgttatgaaggcagtttagtcaccaaattaggtaaaacttggtttcagagctcttgagtttccgaattgcagaaaattagcaatcccctccctattctcaatttctactccccaaatgcaaatactttgaaaaaatttttcactgttcttttctgtttacttctataatgtcaagtaactgggttttcctgccatctcaagattcttaaaagctttatattatctactaacttgccaccatgaaaagtgagggcttatttcttcaataggccctccccactgcacaccccttttccatgcagccttccaatatagtcacatggccatttctcactaaatcagcattaggggcttatattattatgatcatgtgagtattactcacagctgaatgacctgccatactattattacatgtcctttcttaaacaactctgatttcttcagtctttt

SEQ ID NO: 126681 - DNA, 1057 bp, Homo sapiens
tttttttttttttaattatacaattaaggctggacactggctcacgcctgtaatcccaacactttgggaggctgaggtgggcaggtcccttgagcccaggagttcaagaccagcctgggcaacatggctagaatccatctctacaaaaaatacaaaaatgagcctatcatggtggcatgcgcctgtagtcccagcttctcaggaggctgaggtgggaggatcacctgagcccgggatgcagaggttacagtgagccatgattgcaccactgcactttagcccaggtgacagagtgagaccctttctcaaaaaaaaaaaaaaaaaaaaaaaccacacacttataaattattaaaaaaaaaaaacagcttccacaggggcatggagcacagaaagtgaagcccctcctgcaccctgcctctcccccagcattcatgcagcttgacctcattctgtttaagggtcaagaggattccattgttttggttcaaccaaaacccattcagtgagtcccagagaccacttttagccctgggaaaaactggccctggattcccagtaggcatctgaaagaccctggttttggctgctagattgcgtttcgtctgcagccctctcccctccactccatcacaaaaaggcagcctcaaatttcctgtaaagaagagtacctctccccgttctcagcagtgtggcaggattcgttctagtcatgttctctgaacgttattgaagttgtttttctgcaagcctacagtgtgtgtggcagtacgctcagcccagtgagggaggcagagcaaagcagttgctctctctcaagaaacttacagactcatcagaaaataagaatatacccatcagaatagcacccttcagcaaggtaggtgtgcgtatcaggatcctaaaatgttatgacgtttgaccttagtattgcatttctgggcacataaactgagtaggcaaacattaggcacacagatttatatacaaggattttcattactctgttgttgataaaagtgtaaaattgaaggtggcccatagttccaaagataggaga

SEQ ID NO: 126682 - DNA, 1986 bp, Homo sapiens
cctggcaacttcctactcatccatgaaggcccagttcaaatgaggtttccctgacaccaccctaaacctcagacccatgcagaattagccaagtcctcatctgtttacatagcacatttcaggtgtttctgttacagcatataataatattgtattatttcttatttcacctgtcctcctttctggtggactctgggtgcctttaacacagaccgtatgtctcatttatattcctctttcccatgcctggcacatagtaggtgctcagtaggtgtattttcccatgggtgttcatgggctctctgagtgcaacaaagtagatactcatcagtcctctctgccctgcatatgaggctggacctaaggctgtcatcccttgtggggtgtttaagttcttcctctcctctgggtatcatgagcagagatgcagggagaaaagggagaagactcatctcatctcaccttgtgctctaactgtaacagctgccattcagacaccccagatggaccattcagtgtaggctgaatggccaaacaggctcatatgtgctaatcaggtaccatcttgaacccagtccaaacggggaagctgccagcatttacacccatgtgcccagcaaactgggagtgaaggcagtaaagagtgcatcgggctgagacatggaaagcccagggttggatttggagtgtttaggccagggtgagatgccaaaccatcaggcaaccatcttccatgttcaagttttgattttcattttaagtgcacaaaatccacaagcttttttttttttcatgcagcagcaacagcttcctaaaaacgtctctcagctgagccattgcccataacagcatgctatttggcctttgtaaaaggaaaaacctctgtatttgtatctagaacacccacagctgaatgtgtcagatgctgctggctagtttgattggttgccttgcatgggtggcttcccgcaggggctggctttcctaaagttgagtgggcagtcccgagttcttcagagatttctgcctaacctgaggaatgcctggtttaagcagagatgatgcttcgtgaaggaatggattcctttgcttttctgttgggagtgactgaggttcctagagtctttctcgtgagtgaaaaggaagtagaggtgtgctccagccaactcttcagatgaggcaagtggattgataatggaacattcctagactcctagagacctggctggcagggtgcccggtgatccaggagttcgggtcatttccacgttgctctgggcccttgtttgggtgccagacgcgcagagtaattagaaaggagtggaacaatcagggaagatgatgtttgccagccacaggcctttttttattgtccctgtgggttggatactgggctgatccaggtgggacagagatcagtttattacccagtctctcagcccctgctcctggctggaatttcacagaatctaaccgatttctgcacaggccactcctcttatatcaaaaggctgaaatccctaggggtgtggcctatgcagcagctgtttctctcctggtttccaaggataatgtcaagtgcctccgagtgtgtgaaattctggctgaaagtgaatgattgaaatgctttttccattaaaccatctccctcctggtataggtattttcctaacaacgcttatgcaaatagctgtgaaaagtaggaaatggtaaaatgtcgagtgtcttcggctcctggcagcatgctcagccgaagccttctgattttccaccaaaaaaagaaagaacgacaggcagaccaccagcctttggtgtggcactgggcagacacagctgggaggcctgtgtcgttttcttgtctgcttcttggagggcaggattatgttagaacactgagccattatgggtctctaggatcacatattgcgctttattgtctacacagccaatgtaagttattgatttgcaaatgggaagcattccttt

SEQ ID NO: 126683 - DNA, 1401 bp, Homo sapiens
atactatatatattttaaaatagaaaggaaaattacaagtgttggcgaggattgtggagaaattgaaacccttacacattgctgttgggaatgtaaaatggcacagccactgtggaaagcagttcggcagttcctcaaaaggttaggcatacagttatggtatgatccagcaattccacttctagttatatacctaaggtcacacaaaaacttgtacaccagtattcagagcagcactattcacaatagcccaaaggtagaaatacccaaatgtgcatcaaatgataaatggataaatagaatgtagtatatcctacaatgagaattattcagccaaaaaaaggcgtgaaatatcaatacctgctataacatggatgaaccttgaaaacattatgttaagtgaaagaaagaagcaaaggaccatatattggatgattccatgcatatgaaacattcagaatagggcaatccgtagagaggaaatagattagtggttgccagaggctgagcaaaaaggggaattgggaagtacggggtttctctttggggtggtaaaaatattctcatattagatagtggtagtagctacacaccattgaggattacacattgaattgtacactttgcaatgtttaaaataattaattttgtgttatatgaattttacctcaataaaaattttcaaaaaaaaaaaacccttctactttaatggttattgctgtaagatgacaatatacattgtttgccatgtaaaggccctttcccaggcaggaagagggactggccagagaataggtgcttcccagagtggcttgacgtggcatgaagagtacggtctgggagccaaagaattctagttccccatctcacattccagccgggcaacttcaggcaagttcctcagcctggagcaccctgtttaagtcattctaaattgcagatctttctctaagaatgcttataaagtacccactatgtgctaggcattagtccagtagtcccccttatctacaagggatacagttccaagacccccagtggatgtctgaatccacagatagtactaaaccctgtgtctaccatttttgcctatgcatacgtacatactgtgatagtttaatttttaaatgaggcacagtaagagattaacaataataactagtaacaaaatggaacaattataacaatatgccagcatcactattcttgcgctttggggccattgttcaggaaagtaaggattacttgaatgcaagcaccgagatgccacagccttccatcagatgactgagacgctactaagtgactgataggcaggtggaatagacaatatggatctgctgggcaaagggatgattcatatcccaggtgggatggagtggacagcatgagatttcatca

SEQ ID NO: 126684 - DNA, 1001 bp, Homo sapiens
cgccacgatgcccggctaatttttgtatttttggtagagacagggtttcaccatgttggccaggctggtctcaaacttctgacctcaggtgatcctcccacctcagcctcccaaagtgctgggattaaaggcataagtcaccttgcccagcccacaactgattcttatgtatgttcttttattccgcaaccgtgttaaacttgtttgttaactctcatagttttctttgtgtgtatttattccttagggctttctgtatataaggtcatgtcatctgcaaatagagatggttttaccttttcctttccaatctgaatgcattttatttatttttcttgcctaattgctctggctagaatattcagtataatattgagtactgatggtgagagtggacattcttgtcttattcctgatcttggggagaaagcattaaatctcttactattaagtatgatattaactgtgggcttttcataaatacactttatcaagttgaaaaagtttccttccattcttgttggttgagtgtttttattaagaaggggattggatttgtcaaatgcattttctgtgtccgttgagatgatagtgtagttttgccctttattatgttaatatggtatattacatggattgattttcatatgttgaaccactcttgcattgctgggataaattccacttgttcatggtacataatcctttttatatattgctgaatttggtttgctagtatcttgttggagatttttatgtctatgttcagaagggatttagttttcttatgatgtctttgtctggtaaggtgatactagcctcaaagagttggagagtgttccttgtgactcagtcttgaccaatagaatatggcagaagtgacacagagcctgggtcacaagggtcttgcaacttctgcctgagtttctttgaaaactcactgtcaggatgcaccttcttggatccagctaccaagctataagaagtgcaggccatttggg

SEQ ID NO: 126685 - DNA, 1281 bp, Homo sapiens
aattccctgtcattggatatattggttgttttcaggttctcattattaaaaataatattgcaatcaaatgaatatccttgtagctaaatttttgcacacattcatgattatttctaaagcataaattcttagaagtggaatgctgagtctaagagtgtgctgtttttgaggcttttgatactcattgctaaattgccctctagaaatattgttccaattaatactcccatcaggagtgtatgagagtggctgttttcccaactctggccaatatctcaccaaagattgtcagatatttgatgatttaataagttcaaatgttatcttattttagttttcattcttatgattactaataaggttgaacatttcgttagctttgtgtatgttcttatatgagttgctttttcatggtttttgcttaattttccattggcctattaatcttttttcccattgttttctaagagccctctatagattaaggctaacttacccatgtctgtcatatttggatcacatgagttttaggaaatcttaatgctcaaacattttctatccaatcttgcctataggaccaaagtagctaggaaaatagaaatttccagataattctcaaaccacatggcaggtgttactgaatgctggcaggggccatttcgtatgaatagttatgctgacaagacagtactaataataaaaactaccatttactgaacaactattatatgccaggcacttttcatatatattagcctttcagtcttatcaccctgcaaagagccgagtaaactggggcagagaaaaattaagaagctcttttaagatcacacagctaataagtggcagagccaggatttgaacctggatctgttcatctctaccacccatgtactttctactgtcctgagctcttgttcttggggtaaacaatagttttacagtttaggtcttccttagcaccatccacatctggacctgttggttggctctagaagagtcaaccctgccctgattttacctgcccttgctgctgtacattatttctcagctggacctgttctctaggcttccagcctgcatgctttctccttgttgctagaggtcctgtctgactgttttgctactgataaagaagcccaaaagataccaggatatgatttctctctcaaatttcaggatcaaaagttaaaactagatccatccagtccttaatctagtggccaactcccaatgttctcacccatcaagccaagaagtgagttggagtgcacatggtaa

SEQ ID NO: 126686 - DNA, 1168 bp, Homo sapiens
tagctttgcagtcagaccttagctaacttcttggccctgctgcttgcttgctgtgtgactttaggctagctaccttgcctctctgttcctctgcttgctcatttggacaacaggaccagacctaggaagattagggataagtcaccagctgccatcctatagatggtcagaaaaatggtagctggtattattgcctggaggagagggcaggtctgagaaatccagtggtttccctgggttagtttcagggttgtaaatcattgtgggatacacataaaaaacgagccagaatttgagagcaaggggagggaggtgttgtgggaagttgagtttggaagtgtctaggtgaagaggtaagttataaggaagcggggcagcaggaaggaataagaactgaagtgacatatcctgggggcagagatggctttctgccccttttgatattgactttcattatctctgagatctgtctgtatcttgtcctccagctcagcctacacaccagggcccccactgagggcatttgcagagtctggggagatgggaaaccgggagctcctgagagggactctcttgcaggcaagtgaggatcactttccaaacaggcaggccatatggagcatgggtaccccttctgtgcagaaggagacaccacagtgtcttgcagcagaagcccatgctcgctctgtgctcgttcttcaggaggcacagggatcagtgctaggcctcttaagtcagagagatctgggttcagcacagaggaaagtcctataacctctcacagccttatttttcccatctgcttaatgggatatcacaggtagctcatagggttgttggcaaagttgaaggaagtgaacacacagcatttagctcaatgcatggcccatgggaaatgcgcagtgaacatttcctttggttgccattgagtagcccctggaacagaggactagggggtgtccttcaggatgagcttcctcatggtcctctcctgtgggaacagtgtgctggtgaaggctgtattcccgatgccatggggcatgacaggcatgaggaaatgacatctggaaatggtccttaaaccagggccctaggcagggagccaggagtgtgcaaacgtggtggcacatctttcagaatgtcagttcaactctaattctacaggaaa

SEQ ID NO: 126687 - DNA, 1065 bp, Homo sapiens
aataaatactctccagggcaggacgaagtggcaccaggtcaccataatggggaagataaaagtgagtcgatgacaggctctttgaacacagaagcacttaccggtgtacctgattctgtgatgctaattgtaaatctgtgaacattaatggtgtaaggatacccttaactgtagggggagtgtgagttacgtgaccttacctcaaggcattgacaggccacagagtcctggggtggggtggggacacaggacacccagtccgatgatattaaccacaggtgagttcagcattccaggggtatggaagatgctggagacatggtcccagtttggttatatcagaccaaggtgatagtccagttctcaaaaagtatatgagtcacaaaaggacaaatactctgtgattccatgtataatgaagttcctagagtagtcagattcatacagacagcgagtagaatggtgggtattcaggggctgggggaggggaaacggagagttagtgttgccatgatacagagtttcagttggggaagatgcaaaagttctggagatggactgtggtgatggttgtacaacattgtgaatatacttaatgtcacagaactaaccgtacacataaaaaatggtgaaaatggcccgggtgcagtggctcacgcctgtaatcccagcactttgggaggccaaggtgggcagatcacgaggtcaggagatcgataccatcctggctaacacggtgaaaccccatctctactcaaaatacaaaaaattagctgggtatggtggcacgtgcctgtagtcccagctgctcaggaggctgaggcaggagaatcacttgaacccgggaggcggaggttgcagtgagctgagatcgcgccactgcaccccagcctgggcaacacagcgagactctgtctcaaaaaaaaaaaaaaagttaaaatggtaaattttatgttatgtgtattttaccacacacaaaaaggttcattggcattgcaggcttgggagtttaatggagcattatttaaatcttgaccatttattggctgtgtattaaattaagcc

SEQ ID NO: 126688 - DNA, 2197 bp, Homo sapiens
tatataattttgtcttcttgttctcacgtgaatgatagaaacctatagtattagctgatatcttgccatttccatttatcttagagagctgtccatgtcagttcatgagaagtcgccatgttctcttttggtgcctgcatagtagggtaacaatttaagcctctgggtgtcttgccaagtttttaatacgctcaactgtttctcagcctcccttatgtgtttgacctggagggagctctcctgacgtgccagaactgggctagacaccagggacacagcagtgaaaaaccacaacccctgcctgccctcagggtgcttccagcctggtggcgaaagtacaggtagaccgcgatgagtgctctgatagggaaactcaggtgctgctggaggtcatggtgggggggcctcactgaggtaggggctcagtgccggcctcccagaggaaattttatgtaagctaaaacctggaggatacaggaagttacccatgtgtagagctgggcaggacagagttagaggaaacgacagggataaaggcccaagtgccagagaatatagactgttctgaacctaaaaagtcctcttgctggagtaaagatagcaaagcacacagtagtataatatttctcaccagtggcaccactgatggtttgagccagatgcttctttttgggggcgctgtcctgtgtatggcaggatgctgagccgcatcttgcgcctccacttgctagatgccagcagtgtctccctcccctcccccaagtttagacaaccaaaaatatctccgtacattgccaaatgtcccagggggacaaatcgctctgatagagaatcactggctggtgaggctggagaggtaagaacacaagaaaaatagactaagatacagaaatattctgccaatatctgtccatgtgttaggccttcagcccatgtaagtcagccttgtcgattactcagcagatatacctgtactgtgactatcccctggcgctgagctacatttgggaggatctaaagagagagaagcctcggtcccccagggaaccctcctcccaaagttcccaagatgactcttccaaaccttggagtccagtctgcagtcactggtgacaatagtgagttgcaggttctaattctgggtggcccaaccctccttcactgtgggtggaggagacccaaagcatcaattctggtaatgatggcatttattatacagtggcccccgatgtcaaaagtaccacatcgcattggtgaagcagtaaggatttcagtttatatttaaagtcaggctgaaaatacaactggcgttctctgcagtttgattacccacgggatatgtctgaaatggggatgcacatgacggaaagcaaagtggctgctttcatgatttccatgttaagcctgggaaggtacaaagggcaggggagggtctgattcctgaggccttctgacctgtgtgccaggtggtctgcagcatcagttaagactgtgaggccatgttgatgctttcagccggcggttcccaggggcctgccgtctctgctgcagaattgatttagaaaagttaggcagatttgtttctgtatggttttccgggttggttgcatttatatccttcaggttaacgtttcgtttatgacattttgtttcattcatgacatatttcagaagtaggcataagatggtagtactcaatgcagtgagaccttgtcctggtcaaatccctcttctctaaggaccccacacactgaggtggcccactattcacatctggagacagtggtcactgagtgattgcaataatcaaacatagccgtaatggagagggagagctttagccagtgggttctactttttcagaatattgtaggaatggcaaggactgacttctgtgtgtgactgtctcctaaatctcccggtccagtgttctgctgattacgtgctcccagctgatgccgtttggctggcattctcttactctctcctgtggtagagctcagactgccaaatggacctggatttggaccctgaggcgcttgaactaatgatgaaacctcaggaaatcccttcttgcaagtgggctgaggctacagcggagcatccttaatattcaggggctagacctggctgccctagtcgtctataagtgaagctggaattctgctgtggggaaagcaatgtttttatggagaca

SEQ ID NO: 126689 - DNA, 1035 bp, Homo sapiens
gcaaactgtttctaaagaaacttaaaaaaaaaaaaaaaaaaacccaagccctcacattaaaaatatcttaaactacttcaaaaataactgggtttattttctcaatttataacttcttggtggcaaaaatcactgcatctcatacacaagcaatattctgctgcaaatcatttgtgaatggtatttggccttcagcattccgagaaaagtggggttctgagtccaaaacccaatgtgttcccctagtgaggaatgatttgaccccagtcagcttggatcagtcaggcattcagatttcctgagaggaggactcccagaaaccttattagcctaatctgtgaaaggtgtttatgagagaaaattccaaggacggccattcttctgtgctaaccttttcaaataatttcctcctcagctttttcaagctaattagggaaaagctctcagtgatttagaaagatgttccccttgcctcacctgaatttttttttaaagaataccaattcatagataaggaatagggttcctgtgcctcataagtgtccctaactataagacagaaaagaataaggttgttgtgatgattaaatgagataatacaaaagggcttagcacatagtaagtgcttaatgaatgttggcttttactattattatcattattaatgaagctagctctagaaaactttattctaattaggattttaaactaatctgtgatgaaaagaaaagatacgtagcagaaactttatttttagagtaaaccattttgttgtaattttatgacactaatgattttttaaagaaacaatttctatggatatcaaattttttttttttttttttgaaatggagtctccctctgtcacccaggctggagtgcagtggtgcgatctcagctcactgcgacctccacctcccaggttgaagtgattctcctgcctcaggctcccgagtagctgggactacaggtacccaccaccacacctggctaatttttttgtatttttagtagaggctgggtttcaccgtgtta

SEQ ID NO: 126690 - DNA, 1085 bp, Homo sapiens
gcggtgcgtatctccggctctcagagaaccactgcatggactttgctccagggtcagcagagcgggagggcgaatttacggctcttggaagacgacgctaacgggcctagcccctgagccgtttccagcgctccctgccgtgagacgagggtggcccgggtttgcgcaggcaacctttggccaggaatctgattcctgggagaattcacttcaggcttaactgctctagccagctagaaagggagcgctagatttcctctggattttggacgttgggtgctttagttgagattttcaccctttaaagaaggctttaaaaagtcttctgttacttctttttaacaaatccttttgtttactagaattatctaaactatatggacaccgccctcaccccacaagcgacatatttttttttctctttcgccagcacccttttagctctcaccactgctgtttcccaagttgtcacagctgaagcgcactgattggaagttgctttgtactgactgagttctgccctggctgaaccatctaataatttccctgagcttggcaccctgtatcgctaagccagtgttaggatgggcgatgaaggaggagctgcggatttgcctttagttgtgatgtttgtgtgagtcggcttgtttgtgtcagactcagataaactgcatttgcctttgctctctttcgaagggctcctacatagctaaggtgtcgctgggtgaagaattcccattgtaagaattggtggtgttaacaaatatgtattacttgttgacctcttgttatatgctagaccctgggcttgacatttccttccttccttccttccttccatctgtccatcttaagtcaaccaatattgcctgtcatggaacagctgtgccctcctgtcaggagggaaagatgagtgagacccatcctcaccctcacagagatgcagtctggtggtctctggaagaaggaagttgtgaaacttaccgattccttgggaaaacaggcaggtacacagggactggcctgtgcagtgggtggggtggtctctcagctgtgccagttcatagaggaaccgaaatctagtt

SEQ ID NO: 126691 - DNA, 1082 bp, Homo sapiens
agtataatgtctatgtgataaaactatctagcaaaggcaaaacaccctcttcccctcatgattaatgtttaggaagaaaaaaggatgtaaatatttttattgttttattatctttcttaggaaaatgacagtgtggttggtttaattaaaagggagagtctcccatagaccaaataaagaaatctgttctgttttaatgacaatggaaaatacctatttaacttgaataacacctggttctgtagaaatgtgcatctattatgtatcctgcattcacttagtctgattcatgtgctgtttcaccacattactgaaaagaagagaagagggaatgttagctctctcatttgaggatattaaactcctgccgtggttgaggcacggtgtgagcaccctacttcctacctagactgttgggagttacctggaggcaatgaggagaaaatgacatgttccattagaatgaggcatccctggaattatttgatgttctttgccttaattgaatccatctgtcccatctgccactcttctctctaaatttatttccctaaccctttctccctgagaattataatttgggggaaatttgttacctacattgttaccttttataaaagctctcggcatctggagggcaggtgtgccttctactctgccttgctagacaactttacctgcctctttcctgccccttgcaggctgctggattaaaaacaggactggataaaaggcccccagtagcaacaggagtgggaacgaaaatagaaattccaggcttttacttattggtttcaatacagagccctagccatgtgccaggcctggctaaccgtggactctattaataaatataactacacaaacatttgcattctgactgggtcagaacagccagcacgggagtgtgttatctcaagggaaagctgtcttaaaactcttgactgattcacctgtgactttggccagttggtgctccctggaactgctctggtgctgaaggttgaggtcatctctgttccccagaatgtggcagatccagccccattcctgaccactatcctttgcaaggacgagacagg

SEQ ID NO: 126692 - DNA, 1061 bp, Homo sapiens
tctaacagatggaagtagttttttgaagcaggtgagccttttcctgatgctcactcaggtgctagatggactagcagaaagaatggcgtcattgatgtccctttgtatgtgttaccagttcatctgggaattttactttttgctggaaaaggagtcaccctcccttgccaaccacatgtgtggttatacattggtattgcagagtgatgccatttacaagtaatacatttgagttggcagatttcccaaggtttcttttgtatatgagaaacatagtgccttgggtcatggaataaatataagagcctcggtatctaattttggttgttcacacttcagttagggcttaagtcatcctaagctaggcttggaagaaagagacattgacatttgtattagtttaataaatttggcagcagggaggtgcaaagaatgttatttcaattatagattgacccatgattgatttagcaacatgcgttgcttaggttgtaatcgatgccaagtaatggcaggttctggactcttaggaaggtgggcacaaatgttggggaattgatcaatggatgagctccatattggccttctacagggagaataaaaatacaagtaaaatattgtaagatgggagtgatagcattgcagatgttaacacagcctgtccaagcttttatcctttgtacctacgcagccattttttttaacacatgggacactattcttcaacagatttgttctcttctaagtttgttctgaatctgtagtgtgtgtcatttcacggtgttttaaagaggaaaaggccttgcttcagttgagaaggctttgatttttccacctacacaaataccctggcattcagggaatctggctaatttaaaaaattatctcttataatgcctagttactaccccagttcgtgttggaggtggagtatacaaaggaattacaacccccactttataatcgggataagagaggttgacagacttaccttgcctggcccagtgccaagtgccacgtggtatagactaagaatagttgcttctcacgaggagcttatt

SEQ ID NO: 126693 - DNA, 1083 bp, Homo sapiens
tttactttagaattcaaaaataagcaaaactaaactataaattatataatatagttatatattgatattatatagcatagactgttgaggaaactataaaaaaaagtaaggaaacaatgatcacaaacatcagagtagtggttacatctaggaagggaggggccctggggcctgaagggagtgctcagagtgagaggactctgcagtgcttgagcattttctgtttcttgacagaccaggtagttacacaagtgtttgctttgtgattgttcattatactgtatatttgttttgaacactctaagagtattttattccacaatttaagcaggttttttaaaaaaaaaaaaaaagatagctaacacttgtaaaatgcttggcatagtgcctggcccatattaagagctcaacagatggcaattttatttactggtataacccagttgttagagccacattgtatcctaagcaaccttccagctcctgaaccagctctagtctccatgcggtctggctttgaggttgagattccagatccctctgtttcccaggctggccccaaataaaccctattacttaaggcagtgcttttcaatggatatgtgatggtttattttattgccttaaatgcttcccaagtgagctgcaatgtgtaagatgttttttgggagcatttctgttgttatacagttctggaaagctagattgctaattgagcaccgcatgatgtgggatagagtcagagtctagcctgctgcaggtcagagttcaggcagcagaggtggaacctgatggcaatgtagtgccaaagaaaaaagacctgggtttcaaagacagaggctatgagggaagtaaagacacactcaaatagcagtcatgtggatggggaccagaggaatcccaggacaattgtggataccattttaagccttcaagtgtgtaaccccaaattctagcattccacagaaagagtgacaatcactgatttaaggtaatctgagaatgtctattccttgcaagcctaataaagaagtttccatttcatagtcatcagaaggattgttgtatgcaatagctaatgat

SEQ ID NO: 126694 - DNA, 1251 bp, Homo sapiens
catgggcgcaagcagtcctcctgcgtcagcctcccaagtgctgggattacaggtgtgagccacctcacccagcgttgcatcagatttttttttttttttttttttttgagatggagtttcactcttgttgccctggctggagtgcaatggcgcgatttcagctcactgcaacccccacctcccgggttcaagtgattctcctgcctcagcctcccaagtagctaggattacaggtgctcgccaccatgccgggctaatttttttatttttagtggagatggggtttcaccatgtaggccaggctggtctcaaactcttgacctcaggcgctccacccacctcggcctcccgaagtgctgggattacaggcatgagccatcgcacctggctttgcatcagattttttttaaaggaaataaaacattacagataaagccttttccttactgaggtaaagttacatttttcctacctttcactattaaaaatagcacacaaatattcttctgcagtgtgtgaaggcttctctaagacctatcactagaaatgggaactattggaatgtgagatgttcatgttttccattgtaacctaggtattccaaattgttcagcaaaatgtctgtaacaagttagtctcccaccagcaataagtaagatttcctcttgctccatattgccaataacttgatgtttttggactattgccaatctgataagtttgaaattgtgtctttgatgctttaaaatttatgttactctgattgctatttaggttggtggtcctttcctgtatttattggccatttggtttccaccaccctgtactgcctattcatatcctttgcaaatttttctgtttggtgctttttcctgctgaattgacgtgctctttatgtattcttggtattaacctcttgacatttatagaggttgcaaatatcttctctctgttcctggcttgcattttcactttgtgatttttgtcatataaaagttctttatggccggggtcggtggctcacacctgtgatcccaacactttgggaggccgaggcaggcggaccaccaggtcaagagatggagaccatcctggccaacatggtgaaactccgtctctactaaaaatacaaaaattagctgagcatggtggtgtgtgcctgtagtcacagctacttgggaggctgaggcaggagaatcgcttgagtccaggaggcagaggttgcagtgagccgagatcgtgccactgccc

SEQ ID NO: 126695 - DNA, 1025 bp, Homo sapiens
tcctgatataccttttctcattaattgtctaattaactagcaaagattcctgcttaagagtgtgtgctctgcaaccgaactgcctagatttgaatcttgtctacaccacttactagctgtttaactgtaggcaaattgccctctgtgtgcctcagtttgcttatgtggaagtcggaaataaagtaagtagttccctcctgtttactggggatatgtttcaagaccccctgggatgcctgaaaccaagtgtagtaccaagccctatgtgaactgtcttttttcctatccatacatgcacctataataaagtttatcaattgagcacagtaagagattaacaaggactaataatgaagtggcacaattaaaaccatactgtagtaaaagttatgtgaatatggtctctcagaatatcttactgtactgtactacggggaactgaaactaagaatagttaaaccactttcctgatctcagtgtgtttatgatttaaaagtgaattaacaaatgtaaagcccttagaacagtgttccgcatttagtaggcactctataaatgttagctacgattactaacttttgatagcatctgatatagagattcttaaactaggaattcatggggctggagccgttagggtggtggttttggacaaagagaggattggcgtcaggctttcaagcttgtccctttacaatccttaaagagttctggatcttttggtgtgttttatttttctgttggttgacattcataaggttaatgagatcaaaatttaaaacttaaaagtattgagattaaagtagatcttaaaaggacttctattgccttttccctttgtgcttttgaatcaacattacaaggttaacccatttataggataatttccaggagagaagcaataaaagctttacttactaggtgttaggttgtagagaattatttataaaaaagatgagcattactaatgttttagtgaacagaggtcagttgaatagatgtttaacctactgtaaatgttaaag

SEQ ID NO: 126696 - DNA, 3334 bp, Homo sapiens
agatgataatgaaggcccttagaacagaaattgattaaaataagtgaggacattagtgaagtggtgatacagtaagaaagcagtaggatcagattgtaggtcttggtggggtcaaaggagttttaggattggggtgccagagacagtgagctggaaagaggtgttatgggaaaatgggatgatcaaaacagagtatggaaggatacagttattggtgatgacaaggtctaaggtatggtcctgggagtaagtggctgaggtgaggttatgttgaaggctgtataaaactttggtttctagtgtgaaaatcttagacttctgaggggatgactgagtcttatttactgttgtaactcaggcactgtgcttgtaacactaacagcaatgtttactatgctgactgacttttttaataaagtatatcatgaaggccatttctcagcaccataaggttgaatgtaatctcagtttcttcatcatggatttgaaatttagtattaaaattaactgttcattattaactcttactgatttttgctttaggactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtggtatgtatgcattatttataatttttttctttcatatatttgtttaaagtactagtaattcaggaaagcaatagctttcagtaaatctctggatggtttttatttttactcagctacctgaattctagtaacaatatagtgtttagtgaagaaaagtttgtctaaaaaaagtattacctgtaaccaagatcatgattttattcatctctgagactttctttcatctagtcagatttatatctgggaagattaatttctttttttttttttttttttgagatggagtttcgctatgtcgctcagactggagtgcagtggcatgatctcggcacactgcaacctccgcctcctgggttcaagtgattctcctacctcagcctcccaggtagctgggattacaggcatgtgccaccactcccagctaattcttttgtatcttcagtagagacagggtttcaccatattggccaggctggtcaaactcccgacctcaagtgatctgcctgcttcagcctctcaaagtgctgggattactggcatgagctgccacacccagccaggaagattaatttctttgaggttaactcattgggatgggaagtaaagttgtgtgactcctctttttttgtggctacaactgttggattggagtagaagagatggtaggagggggtgataagtaaatgggaaaagttacacaagcagttgataatcattctaaataggagaaaagtgaaaagtatttggaagagtaaatctcttagccatgattttatatgttagagatttagccttatttcattgggaataagtcattatataaccacattttgtacattgaagtgtagtcttccttatttctcattgtgtgtagtattaaactttaagtgaaataatggcgtacttcctaaaaatgttaaatatttaaagaaaaagtgagatttttaagtagggcatgaatttttataagtaggtatttgattttcatatttctttttctctttcatagatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaagagtgcactgattgttaatattacaaagaaaccttcatcttaaaggcattgagcagtgcaaaacagaactgattttcaaagcaggaaatagaatcacagttttaatgtttggcaaggaataaaacagacagaaatgctttggagactatggttctatc

SEQ ID NO: 126697 - DNA, 1013 bp, Homo sapiens
gctatttggcccttttcaaaagaagtttgttgattcctggtctatgtccctaaactccttaatttaaaatcagacccaggtaattcttatactcagcattagtggcaaccatgaactaattttgaatctttgaggtatcaacaaaggacttagatttgaagtcctatacttttggcttcagagcctactgagctagaaatattctctgagatttagttagtagaatctgccctggattattggtggcaaatccagagagaaatcatggttttaagctacacctccactataaaagagtaactacaaagtcagttattagtgacttaaagggaaaacagaggtgttttttatgtgtgatactggtcattcatatgtatgagaaaacacatctgctaattatttgtgaagttactttaaagggaaggctatttaaatatgaaggattattaaataacattacaagttttatttacatatttatttttaattttgctgctggatcataagaatggaaatggtaagtaatacaacagtcttttatcattcatatttaattctgtttcttatgtcataggagacacaagaaaactagaggttttcataaaatacttctcggttgttaaaaagataagacgtcaactgttttaatttgcagtgcttatccaacatacttgttaggaatctgtgtcttctgcagacttttcaaatcttatttaaaagggaactggaataatcttatagataattatattttgttaaaattctttataactagaagctatttcttgccattttgtcatcccaacaaatttttttactaaatctatcagtgtgccctttatttctcatattttgtctagtaaacttttaaaaatactacccttcttaaagcagcattccaatctatttttgtaggtggtttttgtctgataaaactataaaactgacctagttgcatcattcagaaacgtaaaaagtaattttccacctcagaatgaccaattagtggtcat

SEQ ID NO: 126698 - DNA, 1050 bp, Homo sapiens
agtcacacatactctgccacacagaatgaaatatgatgtctcaaagtataaaccatttggtataatctctcctacctaattgtttactgcaggaagatagtatctgggtatgaaagtatttaattcagtctatattcaatgtatcataaactaataccaggtataacatatacatttattatgaaaatttcagtttacttaaatataatatttgaattttacttttttccccaaaggaatgtttttaatatatttggggagtattttttgaagtgtcactcattgttttgcttaaatgtttctgtctctgttgggaaagtccaataattcatacatttattttaataggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagtaagtaatcactttattttttaaatacaaaaataatttgtataagctaaatatagattttcttatactggaaataaaaattcttggtgtaagccagttcagcatattttagcctgtgtttgccacgaggttgagctttctcccattaagtttaactcaattttttttagcctatttgcactataaggaaagtttatttcttttttaaatctattttaacttggaaaaaactcagatatgtaataaagcacatcaggttacaaatagcaaaaaaattaagtcgaaattcttttaatttgaagaattacttatcacaacatagtctcataactctttctgcttcttactttttttctttctctaaaggcccactttatacttctacaaaacttattgagtttaattatatcatgggttcacaaactatgtcccagaggtcactgtcttattttttatttttacttctttatttatatatttactttttgagacaa

SEQ ID NO: 126699 - DNA, 1043 bp, Homo sapiens
attcttccatctttaccttcttttttaacataaaacattatttagtacaaataatgaaaaatgatttcatgacacattttccaaggaaagttacttttacatattttgaaatcctgtaaaaactggggatcacctcttaacagttaagaccccaaactatgtgctggacattacctcagactcttcctatctgtaaccagattcttttcatgtatcttttttgtgggggggggggggggggggggggggggggcggatgggaaaaaacaaacccttgacaattactataatgtggattatggcctacaagattcaaggccctggaataatccatgggaagcattatgtcaagtgttccacagtgaatatttgatatcaaatctgcattgaatattatctactaccagttgctgagtgtgtgtgaccttgaacaaaacgaagcccctgacctcttcaagtttctattctagggaaagacagacaaattaagtactgtgtcaagcagtggtaattagaacagagcagaaatagagtagagggaataggtagtgcggggtaggagtgctgttatttgatatagtgtggtgaggggaaggtctctctgagaaggtcatactggaacaggaagctatggaagtgagggagtgaagcatgtattccaggcagaggaaatagccagtgcaaaggtcctgaaggaagagtttatcccgtgtcattaaaggtatcgcatggaaagcagtttgtgtatacagattaggtaaaggaaaaagtagcaacatgaggtcagaaatataagggaagaaaggatcttgcaggcctttatatgaactttggtttttattcatagagagctcaaaagccattggagggttttgagcaaaggataacattttctgccttacatttttaaaagattgtcttggctgttgtgttgataacagactgaagctggggcaagggcagaagcagagagatcatttagaaggctgttagtgcaaaattcaggcaaaaggtgatggtagttcagatcaggaggcagtaca

SEQ ID NO: 126700 - DNA, 1036 bp, Homo sapiens
ttcatgaacattcttatatgtctcttagtacgtgtgagcaagggtttctcttagatctatatactagtaaatcctttgtgacattatgtttattataaatatgttcatctaattggtagcttgttttacattcaacagctgacttgattaagattttttttctgtagttgaatttaacaatcttttatggttcttttttacaaaaaaaaatcttaaattctcccttttcatgtggtcacaggttttcttttatattgtcttcacattttttaaagactttttacttttgtgtgcagctcatctggaccatttactgaacagctcttccttgtattagttatctattgctgtataacaaattacgccgagcttagcagtttaaaacaaaggtctgttgacttttattaagtgagataataaacctcacccattcttctgtgggtcaggaatctgggagcagcttagctatgtggtttgggcatagggtctcccataaggttgcagtcaagctgttggctggggttgctgttatctcaaggcctccagcttattctcatgactgttgacaaacctcagaggatccccttccaagctcagtcatgtggttactggcagtcctcaattccacaccatgtgagtttataaaagttgcctgagtatcctcccaacatggccactggcttcccccggagaatgagaaagttcgagagagtgagaaaggaagacagaagttgcaatctttggccgggcgttgtggttcaagcctgtaatcccagcactttgggaggccaaggcgggtggatcaccggaggtcaggagctcgagactggccttaccaacatggtgaaaccccgtctctaccgaaaatacaaaaattagccgggcatggtggcaggcacctgtaattacccctgctactcaggaggctgaggaaggagaattccttgaatctgggaggtggaggttgcagtgagccaagattgcaccattgcactccagcctgggtgacagagcgagactgtgtctcaaaaaaaaa

SEQ ID NO: 126701 - DNA, 1050 bp, Homo sapiens
aggccagcgcccccaagctgcgcaggagcgggcgtgggcgcccccgggtcagggctcttcgcagtcgcgcgggtccggaagcgcggcgcgggcccaacgagcgcacgcgtacacgcgtgcgcaggggaagaccgagtgccaggggctgaaccgcagggaagggggcgcggcgcacgcagtatggcgcccaacatctacttggttcgccagcggatcagtcgactcggccaggtgcggcctgaggagaagcctcccggtctccgccccggcccgcccctcgcctccccagccgccccactccgtttccgccccagagtctcagccagcagctcaaccgccgccgctccgccccgccccgccccacggccgcccgggcccgcctccgagcccggccagcgcgccagccccgcctgcccttcctcgccaccgggctgctctggtctcgtcggtcccctcctccgccccgtcgtcctgactctctctccctcctttcctcagaggatgtccggcttccagatcaacctcaacccgctcaaggagccactcggcttcatcaaggtcctcgagtgggtgagtgcagcccgcgccggccaggcccgcctgccgctcggcgcggcgccctaggcggggagacggggacctgcgagccgggacgcagccctgccgcgcgggctttgaggccgccgccccgggactgggagtggacggcagggagggcagggaggccgcggcctgggccgcgcggggcggagacgccgcggcgggcgtcgaatcacgagctcctcggccgcctggctcccaggggagccaccctcccacaccggagctcccctctgggtgtccccgtggagtgggagttcaaatttccccttggctccactgcctcccgcagaggaagggaaaacttcctgctgcggtctaaccgaaacccggcggccggcgtcgcgctctgcggagaggctcagcggttacgtccctgccggtgcccactcgaggtctagctccctgggaagccgattttgtcttgtagacgtgatttggcgagcattc

SEQ ID NO: 126702 - DNA, 1064 bp, Homo sapiens
agtgcaatggcgtgatctcagctcactgcaacctctgcacccccgggttcaagcgattctcctgcctcagcctcccgagtagctgggattacaggcacgtaccaccacgtccggctaatttttttgtatctttattagagacggggtttcaccatgttggccaggttggtcttgaactcctgacctcatgatccgccacctcggcctcccaaagtgctgggattacaggcgtgagccaccgcgcccagctcttaatgttatttcaaaatgagatatgccttgacagattagagatatgttcacatgcagctttattaattaaagatctaaaacataccatgacttagtaaaccaatattggcatctcttcttctttttgtttattgaaggccttagaaattggaattggccaggccctttctcaacttccgcgctaaactttctgttgcttctgtctgcctctcctcactttctctcctgcttcttgttcaagcccaccagtggaaggcatggtggttacatttcctcaggaaaccttcagtgctagagtaactccttgaactttaagaaggttccttccttggccctgtggcactcgattttaaagatggagaccaccgagggtgagcagaaccacatctggtcacttatcagaactcattcgcagaatctctcttgagcagaaggaaacagaagtgagccgccactgctcaccttcagtcacagcctagcactgcttctgccagtcagctgagctcaggggcctaccttcctgagaaggaactggccgtgactggcagagccagtgagatctgattgggcaacaagataattgtgatttttttttaaatcctcctcaaacaaaagtgtttaaacaatagcatctcattgaaggcacaactgttcaaaatcagggaagaatgttcagatgactgtatcacattgactacaacactggtcattttctgatttgttcctcaaatctgaggaaagagccagatgctctgggaacaacatgttccaggtctactctaccagggctatttggaaaagaatccctgtaa

SEQ ID NO: 126703 - DNA, 1023 bp, Homo sapiens
attgcctaagtgtccagggtttataatctctacagtactctacagtaatgtcctaggtcttcacatttgttcaacactcactcaccgactcacccagagcaacttccagtcctgcaagctttacctatggtaactgccctatataggtatgtaatttataaatctttaatactgtctgttactttaccttttgtatgtttagatacccaaatacttagcattgtgttatagttgcctacaatattcagtgcagtgacatgctgtacaagtttatagcttaggagcaatgggttatgccatacagcctaggtgtgtagcggtctacaccatctaggtttgtgtaagtgcactctgtgatgttcacacagtgacgaaatcacctaattatgcattttttggaatgtattcctgtcgttaaacgatgcacgatgtatttttctagagttacaattaatataaaaataagctttatagaaatacatataggtgcaataaaactatatatttcaaaaagccaaggaattctctggatgatggtgaccttgtgtgtgtgtgtgggggggggggttgggggggtggcggggtgaggggtgtgggatgtgggcagtgtatggttagatgaagtttatgtcaaggttccagattttgttttggatggtaggtttccaggtacttatatcattaagaataatgaaataagaaactaagcacaaacatgactagaaagcctgggttccctaggaaactgtctaaggctgatgctttatttggaaagtgcaatctcagagcattgatagtaggggaaagtgaggcaaggaggaaggatagggagcaatgccggggtgctttggccttacttcatgaagagctctgctggtgagtcagcaggtgagcctgtccagccgcataggagtcttcaggtgggacaggtctgccttggagcagtccttgggtggaagaagggagaggaaatgagcagattgggtctctaattggaaggtaacttctctggggcactacctc

SEQ ID NO: 126704 - DNA, 3978 bp, Homo sapiens
tgatttaagagtaggaactagtattcccttaaatttaaatttgtgaaagaaaatgctacagctaaagcactgtggtttgaagcaacacaatgacagaaatattagataatgtcatatgcacctcaatcttcagactaggtggaaaattgagattacttctgtggatttttcagagagaaaccagaagcaggtaactccttagtgagacaggagtggctctaccagacccaaagggaatttaatttcttcaatctgtctttgctactcttgtatggatgaagtggattacctttgtcattgacttttggagtataaacagaatctttaacccagtcactgtgtgttagtcaagaatgcaatacttgtttttctttgtttctgttttgggattggcttttggctttttgtgggttttctagacccaaatttagcactagcaaatttcttaaacttccatttgataagtttaatcactgttgagtttgttggccaggaacaaggcagggtttaccaggcttttttgctgcacactcacaatgattacagttctccctaggcacccaggcatcttccttcagcctgaggaaaaaaaagattggtcagctaggtttcttggttttcctttaagaaaactggtttaagaatgtagtattaaggtcattccttttcatagaagttaaatatttctacataccaggcaactcagtgattggccattttagatagtaccttgttccactagcattttttatgcatcaaatcatctcacaatttgaacaccattggcatctctgtatttgactggttggttagtctaattcatcaaaccaggattcaggtattttgcttaataatgtaatataatcatgaaatttccatttatgcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcatacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaattacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctattagtgaagtgttaaatttgtgtgcttcaagtaatgccattttcaggcctacctgttttaagtattcctccagttcaaagaattagaagatgagagaagggcaagtgtcagagttgactccttttctgctttgtgcaactgtatagatgacagtgccttttactaaggaagaacactggagggacatcagatttgaga

SEQ ID NO: 126705 - DNA, 1039 bp, Homo sapiens
ttgtgtgtgtggttttggcgtagttggtatagttgggcttttcttcaacagcatgtacatgctgtgcttactgtcagtttaaaggcagtttgtaatataaagagataccttaagggtcacatgttagaatgctcacagacttcctacaaatggagtattaggtgttcttcagtggcaaaaaggatatccaagatgtcatactttttctttattacaaacgactatccttcaaaacaggctaaagtgttatgtttctgaaagccagatgtggattggttcagttatacctattaagtgcttaaaacttaaatgtaaattatgtatgtgcttttttgtaagggagtgtttagacatttctgatgattagtcttctacttgtctaactttcttaatttggatttcagattaacgtcttcaaggacccagttgctgatcccaacaaaaggtccaaaaagggccgattatctttacataggacgccagcagggaattttgttacactggaggaaggaaaaggagaccttgaggaatatggtcaggtatgtatctatgctgattggtttttttaagcaatagtaggttggctcaccaaattaataagaaaggaggtttttatgttattgtttttgtggaagacaaagtattatattttattataaaatgtccaattgctgacctggcctaccaaaataagatacaaaacaagtgtctacgtcataaacacggggcctgtgtatacatagggagaaatattacgtaagtatagtgattgacagcaagtttgtatacactttatccaaaagcaaactatgttactttaatataaaatgtgaaaacaaggtgacttgatttggattacataataaatggtgaaaccttgatttaaccaagttttctgattcaaatcaaccaaactagaaaaatttacagtacactaaagtagttcatatgatctaatggtctttagcatacaaaagtacatttatatttgtgaactcaagttaaaaaatttttggtttttaagccacttgatcaaaaa

SEQ ID NO: 126706 - DNA, 2956 bp, Homo sapiens
aaaatgtatgtctgtactattattggtatatagtttcaaaaattcacagaagggagccaggtgctctcattgcctaacaaaataatggaaatatgtattcattctaacatcttgacatacagtataaagggcactcagcaagtgctttttagttagactgattttaaatgagtagattcaggaataccagaaaacacacacacacacagataattggttgaaaatacgaggttagaaacttaaccattgaagaggagtaaggctacttaaagcgttaaaaactaattgggtaaggtatggttgacccagctacttcatttgccttacgatgtatattcattaaactaagtcactcaccttctctgtgatgttgatggtttggtatagtaaacatgagatatgattaaaggtgattcagggatagatcaagtgtctgcctaagtaaatctgtgttttcatttttttttctagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcaagaagtacacaggcaccactaataatcagacctgattctggaaaccctcttgacactgtgttaaaggtaaattttcatatgtaactttattattagaatccctctgtaggccagctgcatcaatactacttttcatttatatacacacaatttcagagctgtgtggaccagtcccctttattttagagttgcagcccagagagagtaatagatttgcctgaggtcacacagtaatagcacagaaggataccaagacttatggattgttttactgtcaattagacatttgaatagatattttgttttctgcttacctgcaaaattaattaacagcattgccattttaattaatcctatgatttgggcaccaaacttatttgcagtttgtttctttttcagcataagtcactgctagacctttgaagttgttagcacagaagaaataggaacagggtgatgtggaataaaaataattcaaaaatactcttcaagtggaggttctttagaaatactgttgattcataatgtagcagtgttactttttgttgttaatgttcaaggacttggtttatcttcttcaaaaagtagtaatagcaggcttatttgatgcctactactagaaaaatattttaggtgatttacataagatacgccatttaatctctacaaaaaaaaacagtgataaatattactgtctctgttatagaagaaaaaaacagaggcttaaaaaggttaaagtaacttgctcaaggtcacacaacatgaaagataaggagtcagatatccagtgtaggtcttttggctgcagccttgctacttgaccacaccatttgtcagttaatgagcagatgatacttaccccttaagaaagggaaacagaattaaggaggtcttttcttattctattaaatgataggccaatctgaaagtcttgtcttagcctgcaatatttggttttagcaaacttgataggtttcatgtttttactgttacgtaataaaaaatgtacacagctagttatgagaaactgatttcatcaatggggaattttctctttgttagaatctttaatcagtttatttaggaaaaagaaatgattgttgtgggaagagaatgtatttcttttgtttatatgaccaagctttctgagaaattttaatttggtgtacaaaacttttagtagttagtgaatgagtaagatgatttgtgtattgtgcagtttggctttaagagcaaaggagaacttagagactatgggttctagatgctgtgtctgcctttcacagtttctctgaactttgtgattgaactggattcatattggagttatatatcagacaaaaaccaaagtcattgggcacaagcagaataagtccaaattaaaagtataatcatgagtttgttaaataatgctttatatacttctttaaaatatacttatttaatattaaggatttttttttccttgaatccatataatttgaaaggtctaaggggaaaaacttgttttgagccactttatgatgtgaattcacttcataggaaataacatgcttgtttttaatgtactttaaccctttaaagtacactggaccaaattttagagagcatatacatagtgttataaaatttttaaagtagttaatttttatattctcgattatcaaagcaaaatcatttaactttgaaaagctcttatacttgttttcagctttagttatttgtgttgcatgtgtatttttccatataggttttggagattttaggtaagaagtttcctgttactgagaactcaaagggttacaagttgctgccaccttatcttagagttattcaaggggatggagtagatattaataccttacaagaggtatgtgttttatattaaaagtttcaataaggcatttcttataattaagtttgtttatgtttgataaagaacacaatataaatacaattttaagtctttgtaagtgtttatgttggtataaatctctgtgcattgcttaaagtttagaaataatagtagtttaaaatacagaggtgccagccaagccatacttactcttccagttgtcattggccaccctgaatgatgaatctaaagaagtatcattgtgaaacaaggaaatgtcagtcaagaaatattccttggaatataaaacaaagccttgactctgctggcataggtctgagttttcatagactggagcttcacaaatctgtaaaactcataatattaatgggtgctttttcagaaattatagaatagctgccacctcttctaaattaagcattgactgtcatcagtattagatttagcca

SEQ ID NO: 126707 - DNA, 1137 bp, Homo sapiens
cctgttgaggaaagaaagggtgttcagattctttttacgcttccttgtctgctttcagtaaactatctccagttacccaagaaagaaattacaatctaaactgcagctgctctggtcctagagctaactttattaaaagtaaatcaggttgttttttttttttttttttttttttttttttttttttgagacggagtctcgctctgtcgcccaggctggagtgcagtggcgggatctcggctcactgcaagctccgcctcccaggttcacgccattctcctgcctcagcctcccaagtagctgggactacaggcgcccgccactacgcccggctaattttttgtatttttagtagagacggggtttcaccgttttagtcaggatggtctcgatctcctgacctcgtgatccgcctgcctcggcctcccaaagtgctgggattacaggcgtgagccaccgcgcccggcgtaaatcaggttttttaaatgtttgccaaaccttatcactgacttttataacaaaattatttactataatcattagggaatatttaagttctgctaatacttaaaattgcagagtgctaaaaccagcagtgagtttagaatcaagctaagctttattgttgctactatttgaggcatattagttgactggtgttcatatgcaaggcagtctactgggtgcaacaagggttagaaggatatttttaaaaaactgaccctattctcaggatgaaaataatacactagtaatagtctgctctgttggttaactcctcgtaaggaggtacaattaaaatgctgtagtgttgcaagggaaggagaggaagaatcatattccttcactagcaggatcaagaaagcttttatagaaatatacaaaatcttcacttcttgaaggattggtaaaatttaatagccaacattgggcacttattcattctctgagtaaatatttattgcatgcttatcttgtatcaagcattgtgatgaaagcacaagaatgaaagaggagggagaatgtttagagaataagggctgaaacacagattttgtagggagcgtaggggagactgagaagacaggttcaggttagtaagggcgctcatattttgacactgaatgttaactatgt

SEQ ID NO: 126708 - DNA, 1444 bp, Homo sapiens
tatatctggaatgcacacagcaggcatcctgctgcgcagttctgtgtctagttaatagtatggaagttcaggacatacctccaaaaaaaaaaaaaagctaggattttcctcagaaagaatgcagtattttatgtcttaatatttgtggttaattttgttactacagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagaggtaagtaactgaaaccaacctcatttaatataatgtggattgttggttagagtaccactgtaaacttttggggacgttattgagattgatcttggttctaaaattccaaagattcaaccaacagatacatattcagtacctactactgtgttcagggtacatgggatatgtccttcaacagatgtccctgtcctttatatattagatggatggacagatggatagccagaaacagacataatatatcagatgtgaaataatgccataaagaagctcaaggcagggtaagggaagagagagtgatgaaaagtgggggtgggacactgttaaataggtctctttgaggagataatagttgattttttaaaatatttaggaaaaactgaatctttgtcattaggaactgttatgtctgacaataaatactttcctaagagaaagacaattcttatgggagctatgctatattccttaaatgtggttggctgcatcctggtattattaatgtgggtttctttctgttttggattttggtttatgattgattttccagactgctggcataggagcatctgctcacttggttaacttcaaaggaacagatacagtagcaggacttgctctaattaaaaaatattatggaacgaaagatcctgttccaggctattctgttccagcagcagaacacaggtaaaaaattctgttcattttttaaaactactaattttttcactcttgtatttgtaactcagtgacattttacctaactgcagagccaggtacctacagtacatcttcatgaacttgagcaacacaaattcagtatttatacaaaagtataaacattagtcttagagaggcagagaaattttatccatgctagaagaaacagtttaagagcttttttccaatacttatattgccatagaagttttcttttaaggaattttttttcaattactgtattgtcatatgtaggtagattttattcattaaatttagaagcactcactgtaagtaccagccactttttgccttttccctgtcctcctacatgaccttatctatatttgccctagaaattgtcatctgtactgtaccttcagttgtagatgagaa

SEQ ID NO: 126709 - DNA, 1141 bp, Homo sapiens
ttctcattttctgaaaaagcagggaagaagcaacagtttggttttgatgagtttggaattttctgccacttgtagtgataaatgttcttagcagaagcacgtggcagcattaaacttaaaaattaatatcagtacgtatgttaataattttaactagttttattttagaaggataaggatattctgactagattacagtaacatctacaattgcaatttctatgacagtaaatttagcttctataaaacgtaaagaacctttagtaaaacagcagggaattgagtatcatctgttgaataaataaatttatcattttatcctgccagaagtatgatgggcatcttccaatagaaataaaagctgttcctgagggctttgtcattcccagaggaaatgttctcttcacggtggaaaacacagatccagagtgttactggcttacaaattggattgaggtaaattgtttttttaattcttatttaacattaattgaataaagaccattgaactgagattacagtttagaatttgttactaataaagctatataatctcctataatttacttaacctttccaggcttcaatttcctcatctataaaatgacagactaaataatctttaaggtttcttctagtagaatagaatgttctgagattttgtttaaatcaaattattgagagtgattgtttttaaaacctagttggctttcatctaattcattgccattttaagtgtgtattattttagagcaaacttagaaaaacagcacatttctagtaacttacgacattcgatgaatgataaatgttcaagttagactaaaggaactttattccaacttctagtaactactttcttcatttttctctcatcagtttaggtcttaggatctaccatctgttacttttcagtttctcatctaaataaaacaagatctgctgttcatattgtttaatttctcaggaagggtacattttgggctttgggtttatactgcgagccttttttttgtttttcttgtatgtatacctaagtagtcatatgttttcacatggtcagagttttgataataatactctacctagcttctgaacagtttaataatagatttaatccgtgagaggaaataccctcgaa

SEQ ID NO: 126710 - DNA, 6809 bp, Homo sapiens
caaataacccaaaatccttaagtcatgtttatgagtgagtattgcttcaaagccaaatagcagtgaattatttttgggggcaacagacagatttccagggtttaagaaatcttaaataatactgaaaagaagaatcggttatggtttttgctgtttctagcacattagctttgaagcagcagaaagtcttagccagtgttgggcagagtgtatcctcttctgattgcccttagatattatatagctaacataacttgccctgtgaccttgggtatgttatcccatgtgatcttacatatacagcttattttttaaatgttgacttgtgattttttagcagttaaaaagtataactgaaaaagtaagatagtagtacttgcatttggtcatgtgatcccattgtgggaggaaagatcttcaaatcaaccctaagacatcaaatcagccctatgggacatctagagaagcatctagagaaaactaggctttcttttcccaaaaggattctgttcaactgaaatatatgtgtcatatctcatacttttttaaaaaaactgtcatacttggaacaaggatatttagccttgggaatctaattttttgttacagttggttggccagcactccttaatggaaacagctgtccatcatttgacttagggctagaccgtttttgttctaggcattaaaataataccagttactgttatctagtatgtaataatttttagaagtttatcctttcatgaagtaaattaatcacacaactgaagagttatgttaaaagaactacatttttctgtttgtgcttatgtttgttttttttttgagacggagtgttgctctgttgcccaggctggagtgcagtggcacgatctcagctcacggcaacctccacctcccaggttcaagcgattctcttgcctcagtctcctgagtagctgggactacaggcgcgtgccaccacgcccggctagttttttgtatttttagtagagacggggtttcaccatgttagccaggatggtctccatctcccgacctcgtgatccacccgtcttggcctcccaaagtgctgggattacaggcatgagccaccgtgcccggccagttctttaccacatatgtattgatgttcagatggtgttcttttaacagcaggagggccatgccagtttaggaagcattttcactgggaaggtttgctgggatcttattaggtattttgtttggtttacatctacggaataattttgtatttattgtagaaccattttctttagtaatagaagtcaagtcagtgctaaaaaagttaacatgatttaagagctttctgtgttaactttagaatactatgaaactttttgttagcgttacttaacatttaaaattgagcacttcatttccctaccatttgatagccttccccatctctataaatggcactcttattaatgcagttgctcaaccaaaaatgtgggaggtattaattcttctccctcattatcatcttccacatccaatttatcggcgtagttcccctttacctccaaaaacactgggcaaattctcccatctaacctaatagcccctaactcctgcactctttggtcaccctataatccattcttatccaccactaggctaatccttttaaaaggtgaatcatgtcatattcaccccagcttaaaacataatggcttcccattgcacttggtataaaatccaggctccttggggtagtctgtaagccttacatgatctcatttctgcctacctctgaccttatcgtgttcttactgtccccaccccgcccccatacttttaagtacctaccacattggcctgccttctgttctgtcccttatgccaaagcatttcctgtctccttgtcatttaggtcttgctcacatgtcaccttctcaaagaagtcttcctggccccctctagcccatcattctcttacattttcatagcatctatcttgatctgaaattaatatattttttttcttccttcttcagcccttattagtcctttgaaaatagagaccatgtcattctatttactttctcatcctcagtgtctgaagtaggtacagagtatgtatttgtgaatgaagtatttataaaataacagttgatttgaatttatgctatatcatccaattttctggtgaaggttcaaaatggcctgtttagtagaaagtaaaatgaagaggacagtaagctagcaaaactagaatcattataaatccttttgactacattgttagaaatactttcttaaaaagctctgctttaaaaacattttcccattaaacaacatgtacatatacccctataagtagacctaaacatgctctgtattcttctgtaaacttgttgggtgttagtagatagttaataaatggtgtttcttggctaattacctgcgagtttgcctagataacttagatgcgttagctatattctaaaacgatactcttaaggttctccaaagatttttagagttcatacttcgtttctaattaagcagttcagacatttttgtattttaaatggtatttgttttcagagaaggcattctaagtaaaggtaggtttttaaagtactataattagagaacatagctgaagctttaaaattataaatatttaattattgtccagaactggagctgtatttgtacaaagaacattttcagtatacttttagaccaagatacagagttaaatagcttagagacatttccattttgcttttgactcttcgtcttctcagaaaaagaaaataacttgccttctagtaattttaaatctgataaagaatgcatcattaagtacctgaacagtaagggtcaaactgtggagaaataaaactatgaatcagacttacaaacttgtgctataagatccacaccatttttcaagttttacttcatcgtgtgtgcttttcttctatctcactacttagtcccactaaagaagttggagttatttacattgtaaactggacattttcatttttacatacatcttgggtgtgtttttaggtagaggtgtctttttcttcagtttcataagtagttgaggtagtggtcatatttattactacagactcattcataaatatatttgtttttgcattttagtgaattgacataaatttcattgctgcagattctgtattagctatcttgcttagctacttcttaaattttattaaagtgggatcagtccctggattctaaccttaataagccctgacatatacttctagcttttgatgagtcttccctgtaccttttagtatatcactatctgttgtacttaaggaaaacagctccaagtctcctgcttgacttaaactctcagatcacttgttactataaagatttacctccaaggttgtctgtgtgctgcattaggggctatttttatagagttgcaagtatgctaccattggcaaggaaacagcacattcattcagaatcatcaatggaaatatattcatcttaggattcttgtactaagctatgaagattcttgaggatagagccaagttttactgagattgagactgtgtacccaaagacagcattggctttcctgaacttgagatcaaagctaaacaggaaaaatgatttatgttcacagtgatcactcatgaaaaatggtctgcaaagatttattccgccattgccatgattcaccctgtatcttaaacctcaaggcactgttattcctactcttgaaattgggcagatacacattattcttccactttattttttattggtaaaatgtttgaatttatttccatgttttaaccatattaaaagtataatgaacactcactttttactttttctttcttaaaagcagataaattttttacatggtggctcttacccaagttcatggaaaagaaatttgtgctaaggaagacctcttcgtattttaaactcataaggatttgatgtttaagaatttattttccagttaggtgggtgatttgacaaagggagattacaaaacaggatttttttttactttgctgctttactttgctgccaccgccgttgctgtcatccaggttttcatagtgtcactgtgaaggctaaaagtgatcatcctcagtacctcattgtacaagtaaagtagtcatgttaagtcattgacttttggaacataccacattgagatattagcagtaccaaattctgctgtctttcagttcattcctttctgttgtgtgtgcccattaggcagctgcttctctctctcttcgcctggatgaaggactgttccccaaaaccaaatgaaatacttttccaacctagaggccttgtagtagatttagtgtgcttgtatgtaaaatttaacgctctcctgtggttttaagatactgaactctgaaaatatcttagatacttattttttatttggtatagccaggaaaagaaactggttaatagcaaacaagaaatatagtttctctggttttgaaataacttcaagccttttctgttgtgatttatagtctactcatcggtgttttctaacagaagtgtatttctttacataggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtattacttttcctagtatattttaaacactgcttattactcttaactcctttaggagttcttttagaatttttaacaaatctgttaatttggatgcattaaatcatataatttggtgtgtgtttgatgttctaagtatgagaaaagttttctgaaataaaaggtttttttttttttttggaaaccgagtttcgctcttgttggccaggctggagtgcaatggcatgatctcaactcagcgcaacctccgcctcctggtttcaggcaattctcctgcctctgcctcccgagtagatgggattacaggcatgcaccaccacacccaactaattttgtgtttttagtgaagacgggctttctccatgttggtcaggctggtcttgaactctcgacctcaggtgatccacctgtctcggcccaccaaagtgctgtgattacaggcgtgagccaccactcctggccgaactaaaagttttgaaataagtttagaaaagtcattaatttttggaggctaatcttgtttgttatactttagtcattaattcaaagtaaaggagttgttaatgaactggaaactccttttgaattatggtagcaatcagaatatttttatattagccagttttaccttgaagacctatttttaaaaactacctgtgtctctggacttagttgcaaatgcatattaaaacaaaaatcccccaatttctgtgctttcttatttgaaaggccatttctagggggaaaacagttcccaaacacattatacatgttggaaaagtttatctctaaccttttgaattaaacaatttcagaattgaaaacagtaaggtgaattttaggccaataactcttttctataatcttgactcttttaagattaggcagttcagatagtcttatactactgaaaacctagctagatatcagaagtaattattagtggcaagaataccaaagttaataccaaagtttttttgttttgttttgtttttagacagggtctcactcagtcacccaggctggagtgcagtggtgcaatcttggctcactgcaacctctgcctcccaggctccagagatccttcctgctcagcctctcaagtaactgggaccacaggctcgcaccaccatgcctggctacttttttatagtgacagggtctcaccatgttgaccaggctggtctcaaacttttgagctctcaagcgacccgcccgccttggcctcccaaaatgctgggattacagacatgagccaccacgcctggccccaagatactttaaacgagtttactagttatcttgtattaagttaccagcaactgatagcacactttaatttagtcatacaacttaagaactttgtaaaatattactcatttttaattataactaaaatgtattgattacctattctaggccagcattattgtaagtggttcgtatgtcttaactcattttgtcctcacaaacatcatataagtgggtactcgacttttatcctcatttacggataagaaaagttaattaaaagtgtgttgtttggggggcagacatttagtaattgtggaaattactgacttaccaaccctaaagatgccacattctttacgaacgaagtgagacgtttcatttggatgtaagaagcttttgagtcatctcaaagttgaaaagtaccaaaattaatcgagagaaaaaaattaagttaatatcatttttaaaagctgtgcaagtaataattttttctattacacatctgcttttacaataaataaacatttatactttgagttattaaaagtacaaattccttttctgactctgctgttgactctgggtgagcatttaacctcttagttatatttttaatccatagaatgggtgaaatagccaaagatattaagtctgtgacagttcagcaactcacagaatgcacctttagaaatgtaaacaggacatgtatattcttctaggtaaagtagtaaccaaagagaaaatccaggaagccaaagatgtctacaaagaacatttccaagatgatgtctttaatgaaaagggatgga

SEQ ID NO: 126711 - DNA, 1303 bp, Homo sapiens
tatacataaggaatgtaaaattactttaacatcagttttctggggtgcttttagttagaatagtgaattatcttaaaggtttctaatctagtgagccatacttaattgcactattagaatttgcacctatttaataaattttacttctgtcaactttcaagtcagactggtgtgttttatatcctttataatatgaaacttcagaatattttcatcttagatttttcattttttccccaaaagtcacctctagagggttcaatcaagtcgatatgttttataccagtggcttaccgcagtatgctaaaatagattgtgtattccacagtcacatttaagtcttaggtttcatttcccttatgtttttaggggtccttataacctattttacatttttgtctttttatcttaggaaaaaggacaaaaatgataatcttgaggttagaagtaatgaaacttatttagaaattacacgagaatgttacatatccttatcagtgcttacaaactattggccaaagttgggaactctagtagtttcagatgtgttgatgaagagagcaaaatattgttgatttcttctttctaaaactgaagaaagaataattgattgcctaagcactacgaaagttattttgcaagtagatggtatggtagcaagcacatgacaatgggagttttgttttgtcttgtatcctgtcaagagagtccagaactatttggaccaaaggagcatttgaagtatatacattcacttctgtaaactcatactttattgtatatagtaaggaattaaggacactgacgactgtggttcctctattttcatcgtggttcttgttagaagtaaggacaccgtttaaaccgcattatccattagttatgaaatgtgctgtccggtgtaggttgcttctcaaagggtcatctgtaagctggttatctagaattcagcatatttttaaccattcatttaataaatgttggtgacctattgggtattataaaagaagacaaagataagtagtattttgaaatccaggagggacagaagttgattttatagaagtttcaaagagctgtgaaatttatatatggtgattaggaattcaaggcagctttttttcaaaaaaaaagaaaattttgcttcctctaatggccaagtaacaaatttttgttgcttgtctttcactgcttctgagcggatgcttcggtattgtcacggtggctcctgagtcaacctgagcctcatgagtggggtactgttgcagcttgtaccccagagactgcctatgcattcataaag

SEQ ID NO: 126712 - DNA, 1377 bp, Homo sapiens
gaggaatgaacaagtgtcagtcgagtgtttacagatccggccaggaccccggcccccaatgcactttacgcgcgaagaagttgccggatggttgtccctgtcccgggccgcggcgcggtcgtcttggacgctggggcaggtgtgccctctgctgcctcccgtacccggcctgcggagggaggggacagctggacccgcaggggaggtccctttcttcctgaccaccgattgagacgtctccaggaccttaggggcagatccgttttctcactgttggactctacctcactggtctggaagtcctccgaagacattatttttccaaaggaatttggtttcgtgcttgtgtaataaagccagaatttacttgttctttatctccccctttttctatttcactgtcacccctctttgtggacagaagttcgaacatgtggtgttgcactagtttgtgctcagggtattctgaagcccactcgtttcctaatttttactggattccaaagctttgatcgaggatattttttaagaggttcaagcttgtgactgttagtagtgcaaggatttgtatgggctcagtgattacaaacaaagacatgcaaaatacaactgtttaaacattttcaaggtatttttaaaggttttgtattgaaacaatgtttatatttactgagctcctaaaaatggtagaatacacatgaaaacttttgtttaggaaaagttaacttgttaaattcttttgaattgaataaaaaaatgcattgaaaccatatggtgtgtgattaaaaaaaatgaataaattgtgaagaactggttttggttacaggagtcactggaatccgactggagatgatttggccccctgtcctggtctaacatacaaatctaggaatattatgcgttaaagtattttaaaatacattatccttgtaatgtattttacaaggataatgtattttaaaatgggagttgcataggagagatggatgtgtgtaaacattatcactaaaatgataaacagaatacccattagaattcttagaactattaatgatcaagaggggtggaggcatttcttggtatcaaataactggttaaggttactttgggcgaaatctatttcctttttgtttttgttgttggataacaagaaatgtctagactaatattcatcagttttacaaacataatgaaaattagttgatttttagttgatttttttgtcccaacattttttttaacctttttgccactcattatatgtttgcagttctaggtctttgacagctgaagaccacaggaatcaaacaggcgagacacacagaatactgacccttctttacgcttttatagtgtttataccatatggcccagtgt

SEQ ID NO: 126713 - DNA, 1020 bp, Homo sapiens
tgcggttgtacaaaattagctgcagatcaaggccatagcttgccgacccctggttagaagaaaaaaaaaaaagtcaaaatagtaccattgggggaaaaaacaggagtgatcctaaaaagtatgagcctatcagtttgacatctatgtccagaaatgtgtctcattagaaaagaaccccagatactgggcaattctggcatagtaaagaataaggattggaaaacaagtcttaatttactatgacacagcacaagacctgctgggtcagtaattctgaaattttcatagatatctcaaggaagtttgattcagaaatgaccattaccctgtaccatttttggagagcttttttaaataggttgagatgggacatgatatccttttcttccccctcagtagacatcccacccaggtcattctgatatcaatagttccatgactgtactttggaaaacattaacagatagtgataatactatattcttcttaacatttaaaacataattgccgttagttgacaattgctgtgtgctgtctaaatgctttaatttttttgtctcagctttatgagaacgataaggccatcacttgcccagtgtttcacgtgagctgcaaaatcaagattgggatacaggtggacctggcttcatccctgtgctcttgactgcccgattctatctccagatggggctggggctagcataacctgagtatcccttatatgtcaagctctatttgggacccttaatgtgttttattgttaaagctctgaaaaattaacttgtccaaggtcacacataaaacgagtaagtagggaagcctgatttcttactcttatgtatctaaccttgaagcccaggatgatcagggagttcttaaatggaatttgttctgtgggctgactcacaagtcaggttttcctgtttttttttcttttagtaatgctgatggatttgcattgttggttcatatcctctcttgtgaatgtctttaacgtaagtgatggtatttatgagaggt

SEQ ID NO: 126714 - DNA, 1048 bp, Homo sapiens
ggacaaacgtagggatcaagcatgtgaccttgaccttataatgtggtggtttaatcaaataagccaggcacctgcagttagctggaaaaaatgttgtctggccaggggtcggtgatttttgagggtcaggtggtgtggctgtaggtggcgctagagcaaacagtcagatgggtgaaggtcatcttctttcctacctttccaaaggatcccttcctcttctaatagctttcttttccctctcctattctcttccagtcttataaattctaattgttactttccatttgctatcaattctggtcgaaagagcaagctttagatgttagaatgatagtggcttatggtgaccctttctagggaaactctcaaaggccagaaagaagccataatggaaacctcttggcatctactctgtctccctcttccccgtcctagagaaagcaaatacagtttgacatgtcatgtctgaaagggtagcatccctaggccttgaatttcttagaaggtttacggtaggctatagcattgcatcagtactagtttggagtaaaatctgtggtaattcatgattttatataggcatcatcaagagatcttgtgttgccccataatttcttcagtggaattgctgaaacaaaaaatgaagtaaataccattcagattactctgataaatggacaagtggtcagaaacaaaattaactacacatgggcacatgcagagcagtcaacctgggagaaaaaataactaccgtgatagaaaataaagagctgattttctgagttatagaagaaaaagatctagagttcaaagtagatacacataccaaaaatatagactcataccccataagacaagcatatcaaaagtaataaatagaaatttaccatgtaataactgtggcttaatcctcttaactctgtcccatgtccagtcttgttggaatcttacctaccttttggtttttacagttcaaagggaatttggagaatttacaaaacatccttaaggtcaagcaaaatattgtaaagtttatatcattgatata

SEQ ID NO: 126715 - DNA, 1035 bp, Homo sapiens
gcagagatttgagggaagagaaggatttttataggtgggaatgggtagtggaaggaataaatttccaattcagcaaaccatgtaagttaatatgatgttcagggaatagtgaatagtctaataaggtttggaatatgtgggctttattataggaagaagaggccctaaatataggtttggatcagattgtgggggagggtagccttgaaagccactgtcactgtaagagtttggattttattctgtatgtgatggggaaccattaagttgtgtgtgtgtgtgtgtgtgtgtgcgtgtgtctgtgtgtgtgtgtgtgtcacagaatgaaattagcagatgtatcattaccagaaatggtcaggatagaatcctgaagtttcaaaataggtctttatagtcctacctattcctttcatggtggtcattatccaggaagcagctgaaaggagatgatgtctttcaggggatagcggtgtttaaggattaaacactcttattgaagtgtgtgtggactaagaggaaatgagggacatagactatcagcccattgtgctgctattgcctgtatattatatatgttataaacctactaacaattcagtgttatagttgttgctttatgaaatgtgatgtcttaaggaaattaagagaagagcaaaaatttatgtttactcttttctgtttactcacatacttatttaaaatttaaaaaatttatctatgtatttttattacaattttaaacataacataaaattcacgatttttaccattcttaggtgtatggttctgtggtattaagtacattcacattgctgtgcacccattatcaccatccatccacagaactgtttaatcttcacaaactgaaactccgtacctgttaaatacttaactcctcattcccttctgttcccagccctggcagccaacattctttctgtctctttgaatttcagtactctaggtacctcatagatgaggactcatgcaatatttatcctttggtgactggcttctttcacttcgtgtaat

SEQ ID NO: 126716 - DNA, 1044 bp, Homo sapiens
gttcccttgggtttccgttctttcttaggatggttgccaacccacaatctcattgatcagcagccaatatgggtttgtttggtttttttaattcttaaaaacatcctctagaggaatagaaacaaatttttatgagcataaccctatataaagacaaaatgaatttctgaccttaccatatataccattaggccttgccattgctttaatgtagactcatagttgaaattagtgcagaaagaactcagatgtactagattttcattgttcattgatatgctcagtatgctgccacataagatgaatttaattatattcaaccaaagcaatatactcttacatgatttctaggccccatgacccagtgtctagagacattaattctaaccagttgtttgcttttaaatgagtgatttcattttgggaaacaggtttcaaatgaatatatatacatgggtaaaattactctgtgctagtgtagtcttactagagaatgtttatggtcccacttgtatatgaaaatgtggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaaggctataaatgccacgtacattattttcagtattgttggttatatttaaattttccttacaataaagcacacttttataataaaatacatgaattattgtttttcatacttttttgcttgtttctttaaagttttctgacgtgcataatgcataattcattgaaaagcatgatagcaatgtggcatg

SEQ ID NO: 126717 - DNA, 1111 bp, Homo sapiens
ttaactgcccccaccccaagggcaaccctccgagaagaaggaacgaggacccgagccctccagtctgcccaatcccccgcgctcctgcccctcccttccccacccccacctcttccctaactgaaagacaacaaacctgccgcgaagtgccggcagcccaggcgcgggccgctccggccacgacaacaccaccagcagctctcgtaccccctctccgaccgacgtcggcctcccccgcgcgggttactgctcccgcggcagctcttactcctcaaccgaaactttcctacttaccaaacccgtcgccattaccaagtctttcaagcttcgtcttccccctcccctcaaccccctgggggttgagccccgcccagctctttcgccctcttattggactgcagaactgccattcggttcttcccctttcccattgggtggtaccgtggtccgtctcggggggcgggcatgtattgacttttgtgttgtgtttactggagaagatggcatgtcaatcacaagagtaagtgcttcggattggactattgccgagagtccggggacccaagccaaactttgtccccgaaatggattgtgggttcgtagtctcaagccttggtccttggctgtgggagactgctggccggggaagagctggactacgtatcccagaggcgctcgcacagcgcagtcttgatagtaaacaagagtcatagggacacgtgtatcagctcgtttgttttggtgtctgggacaaaagggagggggcggaggaagggagtgttttaaagcttgggcctcttcttttcctccgggcctctgctaacacttagagcggcccaagcctcttgcagcacccaatccgggccataaacagccagagttgctcgctgctcaagagtttggcaggaggccagggtattgttttagtgcgaggggaaggagatgactgcaccagcggaagtactgcaggctagcgagggacttgatcacccacaaatcacggccccaggcacgaaggggtcgaaagtgatgctgggggctgcactggcagtgggaagaactagaagtcctttctcttgtgccttgcctcaccactcccaggacagcaact

SEQ ID NO: 126718 - DNA, 1048 bp, Homo sapiens
tggctgtttatggcccggattgggtgctgcaagaggcttgggccgctctaagtgttagcagaggcccggaggaaaagaagaggcccaagctttaaaacactcccttcctccgccccctcccttttgtcccagacaccaaaacaaacgagctgatacacgtgtccctatgactcttgtttactatcaagactgcgctgtgcgagcgcctctgggatacgtagtccagctcttccccggccagcagtctcccacagccaaggaccaaggcttgagactacgaacccacaatccatttcggggacaaagtttggcttgggtccccggactctcggcaatagtccaatccgaagcacttactcttgtgattgacatgccatcttctccagtaaacacaacacaaaagtcaatacatgcccgccccccgagacggaccacggtaccacccaatgggaaaggggaagaaccgaatggcagttctgcagtccaataagagggcgaaagagctgggcggggctcaacccccagggggttgaggggagggggaagacgaagcttgaaagacttggtaatggcgacgggtttggtaagtaggaaagtttcggttgaggagtaagagctgccgcgggagcagtaacccgcgcgggggaggccgacgtcggtcggagagggggtacgagagctgctggtggtgttgtcgtggccggagcggcccgcgcctgggctgccggcacttcgcggcaggtttgttgtctttcagttagggaagaggtgggggtggggaagggaggggcaggagcgcgggggattgggcagactggagggctcgggtcctcgttccttcttctcggagggttgcccttggggtgggggcagttaaccgttcgattggtgcccgcggcgagcccaccggagcagcgtctcccgcgagctcacctgggcttcggggcggcggcgctagggggtctcgggcgggggccgggaggaggcagggggagggcgaagttccgggccaggtcgcgcggtgggtggccgggccgggtgtggagat

SEQ ID NO: 126719 - DNA, 1006 bp, Homo sapiens
tatatataaaatatataacatatacatgtatatatataaaatatataacatatacatgtataaatatatatatatatatatatatatatatttttttttttttttgagagggagtctcgctctgtcgccaggctggagtgcaggggtgcgatctcggctcactgcaacctccaccttctgggttcaagcgattctcttgcctcagcctcctgagtagctgggactacaggtgagcgccaccactctcaactaatttttttgtatttttaatagaaacggggtttcaccattttgagcaggatggtctcaatctcctgacctcgtgatctgcccgcctcggcctcccaaagtgctgggattacaggtgtgagccaccgtgcccggcccactatattttaacttctttggattctttcctcactaatcgaagtggccagtgaagaaggcatatggcacgatggcatggacttatgaaactgctctgtgctgagggttcttcagggtgaattgcaagctggtgttttgtatatgtgtttgaaataaaaatactggtactcccctttccaccccacgcatacattatccattagaagttactactgtcccagcacggtgtctcacgcctgtcccagcgctttgagaggctgaggcgggtggatcacctgaggtcaggggttcaagaccagcctcgccaacgtcgtgaaattgtctattaaaaatacaacagttagctgggcatggtggcgcacacctgtagtcccagctgcttgggaggctgaggcaagggaatcgcttgaacccgggaggcagagattgcagtgagacaagatcaggccactgtactccagcctgggcatcagaacgagacttcctctccaaaaaaaaaaaaaaaaaagagtcaatgccaggaattttatgtctgttaagtatgaaagtgagtatttacttagaatggaaaaataaatcacaatgaattaaaaaaaaattaaagctgccagatacctgc

SEQ ID NO: 126720 - DNA, 1018 bp, Homo sapiens
gtgagtctgagattgagtgagtgacctgtccccggttacacagctagtaagagtgaaactgaagtctgttgtcttgaagtgtagcttctcttactgtatggtagctttacagtagcagaacttcagttttctcaggaccaaacttctgatagccttgagcaatgagaggtgtgaacacatagaacttatattcagtaaatatttatttggttcttttggttatttataggtagctctgttttgaaattaaaataatgtctttttccaacttcatttaaggagttttgggatggtggttgataactaagacaaagtgctgaagaaatgatagaagttgcaaagagacgttagtgtactatacttggtgaatgttggaaactgcaggacctgctgtagggaagaaaaaagttctagctggaaagaatgaggaaaccaaagagctctgcagagggagggggaagacaagacagactgcagctgtgcttctgtggaccccaagaacagcactgttcatacacagaggatagctctgaagagagatacctgtgtagtgcagcttctaaatttcataataaaggtaaaaatgggaaatgttttcagttcagataaggttgactgtgcagctcacatctgtatgtgaagcatagtacggatattcataaggatttttagttatcaaaataggttaaattatattctgtatacttaagatgccagaaatacttctatggaaagagttaaaatctcctatctaaactgttaatattaggtgtttaaagaactcacatagtatgactagtttctctcttaagagttaataaataaggaatctgcactgagaaccattgcaaaggaagctggagacgggtggctttcatagagactgggaatgtgagtgctctctttaaaaaaaaaaataccctccttaaaatattataggtgttcctgcatactcatacagtatttcagtatgattttgtccatagactcaaagagactgttttaaagtatagttctg

SEQ ID NO: 126721 - DNA, 1031 bp, Homo sapiens
aagctgtagtgcagtggtgcgatctcggctcactgcaacctctgtctcccgggttcaagcgattctcctgcctcaggttgctgagtaggttggattacaggcgcgtgccaccatacctggctaattcttgtatttttagtagagactgagtttcaccatgttggtcaggctggtctggaactcctgacctcgtgatccgccctcctcggcttcccaaagtgctgggattacaggcgtgaaccactgatctagccccttcttttcttttaacccattcatagccaagtcctgctctgtagaactatggtcatttgcttatatctttccactaaagtcagactcatgatgaattgttcattagtgagatccagcattgcaactaatacaatgccctgtacatagtatttattaaataaatgatttttttaataagtaggaatttagcaaccatttttagcccagtgtatctcagtattctgcacctggaaacaaaaactagtgcacaaagccataccccacaccaaacagatcagatcctctggggatggggcctggacaacatttttttaagcatatgtatgatttcgtgtgccacagagtagagaatcactgatgaaattaaatttgctccatttttttttttttttttttcagggagagagtggaggcttaaaatcgtgatttcatacttgagaaatagatttgtgttacacattttctctagtcgctagttctgtgggggaaattgttatatcctagcatatttgctgtaactatatgctaagactgattgtgatcagtacattgtactaaactggagaagcgttaatttcttccaaatttcatcttttaggggcttgaagtaatggcatgatacatgatttttatggagatgtgctggatgacttgtcataatatctcctagggaggagactgttgaaactgaatagctatctggtttccacctgttaattatgtattttcagtagctgttctatttaggacattacagacccaaagtatgtttaata

SEQ ID NO: 126722 - DNA, 1074 bp, Homo sapiens
tcaccaacaggagtttctgtactgcattaggcatctgatttgtcttcacttcccacaccatgttatggtgctctgacttaaaataaaaacgacattaagaaatgatgtcaagccatgcaatttgggcagtacacaaacctaaaataaatcagagacatgacaatgttgttttgttttttttttgagacatagtcacactctgtcacccagactgcagtgcagtggcgtgatctcggctcactgcaaactccacctcctgggttcaagcgattctcccgcctcagccacctaagtaggggggattacaggcacatgccaccacgccgagctaatttttgtatttttagtagagatggggtttcgtcatgttggccaggctggtcttgaactcctgacctcaagatatccgcccacctgggcctcccagagtgctgggattacaggcgtgagccaccacgcccggccacagtgttagattttaacttaatcatacactgccatttatagctccctcaaatcctttagacccggatgactccttaacatcttggcctacaactgaatactcagcactaaatcacatttcaatcccaaaagattaatatcttgaattataaaaaaaagtcttttctgctgaggaaaaatggcattgtatatacttttatttaacctagtaaccgtcctttcagatgcaaaaactgagactaataggactctttttttcacttgtaccttcaaattcaaaaggaaatttaaaaactttccttaataaaagttaaaaaaaactggaagaatattctattttgtccttttttaaagattctattttaatgtctctatttactgtgttttttattttgtttcttcattctgaaagtgaactacttcagcacacttaaaaaaatacattttcttttttttgagacggagtctcgctctgtcacccaggctggagtgcagtggcacaatctcggctcactgcaacctctgcctcctgggttcaagcgattctcctgcctaaccctccctagtagctgggattacaggcgcgtgccaccacacccagctaatttt

SEQ ID NO: 126723 - DNA, 1053 bp, Homo sapiens
tacttaaaaccaacatgagttgggctatttatggttattgtagacactcatttacagattgttaaattaaactactttactttgtgtgtaaagattggaccccactcgtggcttttcgaaagatgctacttttgaaatatacttgagagagctcagtaaaatatgcttagccactcttcgtggcagatttgctggtatgatgtggaaattacagtggacccttgaaacttgaggatctgacatttatggttgttactattgctaaactactcctggagatatgtgacctttagaaatgtgtaagtttgttgaggtgtgtttttgaattgtattgcttcaaggctggtgttcaggagtatggagctaatgagtcaccttggcttgctgcccagcttttcagcttggctttgcccccatttaatatatgggggtttccttcatgtttataaaaaccctggggagaagatacagctgtcttaattttacaaatgatgaaatggaggagattatgtactatggtaatgtttggaaatttagagatcttaagctcttgggacacataacctgcttgaatgccaaggattttctggaccctagtatttattgagtactggttacttttgagcaaggagtgccattttaatcaggtagttgatcttcctcagtttttggtttaaggaggaactcagaaacttagggccgaggggagtataaataacatgccccttccacctatgacttcgtttaaaaagtaatttcctgaacttcagaaacagaaatgaaccctttgcagtaaataaatgttggtcaaaggcagtgagggaaaggaaatagctatatcagcatgaaaattgtagggtagaattattttaaattagtgtgatgttctagaactccttggctccttcatgactccatgaaagaagtcagtttttacaaatggatatcccgagtcagtgcttctaattaaaacatttcagtttggcttggcatgatggttcacgctagtaatcgcagcactttgggaggacaaggtgggaggagttcaggacc

SEQ ID NO: 126724 - DNA, 1539 bp, Homo sapiens
agaattagataaaggtgataaagagaaccatagagtaaaaaaatttgtaaatgtttaaaataaattagaccatgaaatacttttactatacatttctacatatagaaatgaaaattgtatttctctaaggaagcagagttgtaatcaagattatattttaaattttatcaacctttagttgggttccttttggtctaggtttatttcttccatagtttatgtggccttacattatttgcctgtttgctaattctaaaatttgctaatattaaaatcttaaacttacaaaagtgggttcccattggtaaaaatcactgtttcatatatccagacagagtttaagaaaatgagtggttgtgctatgaaattacggaagcttccagctaatatgcctagggagacctaagtggaaaacacttcattatttatccctgaaaagaaatggataaatatgacagtttataagggagagaaatgcccatatttgcacacctgtgagtggaaaacgatagaccagagttttatactaggtaatgtaggaataactgtaaattttgttagtgctcttgagtgtaatgcattgctaaagaataaacttattaggtatgaaatctcacttttcttgtaacccattaagttgtgctgcttttcttacatttagcaggatattgatcttgactagagcaaattgaatttaattaacttcagtttaattccgtgttcatttccacaggaaagaaaacttcctttcagagttgttatttcctttatagtcctagttttcattgtaatcttaatagtcaaaaagctaaaaattcttttatttatttatttttaaaaaaaaacctgatttaactattggattttttttttctttctctagagatacttttttttcactttttacagcagagtcataggattaataataacagtttatggaaagtgagtaaacccttcagaagaaaatcagtgtaaataaaaacataagacataaggaaaggagtatctccctgaggatgtattattctgtccagcattttgagtaatgctctgttgtctggcctacctcctaacactgtctgctcatgcagcttattgttgagtgttaaactgtgttactgagctttgatatctgaagtctatagttaaggagttgaggacaggtaaaaatttatattacccctgaatagagagagagatgaagaaatcaatgctgttagtgtttggacgtgtttagcatgttaattttcacagagtatttaggccatatacattttagaatatcacattgttcccttcatttttatttatttttactttttgttacttctgttttaaatggttaaacagaagaactgataaaactcactttttaaaattagggagtcaggaatgaacaaaaggaatatttagcagtttggccattctctgatacttcatatatatctaaatgtgtaataacaggatgggcagtttttgggcaaaagatgaaacattcagcatataatttgaaatcaaaaattggagagtatgcta

SEQ ID NO: 126725 - DNA, 1734 bp, Homo sapiens
tgagacttactgagtacatcaaagtagaagaaagaaatggataggacgccctgcattagagggggtattatcattcacaaacgaaatatacacatgtatatgtattgatagaaaaatgaatgggataaataaatgaaaccatagtcgtagtttaaaatatattgtcaaatctgaaaaaaacgatgtctaaaatgtgtgaggagggtttggataaggagttaaggaatataattataaaatgaaatcttgctgtctttactagtgtttaccataaatgtgttcaatgtaataacattggcgttttaaatatgaagttctttcattaataggaaagatctactttaaggacctatgcttatggttgaaactgttgctttattttagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggtaagtttatttatgaggttaaacttttacaaagtttgtacaacagttgaagtacattaacattcctcataggaagtagtctcactgttctgttagtgatctggatttgattttatatacagctctgctatgtgttaggaaagcttattattaatgggaatgtgcgtataactaaagcttccaaaaactttgttttgtgtgtgtcttttttttctttttttttcttttttttttttttttagcaaattctcccacagcctgacaaccctcagtttttgaaggcattatattttccctaaggttagaattactaagttatccacctataagcatgggcctaaagacgtgggatgaaaacagatattaaaaggtatattttaaaaacaaataaaaaagttgataatatttttctccataggcaaatagtgagtcagaatctggcattttctgcatgtcctccctgtcagatgatgatgatttgggatggtgcaattcctggccttcaactgtctggcactgttttttgaaaggtaaaacaaacaaacaaacaaaaaccttgaattttccacagcttacttgtctagtacagtcacgtgtctaatacgtgttttctacctaaaccttaggcacacgactgtgctttcataagggaagcaataaggaatggcaagatgttgaagattttgctagagctgaaggctgtgataatgaggaagatcttcaaatgggcattcacaaggttgatttaaaattcttaaaaaatttttcaaaatctttccaaatgaaacaagatttattgttaatctacagaaatatcctccattcactttgatatttaaatgacatcgtacattttaggtagagcatttttatgaccactcattgcttagtctgatggggaggagcaatgattttaggtttgcctttctaacatgctttcttggatgggaaatagtatatttcttggtgcttcttcgtgttttatacactttacaatggggaaaactggtattaaaaatatgtaatgaggtcgggcgcagtggctcatgcctgtaatcccagcactttgggaggctgaggcgggtggatcacgaggtcaggagatcgcgaccatcctggctaacgcggtgaaaccccacctctactaaaaatacaaaaaaattagctgggcgtggtggtgggcgcctgtagtcccaactacttgggag

SEQ ID NO: 126726 - DNA, 1305 bp, Homo sapiens
aggataaagttgacacctttcactttgaaatttttaatttctccatctctcctgtaggcaagaaaatgggcatgtgaagtgtgcttgtacaaattcttgttttgatcctgctatgtctcactattaagtctcttgagaaaaattgtcctgtcttggctgccttcagtttcgtccccttgctttactcttcactttagtgaagttcacaatagtctaactttggcctctactactctacaaaaattgtctcaaaggttactagctttattctgatttctaggaagagagacgtcgtttgttctgtttgacatctgtacaacatttgacacattgggttagttcctgacattgtcttcccttgatttgtgtagcatggcagcatcctgattctcagtcttttaggcctggtacttgactgcccgcagtgctgaatattagacaagattttgcccccttcactttcttcaccagttcctctctcctgataatgtcagcagcacctccatcatgtcctgtggaatgcactctggacttggagtcaggaaacctgggctctctttatagcttctccagcaattatctgtgttactgatcttaggcagattgttaacccctctgagtattggcttcctgatctgaaaaatgggattggattagttttaaggtctcctgcagccctgagaatgggaagattttgtaatttcgttatttgccaatctatgtctatagccttcacctgcacatttccagctgcatgttagacatctctgcatgaatatcagtcagttctttgaactaagcttagtgtgaccaaaactgcccttacctttttcttcctcttcttggcttactttcctcctattctttcaaagttgttattatcatccttcttgattaccagattcaaaaccatgaagttgtcttttactattctatttcttccctttatttatattcatttgattctaattctgtaaagatttttaagtcatcctctcttattcatgaccttgttcatgcgttagcgtaattatgattggatactatagcaagcttttggcgtgtttgtctcctttgtttttctgtgaatgtaagggtaaggatcatgtttgttagtgtttgtattttcagatcctaccatgtggcatgtgttaaatgctcaatattcattgaatttaaatttttctggttctattactattgcacttgtcaattcaggtctataataggtgtctctcattatatcctcaggtaattgaatatgagatcttttcttctgtagagtcttttcttatttaccatcat

SEQ ID NO: 126727 - DNA, 1035 bp, Homo sapiens
cacttacactcaagtataaataatggtgatgcagtttaataaagagttattaataccaaaagagagattaaggaggattttcaattccaactggaactgagatttaaaagaagaatgcaatttagaaagatgccttgcaccaagaaatttgtaattaacaataactttggggagtgctgagtatttgctaaaaatacaaggtgagttcagatttggggcaaataaagctaataaggagaggccagttagtaaaggcctcttaaagacaggcaaagtactgacaatttttgcttagaaggtattgggaaatcaatcaaagtgtttttatcagcatgactgtcaatttttaagatgatggtaaataagaaaagactctacagaagaaaagatctcatattcaattacctgaggatataatgagagacacctattatagacctgaattgacaagtgcaatagtaatagaaccagaaaaatttaaattcaatgaatattgagcatttaacacatgccacatggtaggatctgaaaatacaaacactaacaaacatgatccttacccttacattcacagaaaaacaaaggagacaaacacgccaaaagcttgctatagtatccaatcataattacgctaacgcatgaacaaggtcatgaataagagaggatgacttaaaaatctttacagaattagaatcaaatgaatataaataaagggaagaaatagaatagtaaaagacaacttcatggttttgaatctggtaatcaagaaggatgataataacaactttgaaagaataggaggaaagtaagccaagaagaggaagaaaaaggtaagggcagttttggtcacactaagcttagttcaaagaactgactgatattcatgcagagatgtctaacatgcagctggaaatgtgcaggtgaaggctatagacatagattggcaaataacgaaattacaaaatcttcccattctcagggctgcaggagaccttaaaactaatccaatcccatttttcagatcaggaagccaat

SEQ ID NO: 126728 - DNA, 1007 bp, Homo sapiens
taactggcctctccttattagctttatttgccccaaatctgaactcaccttgtatttttagcaaatactcagcactccccaaagttattgttaattacaaatttcttggtgcaaggcatctttctaaattgcattcttcttttaaatctcagttccagttggaattgaaaatcctccttaatctctcttttggtattaataactctttattaaactgcatcaccattatttatacttgagtgtaagtgcttattccagtctagttatttatatatgtgtctttcttcactaccgggtttgaaagctctttaatggcagggatcctgtcttggttatttttaccttttccacaaagtcttacatgtaatgggaacttcacagtgttttgaattgaacatttccaattcattcacgctatgcatatattttcagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggtagggcttgaattgcatttgtagtaactttttttaaacaaagcttcttaaatctgtaattatgtctgtagctttgatgattaagaaaaaatttgaggggaaaacgtctttcaaactaaataaaaaactaccatagggaatgcttataataatacctaatggtgcgtaagtatcttagcagtcaggtggaactttatttcctgtatgagaaatttttagattcatgtagcatagtataataagctttctattatcttggtatagtttgggtaatgtagtgatctagtaatcacattttcattaagagttaccaaatatgatataaacctgagtcactcttcagagccttattacagtaacaccatgttaaagatgattttataattcagagactatttcatggtctcagtcatttatc

SEQ ID NO: 126729 - DNA, 1317 bp, Homo sapiens
gccacatttaacagcttttcactgcctttcccaaccatttgttttctatagtagtccttaggcctggtatgttgcctgccactccattttaattttctaggtctgggtgcctataggccaagaaaccatattgtcacatttgtccagaaatgaatttaaagtaagaataagtgggttgtgtaggatttggaggagttacttgctatgaataaagtatgctgattataacattcctttggggggttcaaagtcttttttaagcttttgtattatctgcagaggttttttaaaaaaattaatttcagttagcacatatacagatttcattttataagcaactatcagtggcaaaagttgttagtgttggtaacatgatatagggggaaatgcactgaaatttccaatcagatgttttcttttttttttttttaacctgctttttagaaatcagagaattcaaaattgaattaaaatattattattttttttaattttatagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacaggtaaaaatagtgataattctgattacaataaatgagtaacacttcaatacggttcatggtaactggaatagttaagtaaacttattctttaatagcttttattcaactcttaggttgacttttttgtttgtttttgagacggagtctcgctgtgtcacccaagctggagtccagtggtacgatctcagctcactgcaacctccgccttccaggttcaagtgattatcctgcctcagcctctcaagtagctgagactacaggcgcccaccaccatacctggctaattttttgtatttttagtagagacagggtttcaccatgttggccaggctgatctcgaactcctgacctcgtgatccacccaccttggcctcctaaagtgccgtgattacaggcgtgagccactgtgcccggccaggttgactttaaagtaaaaagtttaagtggaatttttagggttatatgtaattattttataatacatagacaattaggttatc

SEQ ID NO: 126730 - DNA, 1087 bp, Homo sapiens
tctgagcagcttgaactataggcatgcaccaccacacctggctaattttttgtagttttagtagagatggggtttcaccttgttggctaggctggtctcgaactcctgatctcaggtgatctgcccacctctgcctcccaaagtgctgggattacatatgtgagccaccgtgcccagccaaatctggtattttctttgcattttagcattgctcccatgtgatatactggtaatcaatcatctaacattgagggccatcagatatcacctatctctaaactgaatgggataaatcataattttgaaattggattcttcactgtctctaataaagctgccttaattcaatgaataaattctcatttggaggcaaattctgagggaatggagactagaacaggtcagagacatgtagctcattttaagttgctataaatgtccatctggatgtaacattcactgcagaaataatctttagatgtgtatattttacatttgttagggaacacagagtatagtctacagcattgtgtacatttcattacctgtcatcttttagcttaaaataataaatgtttcgcaagtgccacccccttcaaaaacatctcatgttctttcctactgtggatgactgagatggtgtgaatatttattgatttgtttaaatgtgtcaaccattatatggtacctgtaacccaagactaaaagttttttttttaatgggttctgcaaatggaatataaaaattggttatcattttattatttatttttgagacagagtctcattctgttccccaggctggagtgcagtggcgggatatcggctcactgcaacctctgcctcccgggttcaggcgattctagtgcctcagcctccccagtagctgtgattacaggcgtgtgccatcacacctggcaaatagtagagatggggtgacggggtttcaccatgtcggccaggctggtcttgaactcgtggcctcaagtgatctgcccgccttggcctccaaaagtgctgggattacaggcatgagtcacaacgtccagcccaaaaattggtttataattaaggaaaatgcagcaca

SEQ ID NO: 126731 - DNA, 1271 bp, Homo sapiens
cctatttcttctcctccttgaaatttttcaatctagaaattctgtgccaatggcacaagtccccatgaatgacagctaacataccccaacacctccagccttattggtccctcaccaattaaggaaaaaaagctgttgagacaatcccaaaattattagagaaattttctactgtgatattaatggattaataatgcttatctttcaacccaactagaaacactgcattccaaaattatttttccaactcaatgtttagaacaaacattcttttgaagtttgcctgagatttcgacttgccatgctatgagagtaaatgacccttgaggaaaggcagtctttatatgatgatgtgataacattattaggttttgaagtataaaaatgctagagacagcatcaacacaacctcttaaaggttgtaacaactgctccaacatgccagtacacctgcacggataaggcaagataattttaaacactatttattgaaacatactgaattggttcttttcctcttccaacagtcaggatttaaacgtttctgttcttcagccaaagcctttgcttctaatgtgtacattcttctctcttcattcttcattttcttccacctgtcaccaaggatcacacttatggctctgtaaaataaatatttacacaatgctgaaagcacacatttttcataaatctcatgtcaagtgctgctacttcaggagaaaaatgtgaagttaaaaaagatgaaaatcttgtctatcacagagatgggaaaaggtcaaggccataatgctcatttccagtaaaatcccgaatcaaataatccattgttccgtatcagcagcatgaagtattcaacttgtactaaaagctaatctatttgtgcccgtaacctatcaaatagttttgataaaggtcttttctcattcaatcatagtggaagtgtagaattaactatgcatatcttactatttctctctcaagagaaaaccaaataaacctttagacagtattttttattacttgagaaaactggataaactcaaaatgctaagaagttaaactgataagactacatcatgacaaatattagaagctgttttctcctgtttgttactctgctatgaaacctactaaaacagtctcacctaggcacacagatgtaaaccaccttccttctatgaagagctttcagccattcacttcatgacacccatataaaacataaggtcctggaaattttgcacaaagcacatcaagtgatttttatactg

SEQ ID NO: 126732 - DNA, 1084 bp, Homo sapiens
gagactgttttagtaggtttcatagcagagtaacaaacaggagaaaacagcttctaatatttgtcatgatgtagtcttatcagtttaacttcttagcattttgagtttatccagttttctcaagtaataaaaaatactgtctaaaggtttatttggttttctcttgagagagaaatagtaagatatgcatagttaattctacacttccactatgattgaatgagaaaagacctttatcaaaactatttgataggttacgggcacaaatagattagcttttagtacaagttgaatacttcatgctgctgatacggaacaatggattatttgattcgggattttactggaaatgagcattatggccttgaccttttcccatctctgtgatagacaagattttcatcttttttaacttcacatttttctcctgaagtagcagcacttgacatgagatttatgaaaaatgtgtgctttcagcattgtgtaaatatttattttacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcagtatgtttcaataaatagtgtttaaaattatcttgccttatccgtgcaggtgtactggcatgttggagcagttgttacaacctttaagaggttgtgttgatgctgtctctagcatttttatacttcaaaacctaataatgttatcacatcatcatataaagactgcctttcctcaagggtcatttactctcatagcatggcaagtcgaaatctcaggcaaacttcaaaagaatgtttgttctaaacattgagttggaaaaataattttggaatgcagtgtttctagttgggttgaaagataagcattattaatccattaatatcacagtagaaaatttctctaataattttgggattgtctcaacagctttttttccttaattggtgagggaccaataaggctggaggtgttggggtatgttagctgtcattcatgggga

SEQ ID NO: 126733 - DNA, 2041 bp, Homo sapiens
tgaaagatgaagggaagatatcaatatttttatagtaggagggctggccaaagatgttttaaattcattgtgtacatgtgcctgtttcttagtaaaatgcaggtcatatctgtttaaatttttcacaatttctttaaaaatagtggtcagtcagtagtcagatgagagggtggctgaactgaattttggcagttcttggttaatttagaatttcatgtgttcggacttttcctgtatcccttttctgttcatcctagtcaatgtcttatcattgcatacattttctggatgcttgagccatcagatatcagctagctttttaaaatcacctttaagaaagcagtattttctaatagtaaatttataaacatcttatacatcttagctttcatatataggattactatgtattgatttgtaaacattcactgagtttaattttatttccacagggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgtctattggaatcattttggggattttttttttttttaatagtggtgtctgtca

SEQ ID NO: 126734 - DNA, 1254 bp, Homo sapiens
tgctccaatctcaaactgaaattttgaagaaaatatgacaaaaatgtatttgtgtacctggtacttaaatagaccaataattaaaaattaatctcgtagccattctttttagctccacttaaacagacgatctggttcagggactgacgaactttttctgtaaaagaagggccagatatatttcagactttgcaggccacatggtctctgcctcaactattcaactctgccattgtgtgaaagcagccacagacaatatataaatgaacaagcatcaggctagattcagcctgcaggcagtttgctaacccccaacctaatccatgagatcataatcataaacaatggaatggtacatccccttgattaaattcagactgcttcccgatcatgtattttgccattacagcccaagagcacttattctagttgttggttgttcatagttcatcaaataacaggaatataatgcatctactggtgttaccgaatgtgccaaagggccccatccccttgtactcttgagcgtgcctttcagaggcgcaggatgcccctcgtgagctctgggagtaggcacaaatgcccattccgttgccggtgtcttcagtagggaagcagggaaaagggaaattgagaacatatttacacagccagaggactccgagtatatgactagaccactaagaacaatgcagactgaaaacatggttatagtttttcacactaaacgtagtaaccgtagtaaccatagtaacactaccagtaactgagtgaaggctgttggtcacttggcttgtgaaaccgagcattaacagttccagaaatgagcttactaataatttttatatattggtatccccttaactgttttatgtgatttatctaatattttgacattgttttcattttggttttcaggggagccctggaagcttatgttcaatcagtgagaagtagagaaggcaaagaatttgcaccagtttatcccataatggttcagctgcttcaaaaggctatgtctgctcttcagtaatgacatgaaatctttgttcatctccactttgtgctaacccattcatagttggcagttaaacacatactccaaaagactgctactatctactattttaagaatgtaattgattgttcggtatttcctatcgacgtttatttacctctttagcacttatactttagcataaaaaatgttgagttatcaccacctttcaattccatggacctgatttttccaga

SEQ ID NO: 126735 - DNA, 1070 bp, Homo sapiens
aatgactgaaatgcttccccagtagctagggaaaataaattacaacataatgttatttgataaagatagatttttacttgtagaatagttaatataaagccatctttactaataataattctgtatctaatgagaaccagctatctattgagaacattcttgactcttgaccttatcattagtatagggaagaagttcgcttctctattttgtacaggccttcattcataattagagtaattaagttggggtaaagaaagaccccaggatacagtgccgttttacatggttcagaatcattatctcatctgtcaagagatgttgctgccatcttactacttgggattcaatgtccacagctccgcttctaatcagctctcatccataagagctcaaagccaataacagttcaaataattcttgccagccttttgcaccaggtggtatataatttgtagtggaatggatttgcctgcttgctccttctgtaaaatgtggacaatgaaacccatacatgtaatatagtataagggagctagcataaatttttgatggagtgttcagcaaagtaataactttgtatatacaaagacatatttgcctttttgaaaagttgtgtagaaaatgtttgcatataccacatttgattatggtccaaagaaggattctattttaaataaaagctgaaaggattgatgaagataagaatctgttaataacaactacttgaaggctttactcttgttctttatctgcttttagccttgtaattagatgaactttataaggagcttttgctgagtccggtggatgtcagactcatagaccaatgaaccgggggtcaaatgggagctgaagggtagatcagcctgtgagcacgtgggcatgtgggggtagaggcttgtgggcgtctcaaggctgaatagagtggttaagcagtggagggctccttcagtagccaatctaggaaaaatgctattctacaaggagaatgattctcccaccaaatcacctatttcagtattgaacagtgtgaaataacttctgtttttcccgtctagacctctgct

SEQ ID NO: 126736 - DNA, 1143 bp, Homo sapiens
gcactttggaaggccgaggtgggcggatcacgaggttaggagtttgagaccagcctggccagcatagtgaaatcctgtctctactaaaaatacaaaaattagctgggcatagtgccatgcgcccctgtaatcctgtaagccacctcagaaggctgaggcaggagaatcacttgagcccaggaggcagaggttgcagtgagccgagataatgccattgcactccagcctgggcgacagagcgagactccatctcaaaaaaaaaaaagggggggacaggtgattacccagaagattccattttaaaatgagctggttcttaccaggcctggcttagacaggcatctcagccagaaacctctgtgtgggctgggctgctagacatgctgttatgcgcatgtactgttcaggttgtttccctctcctcgtctgtctccgtccttgtccttccccttctgcccttctttccttccttgtatcatttacagtttgcgtcaagaatatattggaagaaaaaaagaaaaatgtaaatattcgaaccataaaactaacttaaattgctatagataagtttcaaacttggctttaaacttcatgaagccaaagataagagagaaacagaatcagctatctgattctcattatcagaaggaagaaaatgtatcaattcctaagagaaagttaagcatctctttttttttttttttttgagacggagtctcactctgtcacccaggctggagtgcagtggcatgatcccggctcactgcaagctctgcctcccaggttcacgccattctcctgcctcagcctcccgagtggctgggactacaggcacacgctaccatgcccggctaatttttttgtatttttagtaaagatgggatttcaccatgttagccaggatggtctcaatctcctgacctcatgatctgcctgcctcggcctcccaaagtgctgggattacaggtgtgagccaccacacctggccaagaaagttaagcatttcttggcacttaattctaaagtacttataaggacttttatacagagagcttcatacgggaagtactaagagatgggaggaccaaaattcttgatcaccttcctgttgtagaggtagtataggattccatatggctgctg

SEQ ID NO: 126737 - DNA, 1042 bp, Homo sapiens
gccttggtgacagactgagaccctttaccgcccaccacccacaccccccgccccaaaaaaaaatagtgctaagtttcctgtttgctgaggcaggatgaccttcatgtaagcactcttaaagttgtgtcatagtatggagatacaaggtctgaggataagtttcacttaagacatctattttaagccatttaagatggaaattttctgccaaccctttccaattctcacatgagagaaagaatctctaaaggaacatttaaagtttgggtgacaccttctaatacctatttatagaatcaagaatcgcttgatcaatgtataattttaatagttctacttttttttttatatctagcttcttatggcgtaacagttttcaaacttttgaccatgacccacagtaaaagatactttctattgatatttggcatatacttgtatgcaaacacatgaacacactcaaatctatatacatatacatggacacccatatgtatggttcatgaaatagtaagtacccttacttcatgtgataacctctaacatttctatttcatttgattattttaacccactaaattagtttaatgacccactcatggcctgcatccagccatttctcagatttctcacgaggcccttaactcttgaactttagttgctctagtgacagggagccaagttttttcctttccacaaactgtgaagatttatacccttttctcttgggattctggtatctctgaggttcctcctgcagatgacgtcttagctcccaaggcctcaggcacataagaataattgtttcttgcctatggagtatccttcatagcttgagttaattgaaaaattccaacagaggtatttttctatataccattatatttctatatttatattgaatctacagaaatctactgaattaatcctagtgctttctcagttgtttgatgggactgatacaactattttataaaaagcgtaggattaggattaactggatcaagaaataaaacagaagtataatatattaaggggttca

SEQ ID NO: 126738 - DNA, 1081 bp, Homo sapiens
ctatagtgtacccatggcaaggagattttaagcaattttttgtaagggtggccagcaggacagaagccttaaatcatatgtgcttcttgaagaaaggtgctgtactatcagggagcagcctattctcaaccattttctaaaccattctttaccagggcgctatttatagcaagagtggagaagcagtctatcacctgagtagcacatatgcaaaaagttcgcatatgcacttggtagaaaagaacaggtaacctaattaatgacaagtagaatttccagtcaaaggaggaaaataaagagaagtgaaaccaagatttgctaaattcttgagttaggtagcatattaatttattaataattgaaaagagaaaaatttttaaacactgataataattgctgacaattaacagcacttatatgctatgcacataaagctttgtgggattatcttttaatttgcattattctattaagtaggtattattatctccattttacagatgagagacctgagacttaaagaggtgaagtaacttatccagggtcacaaactagtaactagtatcagcatttggaatgctgatatagatgtgctactaaaagctccagagttagtccttttaattacttgagccacactgactgataaaaattgtcatcatttatattgaatgtaaaaagacttgtaatgcctaaagtataggcatgcagtcttgaaaattttccttttccttatttttcaatggataaatgatataaactttttccttttatataacaaaaaatgttttttttttattttcatgaaggaattgtctcatcttgggccctcttagtaaataaatgcaaaaattatgtaagtgcttaccttttaataaatttagttggccatcacaacttgccttacagtccagataaaattaagtttactgcaagctacaactttctgtgatccgggtctttcccaaattcccctaatgattctgacattacaacaatggagtatattttaatatttcagatggagttggctgtgggtccattctgtagacgagtatctgatttaggaaagtcctatcgg

SEQ ID NO: 126739 - DNA, 1042 bp, Homo sapiens
tgacgtattttcaggatttctttaagaatcctaacttctcctcactggcaccagtgcaggaaagagaaagtagttgcagggtgccatctggagggatcatggtgagggaagtacctgacatccagcccccttaggaatccaggtcatgggcacgaggtggtttcctacaggtaattaattccccactgtgaccacatggtctcagtgcctacactgatcacacagcagttctgaaatcactaagcctgtccacgacactggggttctgctgattctgaatctcactgggatcttgcccacagtgtcctctgaagcacatactccccctccacccctcagtttattttcttagctgaaggaaagagtggctattgaagttggtattaaattatttagtggtacttctagcaatttctatttataggtcttctggtgccctttaagcatacatttatatctatttcactttgtgcctaaaaatattaatttagaaaagaaaacaagacaatcaaaattctaatttttgttctaattcctattgccttttcttctcctgaacaatgtcagggcaggagtaccctaggagtatccaaagaagtcctgtggttaaccaaatgtctgtggtagggaaggaacagctatgtaattagttcaccgtgcctgcagctgaccgctcattctctccaaacgggggctggagagaagcagttgcacatgccacttttgtatccgctgctaatggcagagtcacctcctcttaccacaacactcttgccctttaaaacatggcctttattgtttaatggaattctggaagaagaaaatgatttacaatatcctagaggtcctttatggataaaaaaattttattttaaacattaaacattttgaaattgtcctgcggcatagaaatcttttgcataatcatacattttccagccattcgaggtcatattttctcatatcgtaactttttcctagccatttatttgttttaacatttggtcctgctcaagtgctaaggcaaaggttgtctttgaag

SEQ ID NO: 126740 - DNA, 1822 bp, Homo sapiens
gattgataaatggataaagaaaatgtggtatacatacacaatggaataccatccagccttcagaaagacaggaattctgttaattgcaacaaatagatgaacctacagaacattatgctaagtgaagtaagccagacaccaaaagacaaataccacatgacctcacatatctgttgtctaaaacaaccgaatacatagaaacagagagtagaatggcagttagcagctatggggtggagggaatagagagatgttggtcaaagggtacaaagttgcagttaggaggaataaatgataagtatttaaggtgatgagtatgattaccttgattcagtcattccacactgtatacatataacattactgtgtatccccttattatatattattataattcatcaaaaataaacattaaaaaaatgaaatagattggcaccattttcggatagggaggcttcttttatttgtttgtttttgcagcctggccttgtggagtgacaaacctagagtaaagctaggctatgcagttgtctgaatctgggaaaaccaaaccccacatgaagatggccgtcatttactaaggctcccctgtacccaagcgccactccatcatgtgatgatactgcaaacaaaaatgttgcaccatacacccttcagcagccttgctgttgttggcacagtcttatacctgtatgaaatcccttcctgctggaacataggcctacttcttctatctctatctgcttctgaaagtgacggacctctggttagcatcctatttatagtaaccactgctgtatttgaagataattaagttcaactcattctcttgctctaagcattttagtcatatctgttgttcttctatagaccatcaccaatttctctacgtcattctcagaatatggaaacacttaacttgctttttgaaaaagattcagcatgatgtagccagtgatctcatttattagaaaatatcaggtgttagctagttttggtatatctctttcctataaatatttcacattcttttaatatattctttaaagagcaattataaacatttataaattataaatagtatttcatggagcatcagctggtatcatttgttgatccaaattaaagcctttccaaacctcatcatctagaggaaaaaactgcatgccatgtgtactgttacataaccatttccacagtcagaattctgttggactgatctgattaaatagcacaagagcagagagatctttgccaagaatttgtatagggaaagcagcattttctgtcattgcaaagcataaaatgctatttcaggatccattattgatgcattcagttagcaggcaaaacatgtgagtggatggagaattgagaggctgggagggaccttgagaggccagagagtagcacttgtatgattcatccaagacagatggttgtctatttcattcttaataatctttaggtaaatggattctaaaattccttcagtaatcctcctggcatctaaaccactttttgaaatgtaatttttaaacattgttttctgctaacgcttatcaaaaagtaattaatgtcttttataccattaagggaaaacattacaaaggattgaaatagcagcattggtggggagaggggtacaaaatcaaagagtgtgatttagtgcagcggtgctgaaaagggctgctttttcttttacaggtcattatccagctcaggaaaacctgatgttccttgttctctgtacatgaaggagctacaaggtttcattgccagagttatgagtgactattttaaacactttgaatgcttggat

SEQ ID NO: 126741 - DNA, 1016 bp, Homo sapiens
tatactttgaaacccccaaaatatgatcagtcctcaataataaaggatctccacccttttctagcagcaagcatatctactcattaaatactgaacacacaaaacaaattgaaataaaataacataaaaattcttcccctttcccatttctttgttcttcaaaattgattgaagagaatctcaagagaagtaagagaggttggattttttaaattgtacagctagagcttgtaacttttaaatgcccattatagtcagatgtatgtttagcatttgaccccccctgccccgagtctgccatacccaccgatgccactcaccatggccacttacacttccagagtgccttattcaggagcctctccacctcctcaccttggcacagagcccatcatttgctttctcttgggaggtcagagcttctgttagtattagttcaccacattattgattaagttggattttgtgggctcttctaagtggttaagcattatctttttaaggtagttctacaggaaaataaatatattttcaggccaccaccttagaacacagcttgattgcaattgtgattatctttgtccatgaggaaagtcaaaataaattggagttgtttaacctggttatactttctatgtcctgatcaagtttaatttatctttaaataataattgttataaaggattggattaaaatctgatcaatatgagaatggttgatattttttttttcttaaatttgaaccatgacagttaagagattaactcaataaagcattccatgtccgtttccctaaaactcatgaatttagaagtaaattaaaggtcaagtgtagaaagtttttaataccacgtctactgatcatctatacacagtataattttgggcttttttttaatctataaaaaatcatagtaataccctctttgcacaattcatttcattagtgtattaggatgcctatcaaatatacatgggatttaggtttatttttatttatttctctgtctagccat

SEQ ID NO: 126742 - DNA, 1078 bp, Homo sapiens
taaagtggctgaagatgggtggaggattatgaagtagttgaggtgcctactttatacaagatactttgttaccacaacccaaatggagcaaaacctactctgtaactccaggcagcttcactagcgttttgttctcattcctaaatgctaatctgttcctttggcccctagccagtactgagatagactagaggttgggggaaggaaccaagcaaaggaaaagtgaaaagaaaatttgaataagacatagaattgtctggagatagaaatatgtggtattaccatttttaaggcattttacagtttacatagcatactttggtataaactgtattattagttccgtgttacagattaagaaattgaagctacaagtcactcagctagcaagcagtagggacggcagacattctgggaacaggagttttctgattgcttctattttttcagggaaatatacagcaaagtcatcaactgagaataaggaggagggaaggaggtgtcggagattagagaaatgaggagaaggtgaggaacaatctcctaggggcttaggagcatgaatgggatatttaacagtattgacaggcaacgccaagaacccaccttggtttagtgatcatagatttaaagtccaaccagtgagaagctcattcagcttctcacactcaggcattgacttggtttcacccaggactagaattttcctaagtgaccatgaatatatgtattcttaataccctgccccgcttgctctctgaaaactaatgaactctccaggccccagtttaaagccagtatctccacagttgcactggatcccatttcctttcaagataccactcactgctgaagatatcactcactgctgaaattgattttaatgaatcacgtaatctaatccagaaaggaaggaaataaagaagtgggtatcagggactcctgtgagatagcatgagaaggtggtacatttgggaggtctcaaggggttactgaattattggaattagaatcaaagggacggccggtgcggtggctcatgcctgtaatcccagcatgttgggagtctgaggtaggt

SEQ ID NO: 126743 - DNA, 1384 bp, Homo sapiens
tttatttaagaaaagttgcattgtgttatacatattgttttgtgaattgctcattcattttacaatatatcaagatctacatttactatgttaatacgtgcataatatattttatttatgtgtagaatagtttattttacttctgtgctcttaatgtatagttagatgatttcatagtttaattttgaaataatagggatttagcattgatgcttcacatctgagttctaagcaataggctttagttcctgcaatatgtgtttaacttagtatgggtcatgtgaatatcagctttctagatgctcttttgtaaaactgagatcaaggttttttagattttcatttaaaaattcttgtttgtcttgacagcaattgtgaggttataattaatttactaagaattttatgtttcaaatacacatatacctataggtgtaatatcataatattttatgattaaactgaacaaattatttaatggtgatatattggggatttgtttgtatagtctgaaatgtgacctttagaagaaaaggtcactagaccttacagtggaaagtttggggttttttgtttgtttttgagatggtctcactctgttggccagcctgaagtacagtggcatgatcatggctcattgcaacctctgcctcccaggctcaaggtatcctcccgcttcagcctctgggcatgccagcatgcctagctaattttcttattttttgtagcgatggagggtctcgccacattactcaggctggtctcgaactcctgggctcaaatgatccatagccttggccttctgaagtactgggattacaggtgtgagccactgtacctagccacaatggaaagtttgaattagtgtttttcttatcctctgtgtgttaaaagaaaactaaaatattagtacataagggaactgttgtggcacctttaaaatttataggcttgtaaacttttttgatatcaactttggaggcaaatatattaataagtatcccttttaaaaactgaagggtattttccaacagtaaccattatttgatggttccagggaatggcatctagaatcttagtgtaaatggcaaatgttatgaactgtgagaaaggagattggcatttaatcaggttgcagaccatttgaaacaataataggaatgacatttaaggggaggtctcaacttcaatgcagatcagtagctatgtatgaggtcaatagttctagacactaaggttttattttaaggctttgtaaatatacactttattctttatataattttataagttggagacttgacattcctatgatggaaaaaaacatacatgtgtgatatttaaatggtatagagacatatgagctcaaatatgagttcaattt

SEQ ID NO: 126744 - DNA, 1039 bp, Homo sapiens
tttaaaaaattttgtttccacagtccagaaaaggctttgaaagactcactacaaccctatgaggctgcttatctatcaaaatccttatctcgactcttcgatcctatcaacttggtttttcccccgggtggtcgtaatcctccttcctctgatgaacttgatggtattattaaaactatagcaaggtatgtattttttatatagtggcttgccataagatgactgccatatttgttagtgatatatgatagcagtacctttttaatttattttcaaattattcaagtaattaggcccacaattaaattaagaattttatagtaaatgagtgcacacatagtaagtacttgagattccaattaataaataatttaaataccttaaatatagtctaaaaacagtctattataattattctatatcttgccaaggatgcaaagtaaacctagctctttgtatcatagtaaatttcttacgttacacaagaaatcaaatataataaacgattttataaattgagaaactaaaacatacaggttaacttttttttatcctaaactccagaacgtgcttcatggcagaaataggaatataactttgattagcttgtgttcgctattttaagctttttaagtgaatgtgacagcttttaagactaaaaagggaagatatcctagcagaggtgccacctgaatgcctgcagacaatgtaattatatactgttggctttagacacttatttaaaagttatccagaccaatttgcagttgaaattatctcagtttctgtcatgactaacaagttgtcataatagtagatctgtacatttgagatggacgttttaaggaataaaaaatagtatgagactgaggtctaaattcttttaaagatttgaagatggtgattctgaggcgtggaagagtaagactaaaaagccacaggtggccaggcatggtggctcacgcctgtaatcccagcactttgggaggcggaggtgggtggatcacctgaggtcaggagttccagaccatcctggtga

SEQ ID NO: 126745 - DNA, 1083 bp, Homo sapiens
catcccacaaattttgatatgttgcgttaaaattttcgttcagttcaaaatacttctcatttcccttttgatttcttttttgatccatgggttatttagaagcattttctagttccaaatatttgaggattcttttcaggtatctttttgttactgatttctaatctaaaactattttggttagagaacaagctttgtatggcttgaagccttttcaatgtattgagaccggtttaatggaaccaaatattgttgatcttggtaaatattccatgtgcacttgaaaagaatgtgtgtttgctgttttgcatgaagtattgtgtgaatgtaaattattaagtcaattgggtgttagcgctgtccagttttctgtcccgattttctgtgtacttattttcttgattcttgaaaaagggaattgaaatcttcaactacaattgtgggcttttctattttttttaaatatagattaggtttcaaaatatgacctgcacatcaaatgcagtgaatagtcagagtggaaaattattattattagcattattataaaaggcctcattagaacacgtctttggtttgccctatagtatgggttatttggaacatatcttcatatgcaaaagaaacatttactacattttattatttttctaattcatgttcttgttttgcttggcagcttcgatgtttttgaagcaggcatttgaaggagaataccctaaattattacgtctttataatgacttatggaagcgtcttcaacaatacagtcagcatatccaagggaattttaatgcaagtggaactacagacctctatgttgacctacaacacatggaagatgatgcacaagatatattcataccaaaaaagccagattatgagtatgtttgtttaatttgacctgttagttggcatcttaattttatttttattttaaattttatcttttatttttattttaaattataaattaagtatataccaagtctctaaatatttgtagtttatttgtataccttaaaagactttgcaagacttttaactgaataagtcaatttttcacccttagttgaacacttg

SEQ ID NO: 126746 - DNA, 1051 bp, Homo sapiens
tctctctcctagcatcatcatttatatttctcctttttctgtgttggatttctccttctcttttaatttcttttcctcagctataaacctattcatgttgctcccatgtaataaaaaataaaacaaaactagaaagttcctctttagttgctgtttactctctctctttttatgtaaatttctccaaagagtagtttgcattttttggtgttcattttcattctgttgatttctcaactaggtgtaatctggctgtcttccatcattctattgaaattgttctcattaagggaagcaatgacctactttttaattgccagcgtatgttttcagttcttatcttatgggacctatctgtcttgtatagtgaaagaagctaatgacaggaaacatacaatatgtagacagaaaatcccattaatatttcaccttaggaatagcctgctacttctaataccataattactttaataacttcctttgggagaactccaaagtaagttgtttataaagtaccttcaatttttatagcacatacagtccctgaagtgtactgtagtacttcttagaattatagacaggcaatattaaggaagtgcaaccatctgcagagttgaggattacacacaatgtaacagattgtctaagtaagtaatgttttggcaaagtatatctaaaggaaaatgttcctagttaggaatatgttctttctgattatacatgttcatgcttagttaaaaaaaaaaaaagttctattagaaggtaatccaagagcttgacaataaatttacttctttttggaagtatgcttgaaaaatctagcaagtacatctctttttacatgtctaaaaccccttgtgcagtattagtctctgaaaactcttaagccactcaaagaagttgttcatacaagttagagtgctaacatggttatatatctgtaatacttggcttcccaaaccaagaatgaataagagatacattgagatatatgtgttaccagattttaaaagttttaaggcttgaaatactgtatactaaagctcattat

SEQ ID NO: 126747 - DNA, 1068 bp, Homo sapiens
tggaaatgcccttgtccgctcattctaacatctatgttaattccgggtttttgtttggttgaattttctttccatcagacctgatatttttctacttatttgcatgtctaataatttttattggatattaaacatgaacttaaccttgtttggggctgattaattttgtcatctctaatactgatagtatcagatacttaaagacagtttgatccttttgaatattgctttaagatttattagcaaattcaaagcagtaataatctgctatttatttcccagttatgaggcaacattcttcttaataccctcaaattattaccctgtgaattatgaggttttccagcctggctttagagaatagggattattctcaatcttatgtgaatgtaacaggatgttccctctaaacctttttcatagttttcccccaaactctggaagtttaatgctgatcagtgctttgctgaatactcaaagggaaccctttgcacatctctggaattctctgtctatgcgcctctgttctctccggtattctattttgtgaactctagttgtttctgtttggctgttctgggaggggatagaaggaagggtattttccctctttccgtgccatggcctggaaagtcctttaaggtaatgagctggggcactcatagggttcatctcatttgtttcctgactctgaggaatcaccgtcctatgttgcatgttaaatgtcttgaaagccatctttcatatattgtgtattttttgttgtttcagataggttggtaaatctggtccctatcatatcattgtgaccataagcaaaagttcctcattaaaatttcaatgagaaacttttgcttatggtcatgatgatttaaatagtgattaaaatatttaatgattcaaatttaaataatgattaaaagtatatttcagaatattatatgggagtgtgtgtgtacgtttatttagtgatactgccatttacttgtcagtgattatctgcttttctttctttttttttcctgagacagagtctcactgtgtccccccggctggagtgcagtggtg

SEQ ID NO: 126748 - DNA, 1051 bp, Homo sapiens
atgttctcccattataaactagaacagtgagtaaaatttgtgaaacacctgttttcagacattgggcaacaggcaatatagaactgtgatctcagataaaccaaaacaaattgaacgctaaaatcaccgcagctttctacctggcaatttccagacagctgcacacacaaaaaaatgggaatcaatatatagtctgccattcttactgattccagaactctttaaaggattacaacaaaatctgtcacttaacaatatagtatcacatattcagcatccaattaaaatgagtggacatgagaagaagcaggaaaatgagaccataaccagtagaaacagagaagctgaagtatcagtagtataagcagactaggaattttaaaacacttcttataaatgttataaatgtgctcaaatattttaaaaataacatataatgagataaatggacagtatcaagaagaatcaaatggaacctccacatatgaaaaatatagtatctgaaattaaatgcagatttaaccctgagaagaaaaaaaaaaaaatcagtgaactagaagatacagccatagacataattcagaatgaaggaccaagatttaaaaacaaacttaaaaaattattagagtcttaggacccatgggacacatcaagcaatctaacatatgtgtaattggagtttcagagccaagagaggaagggaaaaagaaaaaagttagaaaaaaatagttgttgaaaatatgtgaaacatttttgttatggactaaatgtttatgtgccacctcttccaattcatacactgaagccctaacccccagtgtaactgtatttggagatagggcgtttatggaagcaattaagtttaaatgaggtcacaagggtgggccctgatcttataggattactgtccttataagaagtgacgcgagagagcttactcactctctatgtacacaggcacaaggaaaggtcatgagagcacttagcaagagggaggccatcagcaagtcaggaagagaaactcagccctaccagaaccttgatcttagac

SEQ ID NO: 126749 - DNA, 1206 bp, Homo sapiens
atcaacttctttcctccttccttcttttcagtgttttaccatctaaatatttttttaaaacaacagaaacctgagtcctttattttcttctaaacacttttttccttcacactcaggtttcagtaagctacctggtatctctacttccctgcttctcttttgccccacacccttgatgtcaaggtttcactctactgaaaccttgttggtcagtgcaccttagtgacccagatgccaaatccttctgcccacttctcagaccatgtttacttcactcctctgaggtgattgaccacttcttcttaaatctctcctccctcaggtattcccactcttcagaattcctttattgattcctcctcctcttcatccccttccttttaaaatatttataaaatttcaaacatataccaaactatagaacccaagtataggacagtgaatacctatgtacctgccatccagtttcagtgattattaacttatgctcaatctttattttataatcatctccacccactcctctctctccactctgaatcatttcttccaccaacttttaattgatttattccctgtggcccaccctcaacattgttttcttcccatgccacatgcaatatatggaaaagctcgcacaggctaatagtttctaccacctctaaatgctgataacacttaaatctatttttttagcatagatcttgctgaaaagcagtcagtggccaggtgtggtggctcatgcctgtaatcccagtactttcagaggccaaggcgggcgatcacatgaggtcaggagttcgagaccatcctggccaacatggcgaaaccgcatctctactaaaaatacaaaaattatctgggcgtggtagcaggtgcctgtaatcccagctactcaggaggctgaggcacgggaatcatttatcatttggaccctggaggcagaggctgcagtgagccgagatcgtgccactgtactccagcctgggtaacagagtgggactccatctcaaaaaaaaaaaaaaaaaaagaggcaagcagggtcatctccacttggatgccccacaggttccagaagcataagtttaaaagagcacatctttctttgcccacctgctgcttcttcttaaattctattttggttgcataatcttcatcctcctagttcttcataaatatatttagtcctagttattaataaataca

SEQ ID NO: 126750 - DNA, 1093 bp, Homo sapiens
tttctttttttttttttttttttgagacggagtctcgctctgtcgcccaggctggagtgcagtggcgggatctcggctcactgcaagctccgcctcccgggttcacgccattctcctgcctcagcctcccaagtagctgggactacaggtgcccgccacctcgcccggctaattttttgtatttttagtagagatggggtttcaccgtgttagccaggatggtctcgatctcctgaccttgtgatccgcccacctcggcctcccaaagtgctgggattacaggcgtgaaccaccgcgcccagccactatattctgttttctatggtttatatgaatggatgcagtatttcatttttaaattagaattttaggttgattattagacattaagaaattcaatgttggtatctttaaaaccagttaagagttttattatcactgtctaatcaccagtactatataatactttgcttgaaagtgagtgtagcaaattattgacaaattattaaggatccacacattggaaaacaggctgtagattcttatttgcaggattaagccagcttagctgtgtgggggattatagatatgatactttgattttctaagccagaagtttttatcattaaacagaatcttgtaatcatgtgtataggatgcattaaactaaatttggagagcattcagcattttcagttgctgtactaatgagaatcgtaactatgaaaaataatgtgttttcttttacccttttagacatatcaaatgatttgaaaatagcattaaagactgtaactcaaaaatttaggatatccaaatttgaaatcttttcaatattatgagataaatgttcaacttatttatctatggaatctcaatttgattaaaatattgaatagggataaaccaggtagatttctggttttttttttgttttttttttacaattaccttgcaaaggaccattttttttttcaattttattattattatactttaagttttagggtacatgtacacaacgtgcaggtttgttccatatgtatacattgtatacatgtgccatgttggtgtgctgcacccattaacttgt

SEQ ID NO: 126751 - DNA, 1037 bp, Homo sapiens
tttatttaaaaaaatatagatggagttttgctatgttgccccagttggtcttgaactcctggcctcaagcaatcctctttccttggcctcccaaagtgttgggattgcaggcatgagccaccatgcctggcctattatttttatatttgctatataaatgtgaccttacgtaatactgaatatatataacttttaagttgtactggataaaaagagatgaaagaatcttaggtcttaaagagatttttaaaggttaggcctagcctctgaataggtttgtattgaaactattccagaaagagatctttgtaaagaacttgccagaggagattttactcttggcttttcccagcaattattctcagaaagtttgatataatgtttaaatttccaggagcagtttaatctcattcccccttgtgtcgtcaagaatggggaaaaaaatgaaagcagttattcatgtgctgtcaatcctaatgtatgcctcttttgttgagagaattaaaaaaagctgccttattaccatgtgttgacaagtggataccatgatttaacacagaaaccttaagcatcagttctttattattttctttaaaagcataatcacaattattgtgtgtgtatatatatatatataaatttttttttttttttttttagctggagtttctggtcacccaagctagaatgcaattgcacgatcttagctcactgcaacctctggtgcctgggtttaagcaattcgcctgtctcagcctcctgaatagctgggattacagaagcccaccaccatgcccagctaatttttatatttttagtagagacggggtttcatcatgttggccaggctggtctcgaactcctgacctcaggtgatccgcccacctcggcctcccaaagtgctgagattacaggcgtgagccaccgcgcccagccaattattttatattttaaaatgttttatagacagtattaatgttagtttcctgatcttgtttatattgaagttatgtaggagaatgtccttgtttgttgga

SEQ ID NO: 126752 - DNA, 1007 bp, Homo sapiens
ggtcagtgaaatataatgaataagtctgcatggttcagctctcagtcaactccacagaattaatttattgtcaaacaaatgtagaaataacaaatgttatttctaatatggttctttttatagggattggtggtagattttaaataagctcgaatattatacaacagactttcaaacttcttgttattttttaaaggaggacaaaaatggtaagggggaaaataatatacatagtatttaactttgtattttatgaaataaagtttaaaaataatcttcacttcaaaatgtgttttttcttgtctttgataattttaaaatatggtagtatttaaatatgataggactgctgaagtcctgcttaaagttgtatatttatgttgattttgtttgttttcctatttatatctgtttccaccccaccccacctttttttaagaatccaactcaagtcggaacagctcttcaggttttctataatcttggaactttgaaggatactattaccagtgttgtggatggatattgtgctactttagaagaaaatatcaacagtgcattagacataaaagttttgactcagccttcccagtcagctgtgagaggtatggatgtggtttatatttagcttctttatttatttataactgagaagtcttttgaatagtatgtgaaacactcatgtttcaaagcaatctaatgactcattttttagtagacagaaaatgagagaagaaattatgtttcagaatttatttatatcttttttgtctaatcagtgaattgaactggccaactggtatattcagaacttctagataaagatccataaactgtagcgtcatttggttgagaggaaacagatgcaaaaaataaaaaataaaaaggcaaggaacatatttttcttctaaaatccttatcctcccatgtacttcttaaagacagaaaatattttttaaggaatgccgtctctactttagctttctggacttttctttatgataatt

SEQ ID NO: 126753 - DNA, 1010 bp, Homo sapiens
ataggcctgagaaagcatcaacataatcaagataataaacatatttatcactcccaaaagtttccatgtgaaacctcccttccacccttctctgaaaacccctccaggccccagggaaccaccaacctacattttttatttatttattttttatttggagacagactctcgctctgttgcccaggctggagtgcagtggcatgacctcagctcactgcaacctctgtctcctgggttcaagtgattcttgtgcctcagcctcccgagtagctggtactacaggcacgcaccaccacaccctgctaattttttgtattcaagtagagacggggtttcatgatgttgcccaggccggtctcaaactcgtgagctcgggcagtccgccagcctcagcctccagaagtgtcaggattatggatgtgagccactgcgctcagtctcactaacctacattctactttgcattttctagaaatattttgcaatctgtgtcatctgttcattgttttcctgcattcttttcattatttttaaattttacctcatttgttgacttattagctatagaatcttagtttgttgttaaagggttcatagtaaacaattctaaattatcagtgtgtatcttccttgcattcccagaagaaattcctcatggtcatggcatattattcttttcatatgttgcaagattctgtttgctaatattttcttgatatttttgcatctctgctcttgagggagattattttgtaggttttttttttttgtaatgtctttggtttttgtattaaggtaatcacatttgctagtgttttgaagacttttgtgtatatctcttgagggataatgttctgtagcattctttgtttccctacttttgggaaatgttccctctctcattgtatagaattgatttcttttttcagtgataatgaaaacatctgggcctgttgatttcttattcagaatgttttaaactacaaattcagttcccttaatgttctaga

SEQ ID NO: 126754 - DNA, 1028 bp, Homo sapiens
tgttccttttagcatgtaaggtagcatttcacaaattctgaggattaggttgttggatatccttagagtacattaatatgcctagcacagatggcagcacttcccaaattgttttatagattcagtgcagtccttatcagaatccgaattggtgtttgctgcagatattgtaaaatgatcctaaaattcatactggaatgcaagcaacccagaatagctaaaacaaattctaaaaagaatagccaaaatcaacttgagaaagaacacagctggaggacttacacatactgattttaaaacttagtacagagctacaataattcatacagtctggtaatggcataaagatagatatgtagatcagtgaaatagaattgagagtccagaaataaactctgacatttatagttaattaatttttaacaagaatgtgaagacaatgtaattggtaatgaatagtcttttcaaaaaattgtcctgggacaaccagtgtctacatgcaaaagaatgaatatatatcacttcctcataccatgcaaaaaaggaactaaaaatgtatcatatacctaaagatctaaaaccatacaatctgttagaagaaaacatgagtaaattattgtgaccttggtttctgagataaaacaccaaaagcacaagtgacaaaaggaaatgagataaattacacttcatcaaaatttaaaacttttgcacattaaaggacattatcaagaaagtgaaaagacaatccacagaatcagaaaagatgtttttaaatcatgtatctgacacagggtgcttgcatacaaaatatataaaggacccttacaactcaaaaaagacaacccaactgtattagtccgttttcatgctactgataaagacatacccaagagtgagcaatttacaaaagaaagaggtttaatggactgacagttccatggggctagggaggcctcattatcatggtggaaggtgaaaggcacgtctcacatggcagcagatgagagaagagaacttgtgcagggaaa

SEQ ID NO: 126755 - DNA, 1083 bp, Homo sapiens
cattataacttgtgcaattcaatggcttttagtatatccagagagttgtgcaattgtagccataaactaattttagtagatttttattattccccgaaaccacttcatacctattaacagtcactctcctttcctccccaaaccatgcagtcctaggcaactaatattctagaacaaatattctgtttcacaggtttgactattgtggatatttcatataaatgggataatataatatatgatcttttatgccgggctctttcacttagtatatattttcagggttctttcacattgtagcatgtgtcagttcttcattctttgtaattgccagataatataccatgtatggatataccaccttttgtttttcttttcatcagctgacagacatttgggttctgcaaatattttctctttttctgtgaattgtcttttctgaagtaattttattttagtttaaaggtaatacaatttgagagatataacatcctattttcatggacctgcagcaagggaaaacccttgatgttgcatcttttaaacattattatagactcctctcaagcttggaaagagattaggatgtataaattaaggaactggagagttatactgctaggtcagctattttattacagtagattccagactgtatctctaaattttgttctttctttctggtgtttctttttccagcttttaaaatcttgtatttgtattctctgaaacacatctattatagcgtattattgggtctgccatctacccaaagagtctgcaaccctaaattatctctcttggtgacagattacatgctacaagtttctcgtatagactttttttttttttttttaggtgaaattgatttaaacctcagatgagactgtatttccagaaggtaacatgtagccagaggcatatatgtgaaagtagggagggaacatggttgacatactgttgggctgatgtttacctttagtgcataagtatttaaaaaaaaaaaacaacaaaaaacctgtgggttactcctgacacatacagccatatcaagctttctcttttgtcaaggccagatgtatt

SEQ ID NO: 126756 - DNA, 1078 bp, Homo sapiens
tgagccactacgcttgccctacatttctgcttattagtttcagttataagaaattatgagggtatgtgtgtcacaatccaaaaagaagtactctttaagactgatgcttttttaaattgtatttttggtcatccaaaagagttgtgttactcaacttcaattcaattttgatgtgtttcttatgtgaaaatcgctattcttttattacaggagaggcatagtccttgctctttagagtttatgatatagtatttgatgatttgggatatgtaaaactaagagaagtataaacataactttaatatgatcagtattcaaaaagatattaacaatgtgctatgaagtttcaaaataaaccatattgtttgaagaattagaacaagtttcattaaataaagtagggggtgaaagaacaggtataattctgaaaagcagggttggagtggcgaaaacagtgtaagaaaactgcaggtatctttcagcttataaaatcctgaaccatttggcctgtgcaacttttcatggctaactttttacttttaattattgctctgagcgatgataagatggacttgaataatttaaactctgtaaaaataatactgaataatttagactctattgtaaaaataaattatatgattaatttgctgttctatcctgcaaccagccagtttactgaggataggagattgtggtagtattagctagactagaggataatatagaatatagagacttatagaactgagagggacatagagagaccagttaattcatcatccccgttttgaagattaagaaacaacagagagataagtgcccagttttctacacatatttactctgatggaactgttcctgtgtaagtctatgtctttcaactgtcagtccattaggattatttgaggtaggcgtctaattcatttttgttaaggtaactgaatctgaaatatttaatttgtgcagaatctgtagattcctacaaacaaatcagtccagtgctttccctgctttctgtgtctcttactagagatctcatttatagctcacctagaagacggtagagaatatatga

SEQ ID NO: 126757 - DNA, 1175 bp, Homo sapiens
agaaaaagagaaacagatgtcataatatagcttgaatttgaaataactgggatttaatctaaactaccaatgacctggagtttcatcttatagataatatatggttattgacagagtattatgagatactgtatgaaaaatgctataatgcctatagcctctaatataataccttgtcaagtatgtgtgtttgtatgtaaatatgtgatatactgaacaccttatatataactgtatcctggttaataacttcaggacacttttcctcttcgtatgtatattatcgtgtgacaaagtgaaagtttaaaacaacaaacatttatgaaattacatcatttctgaagaataatagccccctaaagatgtccatgtcctatttcctaaaacccccaaatatgttacattatgtggtgaaagagactttgaaaatatggttacaattatggacctagatatgggctaagtaatacatgagaccttaaaagtggagaacttttcccagctgatgttggaagagatgagtcagagaggtgaggcagaagggtgttcagagagattcaaagcgtgagatggaagtagggagctatgagccaaggaatgtgggtggcctctagaagctgagaatatcccccagctgacaggcagcaaggaaaccagaaagtcagtgctgcaactacaaggaactgaaccttgtcaaaaacctggctgaatctggaagcagttctttcccagagcctccattaagtaacacagacagccaataccttgatttcaggtttgcaacacccagagcagaaaaagccaattgagcccactggacttctaacctacagaactgagatagtaaattgtattgtgtagagccactaattttgttgtaatttgtcatggcagcaatagttaactaatgcaaaggggtgggaatccagaagtggcttagctgggtgattctggcttaggacctctcatgaggttgtagtgaagttgtcagccagggtgtgactgtggtggaaggatgtactttcaagctgactcacatggttgttggtaggcctccattcctcaccatgagggcctctttccagggctgtgcatgatgtggcagctgacttcccagtgtgagtggggagagagagagagacagtgagagcatgtgggtacacagtatagaagcc

SEQ ID NO: 126758 - DNA, 1129 bp, Homo sapiens
gttcaggaagagagtcatttagctaatctatgagcttagctttgcttacttacccaatttcatccttgttagttatctatatattcctcagattctcattattaataccatatgcagcaattctcaaaactcacatttaaaaactgggaaaatcttgaaattcctattgtttatatctattgaatgtactatattaatatgagagatttaactcctgtactttcagttgtaatgcttactcacttttattttgtagacctgtgactattgttcagattattttgaaaatcaccataggaaggtctgattgcttggttaaacatttaacaaatattcattacattctgtgtgtccaaaacggtataaggtgctaagggaacaatgacaatgcatttgtagtttagtaaaagatgcagatgaatacactatgatagtatacagtaagtgcagtactaaagattaagtataaggtgctatgcaattacataagacagacactagtctgcagggaaatgatcatggaaggctctccagaggaagtggataaactagatatgaagaatactcaagtatttgccagatcaaggggatgggtgcttgttcagattggtgaaagtgtatcatacaaagagacagcctttcctagaagaaattaaagatggggaatacaagaaaagaaggacagtgtattagtccgttttcacactgttgataaagacatacccgagactgggaagaaaaaacggtttaatggacttacagtttcacatggctggggaggcctcacaatcatggggaaaggcaaggaagagaaagtcatgtctctcatggatgataggggccaaagagagtgcttgtgcaaggaaactcccgtttttaaaaccatcagaaactcccattttcaaaaccatcagatcttgtgagacttattcactatcaagagaacagcatgggaaagacccgctgccacgattcaattacctcccaccgggttcctttcatgacaggtgggaactgtgggagttacaattcaaggtgagatttgggtggggatgcagccaaaccatatcagacaaggaagcgttgagagatagggccaaatattatatggccatccaagccatattag

SEQ ID NO: 126759 - DNA, 1002 bp, Homo sapiens
ctaaccagcagctctcctttcctctccttgatagtggtttgcattggtgttatggtttatgttggggaagaaaaaatacaaaagaatctcttcttcatttttcttatgatactatgggtttaaaaaactataatgtgagttaagtagcagtggcttcttcaggatcatccttatactaagaaacacaaagggcattaggtgttttaaatatagatgagtccatttatataaaaaatactttaaagaataagattacttgtaaagaataaagacgttaaaaaactacatgttcttacaacaatttgttctattattttttccctgtaatacagttattcctcccccgttccccacacaacagatttgtaatgtaagaatagaatcatggtgcagcctgcaactcccagaggtaaaacacacagtactagacttccatctgtagattttacttttcagatttcatatcattttctcagagttaaattcaaatttaaaatcatttaagatttcaaggattgtattcatgttgttcttttaagtggtttcatcatattggattctgtgtttagatattttattaagcataattttattatttttcaattatatacactaggcaactgcttgtgtcttaaattttaattgcttgcttttgtcatattgaattagttttgaaatagtcttttactgttgaatatttcccttttgatgaacttaaaatagtatcattaatgaattttttatctgagtaaatttcttatttgttttgatttggatatttcacatatacaagcataactcagaattattcaaaattgaagagatgtggtatgaatcatctgaaggatcagtaatacaataatttaatatttttaaattcatgtttgacattgcacttggatttggaaacatttagcctagaataaagacagtttattggtattataagagctgtgttaagtatttgaatcttttgaatcacaaatgaactcttatactagt

SEQ ID NO: 126760 - DNA, 1067 bp, Homo sapiens
ccaggcaggagtacagtggtgctatcacagctcactgcagcctcaacctcctggactcaggcaatcctccttcctcagcctcccaggtagctgggaccacaggtgtgtaccacagtacctggctttttttatttttcccagtagatatggggtctccttaggttgcccaggctggtcttaaactgctggtctcaaggatcctcctgccctggcctctcaaagtgctggaattacagtcgtgagccaccacacctggccctgttctattaacatttaaaataaagataatttttttttttactgaaaaaaagagttgtgaaatccttgcctataattgcagatttgtcagttttagttttttgacttcatctggtttttgtttcatgtgtttttatcgggtgcatgcacatttaggattgctatgaaatacatgtctttgtgctcaatgataatccttttctcctgtcagtaaagctattccaggttcattctatatagtttgcatcatatatatagactattttttaaccttcacttttaacttaacttgtttatttttgaggtgtattttctgttgataataatggtttgtttttgctttttaaatccaatttgatttttgtcttttaattagagtgcagagtatttgcatttaatctaattttcatatggttagggttacatcttctgcctctcatttgttctgtttgttccatgtattccttgttcattttttctgtttcctacccttttttggattgagtaatttttacatttccattttaccttctctgctgacttattggctgtatatatataataatataaatgtgtgtgtatatatgtacatataatatatgtatatataacatatgtacatatatttgttatatatacatataatgtacatgaaatacatgaattctcactctgttgcctaggctggaatgcagtggaatgatcttggctcactgcaactttgacttctcgggctcaagtgatcttcctgcctcagcctcctgagtagctgaaactacaagcacttaccaccacacctggctaatttt

SEQ ID NO: 126761 - DNA, 1056 bp, Homo sapiens
tgtagatcagtttggaaagaaatgacatcttaacagtattgagtcttctaacttatgaacatagtatctctactatttttagggcattttacatttatttcgtcaatattttgtagttcttggcctacagatcctgcacatattttgttagatttgtatttaattatttcttcagtactgttgaagtagcacctaattttttaaaaaaatccaattgtttattgttagtatatgtaattaggatcatattgaactcatatcctgcaactttactaaattcatatattagtcttgggagttttttgtgtgaattccatggtattttctatatagacaattgtctgcaaatagagatagtttactttttcctgaaacatgtgagacttacttatattcttgccttcttgtactgcctaggacctctggtattaggttgaatgggagtgtgttgggagaaacaatccccataagccctgaatatccctgaacattcttgccggatatgctgagaatgcaaagccctaacagaactaccctttactccatccatttctcaggaaggggttgtagctagcaaccttgaggaatgaagtaatgacaccctagacaaatagaatgcaagcagacttgcttttctttgttataaaaatggcaactttcccaagctcagtgctcttcagctgtgaaaaaacccgtagtatacagagcatccacagtccctttgccagggacttggagggcaaggtgaattttcactgatatcatgctcatactgcttgctgcatcatgggtaatacagttctttggttcggacccaggcatcttacatcttatgttagcatccatgaaacagtaacaggctagcttcacagcttataaatagggtagaatcccagaccctaaacaatttttgacatttttggctacaagcatatgatgttgacagagataaggtttcctgaaagagaaatgacagggctcttatgggctggtttagaggatatgagaccagtagcgaatgctcttgtttaagtggtggggtagtagtacagagta

SEQ ID NO: 126762 - DNA, 1070 bp, Homo sapiens
ttggcaaattgatacatgatatcattgacagattttgacatgaatttttacctgacaacagtgaagtagctgtgttttatttcatgtcttgtaggaattctttcgttttctctccaatacttcaactgcatgcattatgagatttagttggctgatggatttctaaagaacagtacataatatttgtatttgttttgctttaaaaagtcacggccaagaggaatttcctcagatgataggaattatgtttccctttgatggagtacatgataatatttctttattttccagaatatgtgaaaacaaaaaaggaaacataacgtttgtagcttctaaaatatatttagacatccttttgttaccattgtaaatctgtttttaatagcagtgctcactattttgaaatgatttcttgatcacataacttgctttatattataaatccaggccatgtccttttgataaaaaccatctgctgtttaattttgtttgttttcattagaagaggatacataattggtcataaaagtcagatagaaaaatccattagtcataccaattgatatgaatatctgaatatttagtgcagaaaacacttcctaaatcttccttttgtgtgctgataaagtattttcttttctttttggaaattcatgtttcattatgtcttccagaatcagtaacttccacaattctggtatatgaaagtataaacttccccttttaaaaattcttttcaggcttttacagttatattgtttttctttttgtggttattttatgtagcatcttcttaggatacagttgattttttatattccatcagtaatgtagacctattccctggttttaactccttaatgtcttaaagtcgtgttacaagaacatcttgcagttcgtagttcagacagctagggagatgctcagtcaattgcattcttcatattgtcagttgtaaatactgaattagctgctattggcccttgtgaaaagaagaaaattggttaagaaatagggtttttaataatttgtaattaattgcaagttactttagttttgtttaaaaacta

SEQ ID NO: 126763 - DNA, 1841 bp, Homo sapiens
aataacttattgctaaatttctgatagtgatattgacacttatcgatagattattacattataacaattggaaaatatttgtttgatatgaggttcccaattcttgtaatctgtagttagggttagtaatttcatgattttcccacatgaattgagggtgggagagaaaaatgcctaaagttaaattaagtgatggtacggtagaaaagtgacaagacttattgttaccttagtgatttcagtgtggaaataaaacaactcattttgaattacttgggagctatgatttggtgggaacattgtataaagtgtattaccctaaagttgtatgtatctaatattagaggctttgttagacttttctataatgatttaaagtcttttttttttcattcctggtattcagatttgggtagttaactttctattatacaaaagagctgagttgaataaagttaggaagtcagcttattttgatgtactgttctttttttttttttttttttttttaaaatcattgcactatattaatccagagcatttggcttagacttaagcaaagtgaggaaggaagaaagaggctggtgttttagtattcttccttccctttagtttcatttcatttgtatattataggcatactgtccttgaacttagaaaatcaatcttttttttcctagtaagcatgaattttaaagtttctctattttggtgtgtatacagaggtttttttggttcattaattttaaaattttgataaattctatgattttttacatttaaaagaataaagcttcatacgtacttaattatttgtgatgcatcaaatatagcaaatacactataccaggaaacatagcatagtggtatggaaaatactggattgttttgagcccataattttggtttttagattaaaatgctactccagttgtaatctaaatatatctgtagtttgtggcttagaaacaatgcattttaacttaaaaaataaagcaaggatacctatgtcagttacattttaaagttatacactgttttaaggctatgtatttattccttaaaaaatatgacttacatgaatattttctgttggacataatattgacaaaatatacacatgatagtactttaacaaactgccatgcaacaaatacattaagtaatgaagaaattgaatatatatgacctatctaattgacattcacattgaaaatttacaacataaccaatacttaaaatatttttcttatatttggcagtaatatcagtttttacaatttaaatttaaaactcatttgaatgtggatttggtgaaactgagacttttctctagtctgtgacaacctgaggcactaaacatttttctcttatttcactatcttcaaaggtaatttttttgtttcttttaggatctatccaagagttgtgtattacagcattattaggcaggggatcagcttctactatagaaacaactcgctttttcattttacttttcaagaccttttgaaatttttgtctagtgaatgcatataatagagggtgaaatatagttgttccataagccatgactaaaaaacacaatcttaattttactaaaaggtcacttgggcctaaacataaaatggtggtatttaaaacagaaattggtgtccagcagagaagaaatgtagaaataatcaataaagacatcctgaagactctcttttgtctttctcgtcgttcacggtgtcgtttcacagctcgccggagggcaattattacagaaactgaagttcttacaccaaagactacatttctcccaccactgctttgtgacatgtctgtagcctcatgtt

SEQ ID NO: 126764 - DNA, 1121 bp, Homo sapiens
gtattgtgtgcatttaagacagtttttataaagtaggtagctacagtttgctagcattttgttgtttataagaagtgatagttggaaaaaatttaacagcaaaagaaaagacaaagctttttaagaattgagagtgagacttttaaagtacagagtatgtaaatttgatattttatatttcaacctgtcctaaggcattagcaatattttggatgaaatatatatctttgattcttctttacccaatcaatatgcagtatacccaaccagtgtactcagtttatagtatatgacgtatgggattgtgtgtaatattactggctgattgaagtataaatatgttaatatataattattacctcactacagtcccatatgtatttctcactcctacagtctacgtttaatatggccagtgctctcatttgttagcattaatattttaaaattttatattaaatttaaattttaatttttcaaatcttatgagtattatgtgtccacagctgtctgagggaaaagcagtttccccataaccttgtcatcctcgctagccactttctctcttcatcctgagaaattggttgatgtgctttggtagtctgccttgcttaatacctctgagaaaaatatgacatattgctctcatggaagcagggtgatgaaaatgacctcaatcccagacagacttagctcacctcccttatcttacttgatgcttcggggtttgatagtggcagggagttgatattggtgtcagtgacaggaatgacagcacattttaccacttgctggtgcaagtacaaagctgtcatatttgaaagccatggatacagcttatggaggcctgtagaaaatgtatgaatagaatgggagagacacgtaggattattttcacatgttgttttaatatgagcaagggaagaaatattattgtgattacgttcacttggctctttttgtcctgaaaaaaatgagtatttcttaaaagttatggcttttgtattagtggtaagcccacttttccatttgtttccacatttcaatgccattttgttctaaatatctgtaaattgtaatatttaatatttattctgcttgttatgatgcattgtttgttg

SEQ ID NO: 126765 - DNA, 1415 bp, Homo sapiens
aattattttagtcatactttttttttttactggtatagacactgttttgatcatccttaaacatacatctttgcacagttgttcaatttttttccttatgatacattttagaagttgaatttcttggtcaaaggtcatgtttgaggtttttgcttaatatttcaaaataaaatatattttgtgtagtaatgtgaaaaatactcataggtttatcaaaattattagtcataagcatttaaaaattatttgctagccaggcacggtgcctcacaccttaatcctgatacgtcgggagtcccaggtgagaggattgcttgaggccaggagttggagatcagcctgggcaacatagtgagacccccatctcttaaaaaaaattaaaaattgtttgccaagcacatatgaacattggtatattagttttaaaatttattctaatttggatttgtttttgctgtatgtggttgaacagttttgtgtttgtcattctttttcattgatgagttacctgtttgtattctttgcctattttccttttgccatgttggtttgtaactattttttatacagtagaggtaaatttgctttactacataggttgtaaatgtgtttcccagtttattctttgatgttttaggtttaattttagaagttttataattatacttgttaatattttacttaataatggatttatttggttcctcaccacaatattacaaaaatattcacctccatattcttggatatttttatgattttacttttatctatctgctatttttttggtataacttaggcacatagcaaccacatctcacaactctaggcagtaccatttactgtcacatagactataatgtgaactgtgcctcctggagttgtacaactcactgtctttgggaatggttaagcattaaaccctgtttttccattgtttagttacttttccaacactacttaatgaataatccatcacttcaccacagatttgaagtatcttatttttcataataaattcttacatttgcttgagtcttgtatggactttctattgcagttcagttgtttgtctattttccttttttaaatcctgggattatggtttttgttgcattttagttattattcacttattactatttacagctagatttttttagtgttttcttttttatagtttttaataggaaaatataattggacgtacgcattttccactggcattttttttccaagactgtgtctttgagtaatttgtaaggcatcttaattctacatttgaaaaatatgaagacattgctgcaatatctggatttgaattgttttctgttatatattatgttgtattttaagtctcggtgatgtatctggttgaagatttgtgatcaggggttgaaaatgagcagaattgt

SEQ ID NO: 126766 - DNA, 1782 bp, Homo sapiens
aatgtaagtctgtatctatgggacttggaatgggagttgtggtagtgagtgccattagacaaaaatgaccagacttggaattcttactcattgcaatttctataattaaaagtaaatctttctttggttatttctgtcgccttcaaatgcagttattcatcgtttaatgatggggatatgttctgagaaatgtgtctttaggtgattcatctttgtgtaaacatcatagagtgtatttacacaaacctagatgatgtagcctactacacacctaggctatatggtatatcctattgatgttgctgtattgaatattgtaggcagttgtaacacagtggtacttgtctacttaaatatatctaaacatagagcaggtgacatattatgctaaggtcactgtggctgtgacatcgtaggcaataggaaattctcagctccattataatcttatgggaccactgttactaattaaaacatcattatgtggcacatgactatggtgtgtttttagaagtgctttatataggtttagagcttatctgctggaaactatgcctgaccagttcactctgccattagtggaagctagatgaaactaatttgtatttgcctgtttctcataggcactcaaagactgtaaaattggatatgcattgtaaatttaaatcactttgataacaatctgtgtaggttgagagcttatgcattatttttagtttgaaattggaggtaatattaaatataaacttaaattttatgtatataaaatttctgtactcccaaagaacaaacggatataagaatgttgtcaagtacctttactttggtttttggggtctattgctattaaattactttgttttgaaaagatgacatgtcttgtggaaatttttaatactcaaattagtttcatgttattatttttctagctatttaacaatttattttctaaggcacatctttcccttatttagaagaacagcagaagatctgtgtcccaatagaagttgttctttctttttgccaaaactaattcaaagtagcaacacctttttcatagtctttgaatatatttaatatggggattctaagagattctagatgttgcatgtgttgaactcatgggtcttgtcactggtttaagttcggtcttgtttctatgacaagaacagtgttgtgctttctagaagatatcatctaagcctgtgtcttccaatgtgactttagccttgtggtgacattatttagggattgagatttgtgggacacaggcagttaagcaaagagagaggagtctaaaattataaataagttctgttttacaatgagaaatttaatttattcagccttaagttatgttcacatatttagatattctttgatttcaagagaagtaagggcttagtgataatagctattctaattgatggatttactcatagtggtaatatttaatgatacaattgctcagtattttgaactctaatgcttttgatcctaacaacttttgaggctaaaggatagtatcttactctgttttgtactgctgtaaagaatactacagattatatagtttataaagaacagaaatgtagtatctcacagttctggaggcaagaaagtccaagaacaagttgttgccattcaatgtgggccttcgtgctgcatccttacgtggtggaaggtagaagggtaagagagatgaactctgtgttcctttgtgggataagagcagaagtgagagaacccactcctgcaaaccctttttatagcagcattgct

SEQ ID NO: 126767 - DNA, 1070 bp, Homo sapiens
gctgatactatgcctagaagattttaaaaatttatttctttgttcattcttttctcagacatttattgcaggaccttgacagtcaagagtttaatgttcatggttttgactattaaccagctgcaaagtccatgatgcagcagttcataatttttcaggcaaaattttgaatagctagtgagtgcacatagaactgcccaacacttttaatgtggcttggtggttttcttcttttcactgggtacccacttatttttctgaagtggatatatgtagtggcatttgtactttgtaggctcagaagtctttaattatatccatttcagatatcaagagtctgcttactcttgctattgtgctttgaaagcagttatgccaaaatagtatcagagaaatgtacattacatgttctttctgaattttcctgtctttgattttttgattatatagtcatgctatgctgtaatgcttattccatattttttgttaatcaaggaaatccttcacaaataatgcttcaacagcattgcaattgtatactgctgaaatataggttttgcttaggaaaatcattgggaatatctctaacttgtgatttagtaggcttggaaaatgtcatataaaaagttgaacttttaagctgggtgtggtggctggtacctggaggcccagttacttgggaggtggaggcaggcagaattgcttgaggccaggagtttgagaccagcctgggtgaacagaacagatctcctcttggctctaaaaagtaaaaattgagaagtaaaggaaattaaaacaaaataaaagttgagcatcatagcatgtgcctgcagtctcaactacttgggaaactgagatgggaggatcactcgagcccacaagttagaggctgcagtgagctgttattgcaccactgttctccaccctgggtgacagagcaagatcttgactctttaaaaaaaaaaaaaagttaactttaaacaatgaataatgcttgtgtgttgttttcacagtattatctaaacatagaagggtaaaaatccaagtatcagccactgttttgctctatc

SEQ ID NO: 126768 - DNA, 1077 bp, Homo sapiens
tcaattaacactttaatgcaccaggcgtggaccatcaggaaatgtcctctccctggcactggctgccaatttatcagttttagagaggcaatgtgataacttccaaatcatcaaccgacgttcctagtgggtggggcagtagccctctcctgccccactcttgactgtctaactacctgcaacaataacagtgattgtttttgttaagtgcatagttgggacagagatacgagggtgacttttcaatgttatttctttttatttcttgaattttgaatcatgtgcttgtattatctattcagaaaacggataatatttaattaaaagataaagatgccccaattgtcaatttccatgggaaaaattttcctttggcattcctttttttttttttttatttaagtatttcagattagtttctctgaaaagcagtcaggtaaacatgtttaatacttgattggctttgacttacatgtgtttgtaaatatatgtttgttttatgtttgagtatggtgtatgcatacatacggtgtattgcttgtgagtgcatgggtgtggctgtgtgtggctctggtgtatgtatttatttcacccataaaagaatgtttatacctggaggttcagggaccctggcttctcagagcttttaattcttattgccaccatgtagaatttttctccttaaacaggggagatgtccttgcttctcagttagccttggggccattcaaaaatggttgtgatgcagcagtatggaatgtctctctttcctttgtaatcactactgaggctgaagatcactacatgttggttattcagtatgtcaccctctaccacactctccctcatgcaactgctgtgaatccagcttctgtaataaagtgtcctaaaatacatgaacctttatttcttatctcagccttttgatagctaaagacctagtattagatctgggaaaaggaataggaagtgtgtgaaatagttttgttgtttatgtgctttctcttttataatttattagtgattaaaaatcaccacgcatggtggctcacacctgtaatcctagcactttgggag

SEQ ID NO: 126769 - DNA, 1060 bp, Homo sapiens
tcatacatctcttaaaatataccaccctctaatgtttaatcttgccaaaaatactaaacttaaatctgatgaagctgcccgcatccaactactaatttacaggtaatatagaagatagaggaacttgttaaactgcatcaagggaatacagtcaacaaaacccagtctgtgggaaactttaggacagatgatccaatatattcaacaaattgcaatgaaaaaaagagaaggtgagagaacagattaaaaacaagaaaaattaaaccatagcacttaggtatttgtacttcagtaataaaaaaaaaaagtaaggaagtgattaatgtaaaagagtagtggtttctcttggttggcatgaagggtaatggcattgggagggagtaaatgagggcttctgtggtggctcacatgatcctgtctcctgatctgtgtgttgcttctaagttcctttagctgtgtatctctgagtgtggttttccatgcttgtgttatatttaatagtaaaagtctaagataaaaaaacagggagggaaaggaaattgattggaggggaggcagctatattgggaaatggtgagaactgatgccttatagatcaacttataatagcttagacttattaactaaggattttattaaatggtattcccagaagattcaacataatctgtaagtagagagccattaaagtttactaaaaagggggttggagtgctgaaaactgtgtttttttttttttttttttttttttgagatggagtttcgctcttgttgcccaggctggagtgcaatatcacaatctcggctcatcgcaacctccgcctcccgggttcaagcgattcttctgcctcagcctcccaagtagttgggattacaggcatatgccaccacacccagctaattttgtatttttagtagaaatggggtttctccatgttggtcaggctggtctcgaactctcgacctaaggtgatccgcccgccttggcctcccaaagtgatgggattacaggcataagccactgcgtccggcccaaaaactgcatttttaagaagataaa

SEQ ID NO: 126770 - DNA, 1010 bp, Homo sapiens
caaatgaatatttatgtgatattttaatgctggcatttccttgctatgtctatggaaaagtcccagaaatgaacaaacctagttctgtgaatgtggtcttgaaatgctgttttctgcctgggtgcagtggtccattcctataatcccagcactttgggaggccaaggcaggtggatcacatgaggtcaggagttcgagatcagcctggccaacatggtgaaaccccatctctactaaaaatactaaaattagtcaggcatggtggcagacacatgtaatcccagctactcaggtggctgaggcaggagaatcgcttgaaccctggagggggaggttgcagtaagccaaggttgtgccattgtactctagcctgggcgacaaaagcgaaaccgtctcaaaaaaagaaaaaaagtaatgctgttttctactaaaagaaaccagggcttctttgagaaatctttgattccaggtctggggcatgaaatgtataaaatgatcctggaacatttttataccagataccaaggaggctatcaacgactgctcggttcatgacaaaggaactcaggaactgacttgaataggctttgggtgaccagctattttagttttactactgaaagtcctaaaacttgggaaacttctcagtctcaggcaaagtggtacagttaatcactctcagaggcttctgctggccgaaatggaacactttgagcatcaataaggataagagccatgatgggttgggcatcccttattatgtttaaatcaatttcataatgatatcaaaaaaaaaaaaaagcaaaaccccagaacacccacctcccccccgccctcaccgactaatttttcattattggtgaatattaggaaattatttcttcattttgaaaactaataagggaaagattaagtatttatttttagttttcagtatgaacaatactcctaggtaaacaaatagtcaatgaggtaaagtttatttttatagagaaatttcatatgcttat

SEQ ID NO: 126771 - DNA, 1047 bp, Homo sapiens
ttgtaagcctagagagttgtagactaagctgtggactatagttttaatataggagtgatggggcaaaggggatatcatggaggatcagtcatacttttttggtaatgtgttaaaatatacataacataaaatttattgtttttagcattttaaaacatacaattcagtggcattaagtacatttacagtgttgtgcaaccatcctcagtatctaggtccataacttttccatcaccccagatggaaaccccatatccattaagcagtcagttcccattccctgtcaggcttcttttgtgaggcaaagattggagggggagaccagttacaggcttttacagcagtgtgggtaaaagatactggttgcttggattaggatggtgacaaaaaaagttaaaattatatatgcatgtattttcttttaatttaactatttacccagttggatgccctgtaaatttgtaaagccaatgtaaacttatgttttcctaggtgttcttcagatgatgcagacgagaattggggctttacagggagctgttgataggtactgttcttaattttataaataaatggaatgggaatgtttttatccattgatattctgaaaatgattttattctcactcctctcttttcctgtaggataaaagcaaaaattgttgaaccatacaataagatagttgcccggactgcacaactagcaagacttcaggtagtttcttacttttatttctttatactttattattcattttgttttcataagtggacaaaatttaagagtatgagtttggaagaagtaagagaatgggaacagaaggtaagagaaaaggagaaaaaaatactaaaaagccttaagatgtctagctcaaaaaatacaaatctaaagcaaattcttttcactgtcattgcagtgtataattgtttattaacttatatcttcttcaatttctttcatcaatgttttatagctttcaatgtatagatgcttcacctccttggttaaatttatttctaactttttttttttgtagctattgtaaat

SEQ ID NO: 126772 - DNA, 1114 bp, Homo sapiens
taaagtcttgctctgtcacccaggctggattgcaatggcacgatctcggctcactgcagcctgtgcctcccgggttcaagctattcttccacttcagcctcccgagtagctgggattacaggcacccgccatgatgcccagctaatttttgtatttttgtagagatggggtttgaggtttcaccatgttggccaggctggtcttgaacacctgacctcaggtgatccacccacctcggcctcccaaagtgctgggattacaggcatgagccagtgtgcctggccagtcgttatgttttttaatctctttctcaatgttatacttcctttagggtcatgataaaagtaagcattaagcagtatagtggagtggttcagagtatgggatcaaaatatgttaattatgattataattgttctgttgtttaataactggtttagtacagggtaattaaggacttttccttattttttccccaatccagggtgttatagtgactttttaaacgaagactttgatgtaaagacttatacttctcaatctattcatcaagctgtaattgctgaacaactagcaaaacttgcccaaggaatcagtcagttggacagagaactacacttacaggtaattctgatcttctgggtccctatggattattcagcctaaagtgataatttagcatttttgtaatcttattaaatacaaatgcatatttacatgaagaagtacatacttaccagtgtgacttatttttcaaagtaaatttttgaaattttctgtaaaccactttttgtttgtggaaaaactaatataccacctcaccaaagcctttcattcatacttcctgttcaccaccttaactgatgtgcaacgaatatagtgggcaaaaaataggatgtgttcgataaagataatagaaaatggaattttggaagtaaaacaatatgaataagaaaaattgggatgttacattcgcaattcatactttattagcacaaagtgtagcatttgctgaaattacagaaagttgataaatgttattgtgagtaggatacaatatgagatgttaggcgacgggtcctaatttcagctatgctgttgttaactgacttta

SEQ ID NO: 126773 - DNA, 1028 bp, Homo sapiens
aagttagtgtaaaactaaatttcctgtatcagttgcttaatccagaaatttgggaatccttgtttgttctacctaatcacccattttcagcttgtcactaagtcctacatcctgtgcagtgtgaatatttgtcaaatttgtcactttgacattcttagtgccacttattcaggtcttagtcgggccttcattatgtcttaggctgttaacatagtactttactggcctctgtggttctatttcttgggtgtattggttaattggctttgtgggaaaatagaaaaagccctgatttttgtagtgtttgctgattaccatggtgtaaatactctcaccatcgtagattttaagatatctgtgtgaaaggtcaactggctcacagaattcctgaaaatgtaacagtctgtgctcaagagccaataagaggcaacttcagcacattgctgtgtgactaatcctttttccatcatcctctatacagctgccaggattattgttctgtaacataaagctgatagtgcaatttcttgggttaaatgagatatggttaaacatttcaaatgtcttacaaacctcttttcaaactgcgctccaacctttggaaccacatctgtcattctttaccatttctgtccaatatacatgtgctatgatttagacacactgaaatcagtattccccttgtttctcaaaatatgccatggcatttgccactgctaaaccttccctttgcttggaatggcttttttcatttgtctggctgacaggactcttaattctgagaagcacttggcaaatcagaaggaaatgtggttctcagacttaaaagcagccaaagtagcagtttccttctttcattccactacattttaagaataatcaagagtatgagcctttactttttgttgttggttgttaccagaatgatactaatgatacatcagctgatgtatagattagttaattcatggaacctgccatgtgtctggtattgttcagacactggagaagagttagcaaacaaaaca

SEQ ID NO: 126774 - DNA, 1031 bp, Homo sapiens
gtgatctgcctgccttggcctcccagagtgctgggattacaggcgtgagccaccacgcccggccgagtctctgctccgttctaaggatagtgcctcctactttgctctggattttttcttcctgtttcctggggactcagtcaccctcaatctatgccattgaagtaactttgcaaggttttcaatgactttcttgcacatacgacaaatggacacttttttggtcctttaacttgtaataacatttgattcctttcttgaaatactttcctcatgcggtttatgggtgccgtgctttttaaaaattcttaattctctaggtgctcttttccaggttcctgtagatacttgtcagttcagtttgttctgaattaagcggtctctgttgcccctccacccccaacattcctgaggaattaagcatttccagcagaaactttgattcactatatcggggatttggccaatgacagagtatcggattgataggcttggtgagcacagatgcatagtatgaaaattggtgaggtgtttctgatatgccctctatgggaatgaggaaactataaaagagaagcattatataattcatctctttaaaggctgtcagccctcaaatgccacatcccgttgtgtttgatctttgtaagctctatgacaatactaatacttactttctttatcccttcttttggcttttgccattcttttttgtttctctttctccctgagcactctttagtctctttgattgctttcattttctctgtccaccccccactttcctatcttcctcattttcctgcctttttgtgcattctaaaacttttttttcctaaatcatctggtcttgtctgtggtttcagtatgctccttacctgtcttctgaattataaaactatatttttaactgcctactggacatttctatcttaatttttttatgatatgccattccataacctgtatggacatttctattttgatagtaaacaagcagtgctagttctataatacacatgaaaacctac

SEQ ID NO: 126775 - DNA, 1006 bp, Homo sapiens
tccgcccggccccctggcttgggtactgttctagccaacctatttactctgggactggctccctcttttctggagtcttggggacacttggtttctgtgtgttcctcatttcaactcgaccccccccccccccatgcctccagcttccctgaagtttcgggagcccaaaccctgtggaccgcgttggcagccaccggctgctgccgcagttcttgacgaaggggtgtagcgttcgagctcttcaaaagtgtaagctctagaacagacggcagacgcataatgaaatagggccttgttttaaagtagagctggaaacgcttactcctttaacaaatggactgtacaggtgacccctcttacaggctggttttttttttcctcctttatgaggcagttatctacagtgacacgtgggggagggtttgagacatttgttcaggttgggattaaccatttgtacagaatctagcagtcagattttattgctagtcagtttggagagaagttgcccaaaataagaaaagttagatataatatacttgaaaagcatattcagttgtgtcaatccagttaccatgtcccgaatctcttatccttcagaataaagttcacatttataagcataaaaataaagcccttctcacctgttcttaattttttctctagtggccatcgcattctaccttgtactaaaatcatttgtatacttgttttaatctcttctgtattgcaaactttttttaatatcccacagtgtgaatagcagtatcttgcatacagtaggtgcagaatgttttttaaattcatcatcgcagttagaagcacatgcacacatttgaagaccgaagtgggtaataaatgaaataaagttccaaattattgtttattttctctgactgttaaatattttattgtcatcctgaattacgtgccttttcatgataatttatgtacttttgtcaaaagcaatgatgttttctgaactatttcatgttggaaactctag

SEQ ID NO: 126776 - DNA, 1074 bp, Homo sapiens
gcaagacagtcttaagcttcttcgcaaaaagaagctggaagatgactttttcattttgtacagtaggtatgtatccaggaaaccaattttatccagttccagagctacgtggttttctacattctgtttcaaaaaggtgctattacttatcctgtgcttatcgctgttctaagtattttataactcaatgcatttcatactcataacacctcaggtaagcaagtcttatgctacactgcattatgctctctttgtctcagaggattttccctagtatgtaagatcttagtcatgatgggaataggggtgattcattcattacttgtgaattaggaattgtttttccttccttggctttattccccccagtggaagattttagaagagtgagtaatattcattcatacagcgaaagttttgacccctctactctgcatgctctcatgagtttacaaacataagactcaatccatattctaaaaggagttaataggtaaggtaggaacccatttaaacaaacaattgtaccaggtgctttggaatctttggatttacttattccagtaattccaagcttagctgcacattgaaatcacctgaagagctttaataaaaacactgatgcctgcatcctgagcccagacgtttggatttaattggtctagggtatggcttgggcatgctaattcttaaaagctcctcgggtcattgtagtgtacaactaaggtagaaagctactgattgttttgttttgttgagttggggtctagctctgttacccaggctggagtgcagtggcaggatcgtggctcactgcagcctcaacctcctgggctcaagggatcctcctgcccaagcttctggagtagttgggatcacagtcgcttgctaccacgcccagctgatttttataatttttttagagatgggggtctcactatattgcccaagctggtctcaaactcctggccttaagcaagcctcccaccttggcctcccaaaatgctgagtttacaggtgtgagcccagtcccctgaaacctactgatttattctttcagcaaataaatattga

SEQ ID NO: 126777 - DNA, 1047 bp, Homo sapiens
aatatactcagagcatgtgaaacagtctaaaaatacactatatggtccatccgtacagcggaatatcccactataaagaagaaaataggtctgagtacatctcccagatacatgaggaaagaaaggaacactaggcacagtggtatatatagattgttcacacttgtttaaattttacaggtatacaaaaaaattgttctggaatgcagtaaactaattctcacctttgagaagagggtctattttgtcaaaagtattagaattgttttcatttatcaaattttgtactgtttgaattttttaccgtgtaaattgcttttaattttaaatattttaaattgtttaatgttatattatttggacagatgcttcttaggctaaaaaatcgttattgctattttatcctgtacaaacattaaagtttggtgtgtgtgtgcatggggttttttcctgtgaattttaatgttgagctattcattttgtcaggtgattgcccattgattgttcagtttgctgctaacgatgcaagacttttatctgatgctgctcgtatagtctgtccttatgcgaatggaatagacattaactgtggttgccctcagaggtaaagctcaaagaagttggaagaattttccaaaagagtagaaaaaaaactgtgtgaacatggtaaaatatctttctagttttccaaaaattaaaaagaaaatagagttacagtcccagggctcaaaacaagaaggaagaaaatatagggaaatgtaatttagaaacataaattcaaaggtcttttctgatgactgaaatgatgtatagacctttgacaggtgttttgtctcccctcaccaatagaatttttatgtggctgtgccttgaatctcatccctaagtagttatatgagaatctaatgtttacggcaatccctaaaatgtatttttactgtcatgtcagatatacttgctctgaaaacagattgtttgacttaggaaatcaccacatatttcctcctaattaattccccttataaaaataccttattataatcactt

SEQ ID NO: 126778 - DNA, 1048 bp, Homo sapiens
tgatagggtgtacttaatttgacaataatatttctttttttttttttttttttgagacaagagtttcccgggttggagtgcagtggtgtggtctcggctcaccacaactaccgcctcccaggttcaagcgattctcctgcctcagcctcctgagtagctgggattacagccatgcaccaccacgccaggctaattttgtatttttagtagagacggggtttctctatgttggtcaggctggttgcaaactcccaacctcaggtgatccgcccgccttggcctcccaaagtgctgggattacaggcctgagccaccgcgcccagcctgacaataatagttctactttactggcactgtagtagattatcagtaattcaaaatgtgtccaaagaataaaagcaaagttgttaagtatagcgtaatcgaaatcagattagacatatttgtatactcattaggagggttaaattagctgtttagtggtattggaatgctgtaagccaaaaatatctttctactattgagactaataaaacctcttgttatgcacaataaacatcaaatttggaatttttaaaatctgaagtcattgcaattacttcaaatatttaaacctgttttggttgaatgacttttaacttaatattctcacttgccaatgaaaaccatttctcctgagtactttttgatctgggaacatgttttcctaatctcatattgatccacttagaaatgttgaatctatgaattttttatatctgcttctcttccagatcactagagaaatggatgcacttacatttcagtgctttcagaattttgtcttctcttccagttatttataattcacttgttcatgtgtttgctttacaaaggtgggcaatggcagaaggttatggggcttgcttaataaacaagccagagcttgttcaagacatggtgaaacaagtaagaaatcaagtggaaacccctggattttcagtttctattaaaataaggtaaagacaatatttcaatctattgataggataatccattacttaggaaa

SEQ ID NO: 126779 - DNA, 1050 bp, Homo sapiens
attcccttaaattattggcatgccaagccctataattgctagatgggagaatatagataaactgaactttaagcagcccaatttatgacaatccagatttaccctaaagaaaaactaaagactaatggtttaatgtagaaatctttaaaaaataaagatttctgtacgtacatttaaactttcctggtttacaaaaggtaccaaaattaattcttttgtaatcggattaaacatattaatgcaataaagacattacaaaaccttgtgataatactttttaaaaatatactgtttgcttcattgagcttgaactaataaccaggggttcttaatgtatggacaaatatggtgtgctttaatttgtaggtgtgatggttgcaagaggactcttagcaaacccggccatgtttgctggatatgaggaaaccccactgaaatgcatctgggactgggttgacattgctcttgaactcgggactccttacatgtgtttccatcaacatttaatgtacatgatggaaaagataacttcaaggcaggaaaaaagggtatttaatgctctgtcaagcacatcagcaatcatagattaccttacagaccattatggcatttgactagacttcccaaataattttaatatatacttttagacccacagtgaaaccacagaaggtcatattttgtaccttaaaccagtagctctcaaattttagtataaaaacaattcctgggagcgttttttaaaaatcagttgtagacaccaccctcagagattctgattaggtagatctggagtagacccagaaatacacagtttaaagaaaactcccagtggttcaaacatcctgatcatcctaggcaaacattgacaaatactgctctgaatcctgttctatagatattggggggatgggtagagtgggaattttttcctaatcatgtttttaacattttaaaataaaatttaatactaagaaattatggcttatagtatctataaattaacaagaagtatgcaggtgcaaaaaagtggtggaacaaataccaaca

SEQ ID NO: 126780 - DNA, 1022 bp, Homo sapiens
gcgggtaagggcttctgcgacccggggacccgtggggcgtaggccgcggagggagagcgccgctgcctggtctggagaaccccgcggagctggcctggcccgacccggcccggcccggtccgcggcgcggtggtcgagggcccgcggcgccttctgggagcgggagggccgggaagccgggcgttggtggagggaggcgttgggcttctgtcgccgcgaagctggcggaaaaggcagtggccagcgagccgcctcgccagttcccacgactcccagggaggtggcgacacccgcttcccgggccacccttttccccttcctgaccggggtccgtgcttgccttcccaggtgggggaaggtggaacactgtccatcccctggacaaaaacgctgcgcctcggggccttgaacccggttttgtttgaaaggaagcaagagaaaataagtgtttttccatttaggtgtgaagaaaaaaatgacactccaatgggctgcagtggcaacctttctttatgccgaaataggactcattttaatcttctgcctaccttttattcctcctcagaggtaggaaaccttcaaatcgttaactaataaatattggatcgctcttaatgtaaaatggaaaaagttttctgaacattaaaaagtttcgaaagtctttgaaaataaactcacctaacgaattaggtagtatataatgacaatattaaaataacattttatataaaactctgttacgtgtacaagtgaaataactttttcttcccttctaaaagaaaaggcgcctatacttttgattctgttgattacagatataataaagcaacgattatacttttaacacctgccctgccttgtctcaggttttacctttgttttattgccctgaattggagccatgaactaaataaatataagtggataaatcatgtttacagtacagcatgggtgtaaaagtgtttcactgaggcactggaacagcaatttagaaaccaaagccaataaattattcttagttt

SEQ ID NO: 126781 - DNA, 1092 bp, Homo sapiens
agtacttagaaccataatatagtgagaacacaataggtattagctatgataaggtgctcaactgctagttgttccctatgagagatctcttacattcccttttacaccacaccaaaccttgaagaaataagtaaatttacatttggacctagatcaaggtattaccacttatgttctcttaaaaatataaaattttatattgcataatttaaatattggctgtataaaatgcttggacttggaagcagagacaaaatgaaccgattcatctgtatgaatctccctcaacccaccaatttcaagtagttacttgaagttgtcctaatcttaaatcttaaatgtgtcctaatcttaaagtgaaactgtttttttcaagttgtaagtgcttgaagctatttaagtgcttactacatttttctgcctcctttcaactaaagtgttactcatttaaattgcccttgtacaaagtttgttacctttcctattgcgtgatggattattttgccactttgccatttataacccatgctttcttaccactgtctttgtttatactgttcaatccacctagactatttccccatctcatttcctctatgttcacatctttatctgtagtaattacatggttttatatatatatatatagtgtgtgtgtgaaaattatcaagctacatatttaagattttttcaatttatgtgtataatacctgggtagtttttataattccctcatggttaaagtagagaaacttttagttggagtatacgttaaaattgtactatataaaaatcagtatgcagagttagaccccactcctgaaatgttgccaattgttagaacaatatatctttatttctaagtcatttctctgaccatgaaaaagatacagagtagtagcttctatcaacaatataatattttactactgcaagaattcctttttaaggttttgctcatgtatggtttacttttagaatatttaagccaccagacagaggataatcaaatatcaggttattattaaatttgaaagagttgttttttaattcatgagatattctgtcatgtcagaattaataaattttaaa

SEQ ID NO: 126782 - DNA, 1023 bp, Homo sapiens
attaaaagtagacctttaggttcttgtcaaaccagaagttccatgagtcttagtaatcaccatgtttttccagttgttactgagctcagagaaattgagtgacttgtctaagattatctagctacttcttgaaatgccccttcttgcacagagtatgttttccctcagaattccctcagagttgttgtgttgttggttaaataggatttagagaggcgaacttgggaccctaaccgccatctttgacactgttttgtgagaaaatgtcttccatgttccaaaccaccaatctctcaaatagaatcctctttataaaactaagaacatctggtatgagaagggatggtattgtcaaaaacagaaaggtgtgaatgatttgtgcctcttttcaagatgtaaatatttgtctcatggtacattattaatgttatggattgaatctctagccatataactagttatgagaagtcagtaaagaacaataaggaaaaccggttccagttctgccaccagctaactaaaggacctttgaaatggcttttatttcctgggtttgatttattcatcttgtgaaataaagggagagatggaaagaatctctgcagctcctgattttatgatcttctaactctaaaattatcacaaaaatttctattgaaaactgtcacttatcatgtaagggaggggagttgtagtataagttcttttggttacattagaaacaaacttggccgggcgcggcggctcacctctgtaatctcagcacttcgaaagaccaaggcaggtggatcaacctaaggtcaggaattccagaccagcttggccaacgtggtgaaaccctgtctctaccaaaaatacaaaaattagccgggcatgggggcgcgtgcctgtaatcccagctactcaggaaactgaggcaggagaattgtttgcacccgagaggcagaggttgcagtgagccgagatcgcgccattgcactgcagcctgggtgacaagagtgaaactccgtctcaaaaaaaaag

SEQ ID NO: 126783 - DNA, 1033 bp, Homo sapiens
gtcctgtcatttcccacttacccatctccactctgacatattcttctcttacaaatttgtctgtataaaaataggctgagtagatagctctacaatcagaacataatggttttctaattaatatcatcctcagaactgtttttttcccttagatttacatttctcattaattgaggaagaaagactgacgttatttacctaaatacttttgagaatattattttaatcacagcaactagaaattcttatgttcattttacagattttgccataataggaaatcttttttgtgtgtttcccaaatattaagtttctgttagcaaaagtacattgtagaaaactataaaattctgaaaaggacaaagaataaattataaacaggtaagtttagataggttactcagcttattttctgtaagaatgtctggctattgcaatctaagcttatttcttcctgtatctccttttgcaatagattttgaaaagccatggtaaagatgaagaatgtgttttggaagcagaaaataaaaaactagtagaagaccaggagaaactgaaaactgaattaaggaagacttcagatggtaactttgtgtacatgtgaaaaagtaaaaagactagcatgatattttatgctgtacacttcactgtttttcctaaaacaaaactaatgcctaaatgttcttctaagataccgagaatgacctatttataaattcttgttcaaatatgaagataaaacattatgtcagccaagagaaacatgctctgttatacagaaaaacatgtaggtgtttcagatctgtgttgtaaatacagatgttcttgccttagcaaaagagctgtgttcctaaaaagttgtttataaatgtgtttttataaaaagaatcacatttttccatcatcgtatattcctcctctcagagaagcaattgtaggggaacagttttcttacaagaaaatatattgtttatttcaagcactaatatattctacctgttagacataaggaaagcgttccttgaaagaggtg

SEQ ID NO: 126784 - DNA, 1099 bp, Homo sapiens
ttacaactatatattcatcatcattatgaggatttcctttgcctctttcctgtattgataccctctttcctgaattccatgttttctttctttttctttttttttttttttttccgagacagattctccctttgtagtgcaggctggagtgcagtggcgcaatcttggctcactgcaacctccgccccccaggtcccggttccagcaattctgcttcagcctcccgagcagctgggattacaggcacacaccaccatgcccagctaatttttgtatttttagtagagatggggtttcaccatgttggccaggctggtcttgaactcctgacctggtggtccgcctgcctcggcctcccaaagtgctggaattgcagatgtgagccactgtgcccggcctggattccatgttttctacttttgtataggttttgaaagtcacagaggtgccagctttcatcacattgtatcaagagtacatattattaacataacttatcagttttgatgttgaccttgatcacctggctaaaatagtgcttgtctagtttctgaactgtaaagttcctcttttccctcctttttccataccgtaatctttgtgaatcactgttcacagcccacacttcagaaatggggatcagtgtgcaaatgagtggattaaaaaaaaaaaaataagaaagggaagttacgctcaacctccttgaaagcagagtatctgtgtaaattgtttggaattctacacagatttgtctgttgtctaccatttgtttgtcagtatggactcataggtatttattttataatttgggttataatttaatactactttagtttattgttcaggttgtccagctttcaccattgggagctctttcatttggctcctgtgtccctttgacacatttccattttggatatttgtttgtttgtttgtttgtttgtttgtttcatttttggagcacttccttactttctggcattacaagatactccaggcttatcttgaacatttcctgccccattcttagaatcaatgtttagggattttttttaattgggctggattctttggtactatttatttatattttattttt

SEQ ID NO: 126785 - DNA, 1029 bp, Homo sapiens
aaatatttcaagaatggtctctttgctttgttttggctatcctgagtattttggtttttgattgacggtgtttttatcaagattactatcaggtgactaaagtaacactttgtattgttcacctgacatttatcatttccaagtgaactgtttacacacaagtgaatttttcaaatgcttaaagcttacacttttcatttattcattctttcattccttcaaggagcatattttaagcacttaccaatactaggcaatatgctaggtactcagacagataagacacagctctgtttcttgagtagtccatagtctagtaagggcatagttgcccttcaattcaatacgtggtgtggtgaaacttgagttgtagtagaagccaacactggagatcgacactttcttgacattttaaaggatgacattaattagccagatgaagtaggaggagatggacaaggtgttataacaaaaatgagcagcatgtaaccaaaggagtatggcacttttgaggtactacaaggagctcaaggcaactggagtgtaaaagaagatggaaccagtggagagagttgagcagtaggcctagaagccatcctgaagggcctcatatgccctgtttgtacgttaacattttcagggcactcttagagggtttttaggcacaagagcaatcactttgacagcattatagacaatggattcaagtagacgggcaactacgtgagaaatccacttaataatctaatctggaaatgaggacagtggtcacagagctggagtggaaggtatggattggagagctataaaggaacttaacagctatcaacaaactttatcaacagatgggtgtgaggttaaaagagattaggtgttgattgaagtgatgaataaaacgtaaatctttacctacacagacctcacaatataggcatgtacaaaagaaggataatataattaaaccacagtttatgtccttactgaacagaagtttgtatgtctactttccaagtatcttggaagcattac

SEQ ID NO: 126786 - DNA, 1082 bp, Homo sapiens
atggtagggaattattccagattaaaagaaattaaagagatatgataactaaatgcaatatgtgatcttgcactgtatcctggactagcagtggagaaaatgcttaaaggacatgattaagacagttccaaaaactggcatatggatgataaattagatttaaagtattgtattcatattaagtttcctaaatttggtgactatactatggttatgttagataatattttgtttctgggaaatacattcacagaaatgtattgaagagtagaggggcacgatgcctgcaccttattctcaaatgagtcaagaaaataatagtgtgtgtgaagagagagaatatgataacaaatgtagcacaatgttaacagtggatttgagtaaagactatacaggagttctctatttaagccttgtaacttttctataaatttgaaattattctgaaataaaaataaaactattcgatattttctagccctttctaaggcacaaaatgatgtgatggaaatgaagatgcagtcagagagactttcgaaagaatatgatcaactcctgaaagaacactctgaacttcaggtgggtgtgacatgcactttatgcacctaaatgttttgaaatagtaattacctaagtaaattatttgggttatttgtccttaactaatcaagatgatgtacttaatcctggctttgttaaacgatttaaagaagccagatttttacctagagggtaaagattaggacattgcaggaaaatacaagataattttaaggaattgctgacttgcatacttacagcattccagttttggtgaatttttaagcaaaagaagccacaaaaatggcagcattggaaaacagactggttctagaaaaggtgagttttgctctttgggatgtttgccatattcatgccaaaatgaggccaaaatttcaagttccacatcacactactcttgtctcagtgttttagacatattaggacaagactttagcattcaaatttatcatttacctccaaatgttgatttgaaagatggaaatgggaaaaaaatgtttcattgttaaagccacaaagtc

SEQ ID NO: 126787 - DNA, 1018 bp, Homo sapiens
gcactccagcctgggtgacagagcgagactccatctcagaaaaaaaaaaagtgattccttcccaagaaaatagttgttataatagttgtcatacctgtttctgtggaaaagaccccatcccagattatgccagacaccatgccgagagtagggccttgtttgatagcacttcaggacttgatctaatttctgcttgtatccagtttttgaaatatttaatagatgtcatttgttgagagtatgctctggactaagcacttggctaagggcttcgtatatgttgttttgtttactctccatgacagctcaataattgaaagtattttaatatccctattttgtgaatgaggaaactgagacccagagatgttatataatttatcgaaagtaactagaaagtgatagcattcaaagtcagagaatctttctccagaacctccatcattaaccactatgttctttggcctttgctgatcattggattgtgttcttggatccattctcctctcaccactgctttactctgtatctctgggaggcccgtttccaaggctcccttgctgtctgactcagtctgggcaggtttagccagtggcaggcactagaagactgaaggcaggaggaaggggaaagccagggatttcttctactctttctgctatagaggccttctcctttatgactccagttccttccctctaggtcccactgggcagcttctacatactggccttcgcacctgggctccataaccctcatccctccagcccaagaagtggtggtggcttttctgctattgataatcccagaggtgccttaccaccctgtttggtgtgtgtactttttcatcacctgtaaaaccaatttcccataatatctctgttggaaggaaaacaaaatctcagctccatagtttaccacttctgtaacccacaggtgactcatttgacatctatgctcctcaggtactttactacttaaataaaggttgtaataccttatgaaaattaaaccagat

SEQ ID NO: 126788 - DNA, 1497 bp, Homo sapiens
gtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagtta

SEQ ID NO: 126789 - DNA, 1079 bp, Homo sapiens
gaaggaagtctttgcaggccaaaattgggacaacctgcttggacttccgcctcccggcctccggaaggcagtgcgcacgcgctcgctgcgactccggcgcggttgacttccgctcccactgtgctctgcgagccgaatcatggatcacactggtaaggaggcggaggcagtgggggtcccggttccaagcccccttggccggcctggggctggtcgcacagcaggcaaaagggattatgctcgccccacaacactagggtgtggcagtgagaagaaatctcacagatgccttcctgtgcccggcaggggcctgcggtttcctggcctaccgtctggtgtggtacctacctcctccgtgccggcaacaaccgctcctactctggttctgctgagctccgagcccggaccagtgggcgatgtaggccttcgggaagggagagccccggctctgttttatttagcccagctgctctggcctacgttatggagactggcgggtagattgcggtctccgagtcgcggaatcctctttacgctgggagtggacgggcgagaatgggttggagacttcctgctgtctcagtcagctttgggcgggtgctgcagtggtcaccccctgtcgtctctccgatcctttatggactagaggggtgaaagaagggagtctgatagagtttttggaatcaaactcggagcagtttttctacctaaaccaaaagcatgccccgcgcttcggctgaggtccttactcatcatttgagggtatttacaaagaggagtttaaaatcaaggcattctcatacttttctccaagtaagagtggctccaccctttgttatgtattttctggcttttgcttctttgtggttcttggatattgaatgagtgctcttggagttatgtgccccatacatttatagcgaccgtatcacaaatagagaaaaaaaggctttttcttgagtattgagttgtcctcactcatcagatatctacttggttatataattaggtgtgtatgtttatttatgtaggtgtgtatgtttatttatgcaagatacatgcagatatctataggtcgg

SEQ ID NO: 126790 - DNA, 1042 bp, Homo sapiens
atcagacatggagacagggatggttttcgttctttttctccttcttactctttttcttttaaaaaattctcttgtagttcaagacaatggttcttgggttcattaatggtttcatgtttctgtaaacttctctggaattatatgaaaaattttattcacttttctagggagaggtcctataacttttatcaatttcttaaaggattctgtatctcaaaaggggttaaaaagcattgccttaagtgttgatccaaaataaataaaattagcagttaaacttaatgtaatattgaaaatcagaacccagatctttaaccttgataatgttaggtatggtgttttaatacctgtggcagaataatctttaaaaagaaaaactaaaagaaattacaacttttttttcctaacacagacaatgagttacaaggcactaatagttctggatccttgggtggtcttgatgttcgcagacgaattcctataaagctcatctccaaacaagcaaacaaagcgaaacctgcaccgcgaactcaaagaactataaacaggatgcctgcaaaggctccacctggtgatgaaggtaatttgtttaactaataggtccaacactctttctgttttatctgattgcttcggacagtctgtgtgatcttatagctacctctttttgtcttacatattctattcattcttcaaccttcttgtttgacttctcattgtagcacattgtatttttattttcctttataaatattttttgatttggttccttttgttgttgaaagcaatactgcccattgttcagtaatctcaacagtattgcagaaagcataacattaaaagtaaaatccttctatccaaagataatccctgttgacttttttatacaaaagtattaattttttatgtgtagttgccattttttcatgtaatatgcatttgagatttttttcttatcagtacttacagatgtacctcattaaaaaaataggtttgggtatttatagatataccataatttatttaacagtttttccagttt

SEQ ID NO: 126791 - DNA, 1335 bp, Homo sapiens
tgttttgatgtaaatttattttaattatgaaagagtgtatattttttcatagcattgaccattcttgtttagatcctttcttctgagttctttgtaaattaatagggtttttgttatatgttatgtatgtgcgtgtgtgtatatatatttttttgtttgtttgtttgtttgtttttgtttttttgagactgagtcttactctgttgcctgggctggaatgcagtggtgggatcatggcttgatattccaggctcaagtgatctttccacctcagtctcctgaggagctgggactacaggtgcaccccacctgcctggctaattttttatatttaatttttgtagtcatggggtcttgctatgttgcccaggctggttttgaactcctggactcaacagtcctcttgccttagcctcccaaggtgctgggattacaggcgtgagccactgtgcctggcctatattgtatatattcttcatttgtcttttgaattttgtatacaaaatatttattgcagagaatctttttttttttgagacagagtcttgcgctgtcacccaggctggagtgcagtggcgggatctcggctcactgcaagctctgcctcccaggttcatgccattctcctgcctcagcctcccgagtagctgggactacaggtgcccgccaccacgcccagctaatttttgtatttttagtggagacggggtttcactgtgttagccaggatggtctcgatctcctgacctcatgatccgcccgcatcggcctcccaaagtgctgggattatagttattgcagagaatcttgaagattctatatagtcagatatccggtctttgcttttatgacttctgggttttgtgacattatttgaaaggccttcccctatttcaccagtataaaagagtttttccatcttacccttgattacaggttagcaaactatgtctgtgggccaaatgtagccctgtttttataaacaattttattggaacacagctatgctcattcatttaagtattatctatgggggctttcacactataatggtagagttgagtaattgtgattgagaccatatggtccacaaagcgtaaatatttactatttagcatttcacagaaaaagttcactgatactgctttagaacatttatggttattaaggggaaaaaaggtggggtctggcttttttttttttccctcgaaacattgtcccaactcttttccttgctgaatagggattttactgttatcatatatatgttaaagcagcagtccctaatctttttggcaccaggactggtttcgtggaagacagtttttccacagg

SEQ ID NO: 126792 - DNA, 1049 bp, Homo sapiens
taaaatcgatagaatgctttatgttttcattatgctattggcaatacaatcagtctcttagcataccatttttgtagctagactagaataaatggtgatcaatatcttaaaaatttgtgcaacaagcatgatcatcagtaaagttttacattagaaatagtttcatgaattgataagagcatttgaatgggagtcaagagatctgaggtctgttcctggctttgccacttatcttctatatgttgagttatgagtctccatacagtaatattctcaataatgaagtaaaagagttggactagatcaccaagatcacttctaactgatgttttaaagtaatcttgattgtcttattcttagaaaagctttgaaaggcatcagatgagctttttagtgaaaaggtctattttgccatgtatatgtgcttccaaaatgaaatttgagatttggaaagttaatgggcaatactttttttttctcagaaggatttgattataatgaagaagaacggtatgactgtaaagggggtgagctgtttgcaaatcagcgaagatttcctggacaccttttttgggactttcaggtataattaaaaatgaaaaattgtattataacaataaaatattttaagtattaaatacttaaaatgttttattggagtaatgcacagtacattaagaatattatgaacttataactatgattttcagcacatacaaatcatttgttaatactctattttcaagaataatttgaagtaattttcagtaaaatcaataactgttaacactaagaagaaaaactaatggtatcacaactaatggtggggaataaatggagattataccaagaggcttctatttctaattgttttaacaacttttataaaatattgaccaattcattgtgtagatacaatctttagaattgtgtaagaaggtaattttaattatatcatttcaacagataaacatcttaggtgaaaaggatgatacaccagttcatttctgtgacaagtgtggattgcctattaaaatctatgggagaat

SEQ ID NO: 126793 - DNA, 1050 bp, Homo sapiens
agtgagaccctgtctgtacaataaaataaaataattagcctgctgtggtggcacacacctgtgttcctcgctattctggaggctgaggtgggaacatcagccaggagtttgaggttacagtgagctgtgatcacaccactggactccagcctgggcaacagagcaagatctgtttcttaaaaaaaaggaaaaaaacgtgtggggaccatgggtgaaatttatagggtttacacctccagaaagtataagcaaatgcatgtgtgtacatttattgggaaaagagccatagtttttgtcatgttctcaaaaggctttgtgattgaaaaaggttattataattagtacttaataaatgttcattttaacaggtattctcaagtgtcttctaagccttatgtataggttactatatatatatattttaaaaatattataagttctaatatgcttaactgtaatatgtctttgtttacagattccatgcaagcatgttttttgctatgactgtgctattttacatgaaaaaaagggagataagatgtgtccagggtaagataagattatcattaccttttttaaataataaagttttagtgcaatgatttataagttggattaaaggttagggagtgatgtaaatcaggcaggagatgaaacatacagacatggctaatctttttctgtgagcccagcttgtgttaggtttctctttaatatagggcaaggtagccactatcagtcaactcaaattggtcaaaatgaaatctgtttgccattatagaagtattattataaacaaaaaagttactttttttaatgggacattaaagaagtattaagatatattgagagcaaagactccagaattagaattcctgggttcgaatccttgttctgctatttattagctgttttactgtcataggctattctttattgataaaatgagactgataatagtacctacctccttgaggtatttttaggattaaatgaggttttatatatatataacatatgtacacagatacatatatatagtagctggca

SEQ ID NO: 126794 - DNA, 3926 bp, Homo sapiens
ttaagaaccctaatgatgaggctgatgttacttgttgtagtccttgcaatgtcttctacttactgttttccacttagtattatttgctcaacaaacagttatcactcaataataccatactagtttgaattccatgattgtaagtaatctacccgttggtttttttcttgctgggttttttggcaaatggatgcagaaggtacaattgtttgagaaaactggataaattctaggccttgggaagaatgaggtctcttcttgaaacataccgtttgatattaggagttctgaagttgacagaaatgcctatcttaatggctaacagacaacaaagtagggaagattaaaggtttgcgtagaataactgtaacttctaattgtggacttttgctatgttttatgtaacagtcaaattttaaaaacaagcatatttttgaaaattacataattttttgtattctcttttagtaaatcacatttctttcccttctaatttagctgtagtgatcctgtgcagcgaattgagcagtgtacacgaggttctctcttcatgtgtagcattgttcaagggtgcaagagaacatatttgtctcagagagacttacaggctcatatcaaccatcgccatatgagagctggaaaacctgttacccgtgcttcacttgaaaatgttcatcctcctattgccccaccaccaactgaaatccctgagcgttttataatgccaccagacaagcaccatatgagccatattccgccaaagcagcacatcatgatgccaccacctcctttgcaacatgtgccacatgagcactataatcagccacatgaggatattcgtgctcctccagcagaattgtccatggctccacctccacctcgatcggtcagtcaggaaacctttcgtatttcaacaagaaaacacagcaatttaataaccgtccctattcaggatgactcaaattcaggtgctagagaaccaccacctcctgccccagcacctgctcaccatcatcctgaatatcagggtcaaccagtggtatcgcaccctcatcatattatgcctccacagcaacattatgcaccacccccacctcctccaccaccaataagccatccaatgccacatcctccccaggctgcaggtactcctcacttggtatatagccaagctccacctccaccaatgacctctgctccaccaccaataacccctccccctggacatattattgcccagatgccaccttatatgaatcatcctcctccaggacctcccccacctcaacatggtggtccacctgtaactgcaccccctcctcaccattataatcctaactcattaccccagttcactgaagatcaaggaactctgagccctccatttacacaaccagggggaatgagtcctggtatatggcctgcaccaagagggccaccaccacctccacgattgcagggtccgccttctcaaaccccacttcctggaccacatcatccagatcagacaagatatagaccgtattaccaatgataatagtattttgaatggaagatatgagggggaaaaaaacttatgtgtagtcaatcttttaagctttgactgttttgggaaggaagagtacctcttatcgaggtagtataaaacacatagggtcttgtttcttaaaatggttttaaatcttgaccttaagattgatttcaagtaccatactgtagtacagataagtggctcagttgagcacagctatattttaacatctctttgttcccctagtttagtaaattgacccagaggtgaccatttgtaaaaaatttgaaaaaatttttcattgttttacttcaaaagtattgttttgttaaacccaacgtttagtttttcttgtgatacattttgttaacctgtgtaaaaggattaaatttcaatatggttgtaaaaatgctatttttatgtgaatttaagtgcagccacatactgttttttaaaccatatgttttaccactaatttcccaaagttataataaaatcctgaaagtaaaaatctactagaatttgctgtaaggcagactgttaaatgatagagaattatttcacattttaggcactgaaatgttgaggtttcgaggtatagtaagtatacaatgcacttcacttggatgccttttcatttttaggcagcctcaggagcaccaaaatacattggaattctagtactaagatatatttgttcgtaatgttaaaagacattactaattatttggaaagagatggccaaaataatcaactctacaggcttcaagctggtgggggaatgctgttactcattaatgcttttttactgaatggtcggaatcacatatgcaccacacatactgatcttaagtaacattattttatagaactgtttaaatgggtttaaatggtgttctttagatgaaatgtgttctgttttgttcattgtcttaaactgaatagggctgaataggctttatgtaattcttcatttcatggtagagtttgatgctgtgtttaagtgggttcttgtttataggattttcaactacagtttgaatgccatggaggaatttgaataatatattaatgaaggacatattcttgtaatcacaaatttgcatttgctcaggtttcattgctgtgtgataggatttttcctctaacttgaaatttaaaaacttttatttcctattccttttgtcggtaaagcagtctgaatttggaacattttatcatggagtcaacagtgaagactaccagataattttgtattggagaagaggaaataacagctaaattgtggatttcagtgctttacatggtgcctttcgagtcagcttttacattataggggcttgttatagtttagctaagatgaccacttaacagtttatacagaactcatatgtataaatcaacattcttaggatattatttatatcctttgaataaatccctgtgaagtttttcctccccactaaaatggtgcataataaaacatgaaatatgtagtatgcagatatcatttattagatagtttgtagtgtatacatttagaacatacttcttttgacaaagggtgatctgattgctaatttaccattttattctgtcaggtacaggtgaaacaaattctcatcttgaatgatcagatgcaaaatcatttctgaaccctagagcagaagttagaaataacaaaatggccgtttcaaccttgactggccaaaaataactaataaacttttttgttttaagtcaggcaagtgattttctacatttagcagtttgaaagtccagtgttaatgcaatatttctagtgagaaatgcttgttattaaaagcatgggagtgatagtgtgaaatggtggtgagtgcttctatcatattactgtaggtacttggactggtgcaaacttgattccttttcatccccctgtttaggagctattaaaatattactgttaaaaatccaaaccattctttgttccatgtaataagaaaatagccaaaatcactttagagcttctcaactatttatgaagagctatcctgcttttattgaaagtcactagagttgaatgtggtaagaaaccacttagcctatgtattggacgagaaaatcagtatcatgataaaattttgaattaagagaacccttgtagagtttttaaaaaatgatttattttcaattaggtttaagaaatctatgttatgcagggaggcatatcagatgaatgttgtagcagacaaaagttttaaatcgtgttagacttgaattcatcaattgtttgaatgagggtgggtgggtagaaggataacaaaattactgttagtgtttctttccttacggaaaaagatgtgaatcccagccttatttcagggaagcctttgaagctatgatggacataagt

SEQ ID NO: 126795 - DNA, 1052 bp, Homo sapiens
cttgtggaaggatatacataaagatacatatatatgaattattgatttataaagttaaatacctattatatatgttagatgtgggtgtatgataatgaacaaaatagatggtctctgccctttaggagcttacattctgacttacttaggaattgttcttgatagtcgtctttaaattttcttcaaaaattttccttatattcaaagtattgtggccaggacataaatcttaatgtttaaaaatacattaccaaaatacatacaaaaccatgagagaaaatgtatttaattctgaacattactatttcctagcagcttttctggatataattgtacaatgctaaattagtgagtttggaacaaatctgtggaatgcacttataattattcctgagtttagtcctatcttgtaatcagtttttatttaggttttaatttcttttgagaagtgatgttttctaatatttaaaagcctgggttgtatagagttagactgtccagacagatttctggctttaccacctgtgactatctaatttagactagttacttgctctttgagtcttcatttactttgtttttttaaaaaataggggaaatcttagtactgacattattggggactcttttgacagttaaatgactatattttaaaaagagagtcagtaggatttcctggtggattttttggcttgatcagcttaagaaaaatggagttgtcattaactgaggtagaaaaaatgctggtagagcagattaggggaagatcagcagatcagccttgacatgttgaaatccagaggaagatgctagaaacatgaattaaatatccctcttttatattcttgttcatgcagtgtagggtcagccatttaaaaaatttcatttacatttctaagtggtaagttcctgtgtttagacaaaaatatgtatcaagtgcttaaataacttacaaaataattttaaagatacactgctcaacatgtattactttcacactttatgaatttctgtaatgtatttgtctcttcacaagttgttctgtctcccag

SEQ ID NO: 126796 - DNA, 1065 bp, Homo sapiens
ccaaaggttttggcctcagggccgcagttatctctcctttgtgagaccttgggggcactgtttaacctctctgggtctcatccaagaaatggaaatactaataatactccatatggttgttgcaaggatgaaatgagatgtctgtaggaagtgccgaggaatgcctagcacaaccaagagcttgttgaacttgtcacgctttactgtcgataatgtgcattaagcaaacgctagttttatttgtttatttcatcttctaagtataagaatacattgtagctcgacattttggcaccagcccctaaagcattcccaccaccacccccgctgcgacaaagccctgcgctccttacgacagcgtacgacgccgagcctgacaggaacgcctcgtgcggtagaaccgcgcgggccaatcgcgctgctcccgggtgatgacgtaggctgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaaggtgagggccgagtaggtgaggtcgtgttgagccagaggcacggaaggtcccgctcagtgggtccggtacgcggcttaaccgtgttgggctggcggaggcgggcgcctgggccgcaccacccctggccccgcctctgcactggctcagcccggccctgggctccgaggtggccgctcatcctgcagcaggcgagggacggggctgggcccaggctgtggcgagtcctttcgggttgtgtgacggccggcggtcacacatgccacacccccaagcctgggccgagggccatcccggtcacacataggcctctaccttggaggaagtgtaagccacccatgtcccgtatagtctggctttttataccatttgcctttttctcatcctaattctgatccctgagtggcctaagtttatgcagtgggcaggtaaccctggggtcacttcttgaatggtttagatccagtcagctccaacagatagccctcg

SEQ ID NO: 126797 - DNA, 1066 bp, Homo sapiens
cacccggctaattttcttgtatttttagtagagtcggggcttcactatgttggccaggctggtctcgaactcctgacctcaggtgatccgcccacctcagcctcccaaagtgttggcattacaggcgtgagccaccacggccggctcagagctttatgacattaaaatgatccctggcactaataattagccatgttttctgaaaattgaataaaaataccattgaatacgtttttaaaattaagttaaatatgagatgatttgttgactattgataataaaaagatgggtgtggcaagctgaggctgaaaaatttaaatgattagttattgtcaaagaggggatattgatctgtagcttctgtgtggcaatggaagaagatacactaataatcctcgcttgatacgtttgcccaaaattgttctgttatcatcaaccttcagtagttctatgttttgaattcatatcttacataatagggacattttctttttctagagaggccatttcaatcgaatatctcatggcctacagggactttctgcagtgcctctgagaacttacgcagatcagccgagtaagtacttaagtaaaacatttttttcatcacattagctgacagttcctttctatttcaatgtaaaagcaagtgaatattggaataacttatgttaagtgtcttatagttcatttgttcatgtatttattcgtttgaatgtatattgagctagtgtgttccaggcggtgaacaaggtaaaaaaaccctgctcttatgaaacttgtaatttggtgataaaagacaaacaatatataagtaatggataaatattttgggaagtaactgaaaattaaagcaggtaatagggaggaagagagataattttagatacagtgtcaggaaaggcctttctgaggagatgatgtctgggcagggtcctgagtgaagtgggggagtgaggttacttcaggcagagggaaacaacactgagaaaggcctgaggtgggacttagcttgtgaagtttaaggagtaataagaaggctggtatgactggagcagaaacccat

SEQ ID NO: 126798 - DNA, 1659 bp, Homo sapiens
tatttaattctaacatcaatcattgaaggcagtgttttcatccccatattacagaaaggttaagtcattgggtcaagttcatacaactactcattggccgtgctgagatatgaagcccagaatgtcagattccaaagctcaggctctttgcttcatacatacttgtcttccagtatcactaaattccgtcagttattaaatcaatagaatttaggaaggtcagtgaatacaatgtgagtgttacagaactcagttgtgtttctgtatgttgtaatgaatagaaaataatagaaaatgaaatttgagtatttatgccatttttcagtagcatcaaagagcatcaagtagtagtaataaaatagtgcagaaactatgtagaaaatgctgatttgtactgtaagaggtttaagtatcgggttatttgtttgctcttccaaagagctctttttggtaaatattaagcaatttactattttatatcaatttgcttttatcgtagttgatgctgatgtaacagttataggttctggtcctggaggatatgttgctgctattaaagctgcccagttaggcttcaaggtaaggtttgaactcaaactaagtattgatttattttaatttgggaagggttgatcatatttataaagtactttgcaggcaaaaacatggtaaatacttccttaactctataaattacttgtaagcctgagactaataaagattaggttcatttggttgtagtattctcttggaatggaaagtgaaatctattagttttcttctcttcccagtacttttcattttggcatctaatcacactttggaagatacagtgatagaactaaaagcatatatttggtaatgttaagcacacaaaaatatcttttagaataattcacttttgggtcagcccaaaagtgtttattattattcaaatgataaattataaaggactatatattttagtctgtgaaaacatagcccgaatagcttgttttgtagaagaattaagacatatatttggaattttagtgatctgaaacattgaggttatgtgcagttaaataatgttttctttggttgtagacagtctgcattgagaaaaatgaaacacttggtggaacatgcttgaatgttggttgtattccttctaaggtgagcatgtgttttgtacagcacagagattgtttttggctagcaaccaactagaaggatggattgagactagattagacaaatacacttgttaaaaaacaatccaagttgtggcacatttcacacagagaaaaaaaagaatgataaaaaacacacttctcttttgtaaaacttaaagagtgctgtcactagtctgccacacattcctgaaataacttccttgtctcagaatgcctagctttccattcaaacagactctgatgttctagttttttctctttatctttccttcaccagtgtaacagataatagatagtaaattgttcttttaggtcctttttgtatgtaaacatgactgcctttttcacctgccaccctgaagtgtgtacttatgcctttacttttaaagaaagtaaaaatgtctttttcattcttgtttgttgaatgtttttcacatcattattgtttgtctttgattaataagagaaactgaattggtgtagt

SEQ ID NO: 126799 - DNA, 1053 bp, Homo sapiens
aaataaatgacttagtatttttagtgattctactgagatcacagtttataaatacatttatctcttcatatccttggaggattggttccaggaccccccttggataccaaaacccacagatgctcaagtgccttacataaaatgacatagtatttgcatataatctgcatacttcctcctgtatactttaagtcatctctggattacttataatacctaatacactgtaaatgctatgcaagtagttcctatgctgtattgtttagggaataatgacaaaaaaaccatgtgtacatgttcagtacagatgcaaccatcaatttttttcctgaatattttcaattaatggttggttaaatctgcaaatttggaacccatggatatggagggtcgactgtactaggttttttcaaattattttgattatatcttttgtttttcttacagatagatgaagatacaatagtgtcatctacaggtgctttatctttaaaaaaagttccagaaaagatggttgttattggtgcaggagtaataggtgtagaattggtaagtgttgtctttctgcctcttattacctccttggagttggaagggacttaaaggtcccctttttgattttttgtataacattacaggctgatcagcattgagttttgcttaaacacttctagtaataaagagtttacttttgtttttttcaagacaacctatttatgtatttactcatttagaatgttctcctttattttagtctgtttccttgtaccttccacccttccatttcctagaactggtcgaattcttttttaatatgacagccattcagatatttgaggacagcttttatcctgggcaaattgcattccaaataaagattattctctttaccatcacatacatgatttggctcttcccttctctatcctcatcttgatgcctcttaacttaggttttagaaatgtcaaactacttgcatttctttgaacaccatgttattttagaccttctgtctgccttgttctcccttcttgtccatctggcagctttcca

SEQ ID NO: 126800 - DNA, 4313 bp, Homo sapiens
ttgaaatttatgattaggttaatgctagaaagagaatccaatattctcattgttgtgccttcttatagtacattcagaaaaatttaaattcccaataataagtaaaattgaatcaatatttttaggcagatacatggggaaatcaataataaaagattgcttactatatgtctggtactctactgattaaatactttaatggcatttaacttattgaattagtttttaaataaatatttaaattaaatagttaatagtatttaaatagtttaatgacttttactcaaagataagaagctgaattcattgactaattaatgactaacttgtcacacagctagtgggtggcagtcagtagttgaatttggatttctgtgactcaaagacctgtattcttaactgctgttttattatactgtggtttttgtgagattttaataacagacctctagattttaatgatagatctctttcattgtctgactcttatgtttatattcaaataaacttatattgttaaaaatgtcatcagtgccggctgggcatggtggctcacacctgtaatcccagcattttgggaggctgagatgggcagatcatgaagtcaagagatcaagaccagcctggcaacatggtgaaaccccgtctctactaaaaatacaaaaattagctgggcgtggtggcgcgtgcctgtagtcccagctactagggaggctgaggcaggagaatctctggaacctgggaggtggaggttgcagtgagccgagattgcaccactgtactccagtctggcgacagagcaagactctgtctcaaaaacaaaacaaaacaaaaatgaaaatgtcatcaacacttgagaaattgctggccttaaatttctaagcctatcaatttatgtaggtgtgtatttaacatttatacactgtttgttatctagtattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaagtaagttggataattgtctgcattttcagtaattttaaaattgatttcaaacagtattttgaaaagtaagatttttatgcttaaaatatgtattggctttggggaagaatagtaaacttacaaaatgtaaaataaaaaataactgaattttactcaaagataagctgaattcatagatttttgaagagctgcatttgatgtattttttggtgacttgtttactggaaacttttgttaccataatgtaactgaaggtaagtagctgtgatttcagaaattcattgtgtttcttttgatttctgtggtagtatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagaggtaagtctgaacatgggtggttttaagccaatgtgtgagttgtgccaatgacattggtggttgagaaacagcattttatcattatgctaatatatttaacagctgtgaaatattgtttagcttatatatttttcccttgttagcattataaagagatcattcacagatttatcagcagtaattgagaggaagagaagttgcctatattaaaaaactagtaattccagatcttttatatttggctttgaaatataaccagatggacagacatttgtatttgcttgtattcgtgcctgagatatagttcattaaccagtcttctggtctttcctttccttctatgtgctttgcgaacaattcccttcttgggatttattttctgaacaaatggtagatgattttacaaattggaaagaacttttctggcagttacgtagattctttttttctgactgtcacagggtattgagtacaaagttgggaaattcccatttgctgctaacagcagagctaagacaaatgctgacacagatggcatggtgaagatccttgggcagaaatcgacagacagagtactgggagcacatattcttggaccagtgagtattgtaaaaccagagaaatcccattaagatttctagaaagcattgctgtttattaattataaaccacctggtgttagtctgaggttgctcatttccagcaaaactttgaatatggctctctgtgcatcatttctagaaggataccagcagcactctcacagtcttgcccactgtatcatctactttgtcctgcagccaagattctctctttaaaacatacaccagattatgccccttaaaatcctccagtggtgcttttcaacttcagattgttacatccaaggcctcactgaatctgtttgtgcctacttctctgacctcttctttttctgctctcttttactcattaatgccatgtcacatgggccttctctcattttcacaacagaccaaatatttgcattttagggcctttgtgcttaagataccctctgcttagactgttctgcctccagatctttgaatggctggctccttattattcaggtctcagctcaaatgttacctcctaagggaagcctttcctaccactgagcctaaagtatgtatctttcttgtagatatctcttgtatctgatgtaacaataatgagaatagaatatttgagtgctgtgtcactttagtatacattttgttatttttacatcagctttttgaaataggtgctgttatttttgaggtgaagaaactgaatgaagcacaaagaaccaatgaatggttaaggtagtaagtggtagatatgaattgaaggccctttggctccagagcccaagctcttctgtgtcaccttttctattaagcttttcctgacttttcttcaactgataaagaaacagatttaaggcgtttttaagatctaaaagcttcccctcaacaattgctatcctattagcatgtagtttttgccttggaagcaaatttacttggcttgttattttaaagggtgctggagaaatggtaaatgaagctgctcttgctttggaatatggagcatcctgtgaagatatagctagagtctgtcatgcacatccggtaattattaacaacatatagaattgatggttgcctaaattttcttctgacccacaaatatttggattttaattttaaatttcttcccttgcagaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatgtgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaacggtctctcacttgttttatttaacctctaaattctttcattttaggggtagcatttgtgttgaagaggttttaaagcttccattgttgtctgcaactctgaagggtaattatatagttacccaaattaagagagtctatttacggaactcaaatacgtgggcattcaaatgtattacagtggggaatgaagatactgaaataaacgtcttaaatattcatttactggttatcatgagtacgtgttgagatggtcatagttttttttatgactacttctagtgtatattctaatttcttttctaggcctgaatgtatctttattttcatgttataggacaatattaaggcattttaaaggtcatcatcctttcatctattttagatacacctactaaatgtttaatatatacttttggagaagt

SEQ ID NO: 126801 - DNA, 1514 bp, Homo sapiens
tggctatttgaacagtttctaaaaagaatcatttgcattccaaccccacaccccatttctcttctcctcactcacttcttgcatatgctacaatctcacctttccttcctgtatcttttgtttaatctttttcctctgatttccttataagcaagtcttcacaaatcctaatttagtcaagatccaaagagcctccacttcttcaatatgggcttctctaatgtctaatctacttttgaaaaatctgcgcttctctatgtaatttgcaatacaattatgctacaacttttctatagaaaagtaataatcaggagaatgaggacttagccctaaggatttgctgcaactccagaattttttgaaatgttctttaaaatcatgtcaattttgcattcaattccactgtttgaagataaaattttaaattacttaccagtgaatatccttggtggcccttaatccagaatgcatgccatgattacactattgctcttaaatgtaattactgacactaacattaccacttctttctgtctaaatgtggaactatagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaaggtgggtcttttcacacaggcttattttttaaattactttaaggcatccatagtttatttaaaagtgaaaaatatattcactttgtcttgagatcatcatagtataaattgctcagactttatatatatatatctccccacagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaacaaggtaaaacaactacattttaaaaactgacttaatgctcttcaaaataaaacatcacctatttaatgtttttaatcacattttgtatggagttaaataaagtacagtgcttttgtatatattttggtgtacttgttactttcactgattgttgatgaatcccttttttcactgtaaacgtggatttataaacaagtttactgcgtccatgaagaccctaatttatgttgtctataaacaagctattatatttatttgacaggtaaacatcctccaaaactccacacccttgactcccctcctcccaatcacctcccagtgggattcccaggttgaggttaaggaggacaaatatagtctatgctaccatcactatttcaatggttgctgagttgctccagccatcaaaactcctgtaagtaagtattccttgctctaggaatgagaaaaagcaacattttagaaaatcagcaggatgtactagggtttgta

SEQ ID NO: 126802 - DNA, 1009 bp, Homo sapiens
gtttgcaggtgtccttaaaatgctttctcaacacatcatgctccttggggaggtggggttttttgtttttttttactgtcagaaaaaattttacatcaatctcagcttagatcatcagaagtactgaaagaatgaagtgaatatatgaaatgtagcaaagactaaagttagatacttcatgtaacttttcctgaaatattctttttagtaattacttcttttggtctagagcaaaatggcacagcagacttttaaatcttcctccaaacttgtactcatagtaattccatttcttaaactaatgtcttgctggaaaattgacatgcttttagattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaaggtacgtaaatctttgtaatttcagagctatgttgttaaaggagccaccagtctcctccttgcctgccttagagtaagggacatggacctaacagaaacagaattcatcagaaatatcaaatgacctgttttgcaacagccgtctttagaagtgtggatgggaaagaatatggaaatatctaataagtatgacctatgtcctcaaatccaaatttggacaagagtttagaagaacggaattaacttaggggtagaagtctcaaaacaggctttttttttttttttaaaccaactatattgacaaaaaccagtcatattgaacttttatttctgtgcggtagtcagttaaattcttcatggcatatagtaattatcaggccatttgagaatattttacaagcaggttggaacagagaacaggtagtaggaaaccaaatcttatctctttgagactcattttgaattaactacccctcacctctcattcgaaggcactatatt

SEQ ID NO: 126803 - DNA, 1065 bp, Homo sapiens
gcactttgcttcacagtatatactactttttcaatatattctgcctccccggagttttgggcagctttccgcttaagttcttccacattcctctctaactcgctgatgcgctgggacgcgttgaacaaggtttcctcagaagctgctgtttcagactcaatctaaaagcatgtcaattttccagcaagacattagtttaagaaatggaattactatgagtacaagtttggaggaagatttaaaagtctgctgtgccattttgctctagaccaaaagaagtaattactaaaaagaatatttcaggaaaagttacatgaagtatctaactttagtctttgctacatttcatatattcacttcattctttcagtacttctgatgatctaagctgagattgatgtaaaattttttctgacagtaaaaaaaaacaaaaaaccccacctccccaaggagcatgatgtgttgagaaagcattttaaggacacctgcaaactttggctaaagaacattcacaaataagcagctgtgcgaagagggatttccacataaatttccaacttaatgtgagtgggaaaataaatgttaaactctagtagtggagatttcagctaattactgaagacatggagactagggatgttctttgaatttctatagaattgtgagatgatgtatggtctgggaacgttacagctgtaaactctaaatacacaaagttatttagggaaaaaaaaatatctgggcaactggtgaggatccacatctgatctcctttcaaagtagaatcaataaacattgacttttaaaagctagccaaagtaagcagttgagcccatgacaaaagaatcaatttcactgagcactcaatttttctttaaaatgatcttcaaggatgggtctaattacatagaattaactgaataacagtactgctataatgaagttaataagggtcagtataagacataggctaaaatttgtaaatatttcaaacctaaggaccctttaattagaataaaattcttagaaattataattcttagaagataaagtttgagtgaattg

SEQ ID NO: 126804 - DNA, 1876 bp, Homo sapiens
gttcaagtgttaccagtaaagatggttttggctgcaaattacagaaaactctcaagtgaaagggacttaatcaaaaaggatgtttattatctcacatcttaataagatatccagtagcaggatagcttcctgggtctgcgacccacatacttttcatctttctactctaccatcttaagcatatcagctttgtcctctagctcctcatggttacaaggtagctgccaaagttccagacatcatataaagattaataatggaagaagagaccacctattccttgcatctttttaaaaaggaggaagtcttccctagaagcctttaagcagtcatccttataaacctcactggccagcaataagtcacatgccaatgcataaatgtcactggaaaatggaaatgcgattacagtaattcacaaactaatatttaatgctgggttgataattttacctgacttagaggcaggtacctgaaaaaaaatcagtattctgttagcaagaaaaaaggcatggctaataaggagtcaacagtatttgctaaggatatcttaggtaatattttatggaagccatcattcaagtacatattttatttgaataaatcctctggggtccatttttatgttcaatagtttaaaacataagcaaagcttgaaagtaaatgaggatctgacgtatttgaagcttaacttcataaactttttttttcaccatcttccacattttacatttgaaactccttggctttgttgacaacccattattccggttctcctgcttctataattttctccctttctataatttcctgaatctagatcatttgtaggaaatatcaaatctccatatctgcattcacaagtttctgagctattcgtccaacctcaattaaaagatttcattgcctttaagtctcagctttaagctctggccctctatggttttccacaatgttcagattcactctgctatactttcccgtaacatactctgccgttcctgtctccccatctggaattgtcctttcttctttcaaattctattatcccttaaaatctgatcagctcctcatcttccacgaaggtttccctcactacccagcctaaaacaaattctagtagtactcaattgtctgcagttacttttttgtgtgtgtaggtctcatctcccctcaaaatcccagatagattataaactcttaaacaggaagttagtgtctcttggtgtgtaaccccaccatgctagtccatagtagatgaccagtaagtggttgaatgaatgaaccatctattcttttcacctctttttggggacatctttgcttttcacagaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaaggtatctaaagacatggcatctaaggggcttattttgtgtatctatcatggagtaaaaagtatctctttaaccaatgaaacttctaagaaggacctatgcgagtctctctgggtcatttcaggaaggctattctttaaagaaaagaacactgagagtacttttttcatgttcagcaacaatatactgtctcattattttttactcagcaaaagtgcaacagatgttaaagtcactgcagatatggtaaaggaagctctggaagaagcagaaaaggcccaggtcgcagcagagaaggcaattaaacaagcagatgaagacattcaaggaacccagaa

SEQ ID NO: 126805 - DNA, 1575 bp, Homo sapiens
caggtacttctagttctgtatctttgtggatgtttagctagagccatactgtgtttttttttttccatgtctgccccatctgttgaaacaaaacagatcttctatgtgtgctgtcagattgtttttagaaagcaaccgaggttttacacttatgttcttaagactcatgttttacagcatgcagaatacactttattttctgaagctttttgtttttgtaagccagataaatgacttatttagttgtaatttgagatataatggaattataattatcttaaaattattaggctaaatagttgattgtatttatttaaaaactacttttttgtactttttaataacaatacttgtttgggaatattctgttaactccttttcactgcagtaaatctttgtcttcttttcagtatgagaatttccacaaacagctctaaatgcaattttctccctgctcagccttttctatcatatagcacacttgtattataatttatcaatttgcatttgtatgccatgaccaagtggtgatctttgagaggttttggtaggtaagaaaggaggactctatgcatgtgtgatggcagtcgggggtggtaatttgggaacacttcatctacctttgttcctttgtttgtactgttttctttaacctgtggaatgttttcccacttcccctgctcaaatcccaccagccaacagcttcttcagctacaactgtagcattcctctgcagtctctcctttgtctactttctttcatagtgactgcatctgacctattcttggctattttatgtggaatgatccagtcctaactagatgggaagttactaaaacgctaggtaatagatcttttatgtcaccatatttactggaggagttaacatggtgctggtgctggtcccaaagatggttcacaataggttttttttttaaactctaactggttagaaaaaaaggaaggcattccttggcccttgcactggcagaattcaacttgatatagcagatgtttgcatcctgggcagagctcatatagtattttaactcatttgggcagaagatattgatgagttgtaaacttccattgtttccttggaaataagcaggttagtttactcctaaactctctgctcctctctccattctgtctcccaaacactgttttcaagcacccttgctgaggaccacctacacattctctggggccacccaggccctgcacagctgttttgctgcagcagattcactatccgaagtattgtgcctgatccttggcttgttgcagacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtaactcagtggatggcctcagtttttgttatgtatgtttgctttcagctgtggactaaaggatctgaaagggagaaatca

SEQ ID NO: 126806 - DNA, 1037 bp, Homo sapiens
tggtttcagggttaatcttcaccaggtaaagttactggaacaaaggaacataatagctaatacccgtgaaaaaattcttttgctccctttaatttttaatggaagccccttctagaatgactctgaattcctacactgagatgggttttataattcaaatcagaacaaactaaaaaaggaatgtccaagctgggtgtggtggcacatgcctgtcatctcagctactcaggagggtgaggtgggaagatcgcttcagcctaggagtttgaggtcagcctgggcaacgtagtgagactccatctctttaaaaaaaaaaaaaaaaaagcgggggtgggggtgggctggggtgttagcctgtaatcccagcactttgggaggaggctgaggtgagaggaggattgctggagacccggagttcaagactagcctgagcaatgtagtgagaccctgtctctacttaggaaaaaaaatattaaagaaatgtccacagtgtaaaaaggatcaagtttcagtgcggtgtcactgagtagctaaaacagtatgggagaatagtcatgattcattctttagttgaggaccacagagaaacagaagaggggaaggctggaaacccatatgctgctgcttttaatctgtcttggttacagataccccattccaggatccagagacctcagcctaggagtttcagtcctgctgattcatttgcaaattattgtaataatgacaaaagatggtttgtttttctttgttttttttttttttttttttttttttgcttggcaccatagcagtaaggccacatccccaaaccttaccatttcggcagcggctgaaaggtctaggctttgtagcttgcctgccagttcatcaaggaggcgagcctgctcctcttgtttttccttgaactgggattctcgctccatcatcacgtcttctactctgtctctcatgagggctgactgctccacagtgctgttgggttctgtggtggaggcattcaccctctcctctgcctcaagagacatctggaaata

SEQ ID NO: 126807 - DNA, 1123 bp, Homo sapiens
ggagggctactatattagtcatttgagtggatccgaataaaggattgagaaaagtcatctagtcatataatcttcaggctgcctgaaaccagctatttataaagaactggatgtttgcttgtgtatagaaacaagattgcatgattttcttaatttttcatttttcacccagatgtttgccatactcgagctggagtaggtgctaatgggacaaaacatattcattgctcatgaaaactgtacttcataaatattttttcttgaattttaaaactttacagtaaatttaggacccgaagacaccaaatatagacactgcttggggaggaagcctagtatgatgaggttaactgtgggcaatttcatttcctaccctaggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatggtaaggtttggggatgtggccttactgctatggtgccaagcaaaaaaaaaaaaaaaaaaaaaaaaaacaaagaaaaacaaaccatcttttgtcattattacaataatttgcaaatgaatcagcaggactgaaactcctaggctgaggtctctggatcctggaatggggtatctgtaaccaagacagattaaaagcagcagcatatgggtttccagccttcccctcttctgtttctctgtggtcctcaactaaagaatgaatcatgactattctcccatactgttttagctactcagtgacaccgcactgaaacttgatcctttttacactgtggacatttctttaatattttttttcctaagtagagacagggtctcactacattgctcaggctagtcttgaactccgggtctccagcaatcctcctctcacctcagcctcctcccaaagtgctgggattacaggctaacaccccagcccacccccacccccgcttttttttt

SEQ ID NO: 126808 - DNA, 1142 bp, Homo sapiens
tatcccatagggttattgtgagagttaaatgggatcattcatataaaacatttctgtttaaagtattattactgctaagaaggggttagcaaccactgaagtcacgcatgtgctagaggaagctgctacagtctctacctgagccattggtcaattgttgtcgatggttgacaccttcccattttcacagtgaagtgagtattctaaatgccacatcttgtcactgaggttcatgattaagtagatcagctagcattgcttattcccttctagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagtaagtagttaatgagccagaggaattactcataaagctgaaaaaatattgtgagttaacagcaaagatttcctggcatggtgcttccatcaggaggttttgttagtcctgtgggtgagaacagattctgagccatttattttccagcagtcttgactgggcatttgggtgagtgaacgttggcacatcagtggggaccagccttctggaggctgcagtacagaatatgcaagcattatattcagtgctcctccttgcaaatcatgttctaagtcagtaaaatgggaggaatgctggatttagaagacaaagatccataattgagtcttggctctgatgctaggcttgtgaacttggatgactcaattcctgagcctgtattttctctcctgtggagaaggggtaggataatatatgccattaccttatgaagtaatgaaaggatttatatataaaataacaacaggattgcagaaaattataaattaagtattgctac

SEQ ID NO: 126809 - DNA, 1027 bp, Homo sapiens
gctcttggaaaagggcagtgtctctaaacccaggcaaacggtaaatgtggggcataggcaagagggtccgggtagtggccacttccccatcatgctcgtttctcattttgtgttttttagtagaaaaacacagtgtgttcttttgcccagacattaatctttagaatgcctgtattttctaatgttgggatttctttcacaaccacccaccttaatatttccattgtgactcagaaaatcagacttcattcgattctttagagaactataaatactgttgtcagtagagtgaagtcttgtcttatgtaatcctaattacagaatgtgttctcagaagaggtaggctagaccagagctgggcagaccacaggcagaggccaaatccagccccctgccgatagtagctaatataagttttacacccacttgttcatgtattttccctggctacttgtgggcagcaatgccagagtcaagtcatcataacagagacagaatggcctgaaagctggatttactatttcaacttttacattaaaacttgatgacccctgtgctagacaggcagctcatttctgcaggtaaaattatattcatctcccaactttcattccaaaattgaacctatattactgaggccaaaaagggaaaaggataaaagagaatgtcagaaaaaagaaaatcccatgtaagaaataaaaattatttaaattgcccttgcttttagtaaatagaaatgcctaagtaaagtatcagtaaaattcttggcattgcagcagatcctggagtcccacgttgctttgaggcaaggtccacggcagaagaaaaccccattacctgaatcttagggtgtagcagtttctctgtcccaaggcaaatttaagtttccaacaaaaaggaggataatcagcccagtactgagtgaccaatggtatagagtggggagtggacacagagagaacagctgatactgttctgccacttgcaggctatttggggacatggggtacataaaatgaagtaacaa

SEQ ID NO: 126810 - DNA, 1617 bp, Homo sapiens
taatagagacggggtttcaccatgttggtcaggttggtctcgaactcctgacctcaggtgatccacccgcctcggccttccaaagtgctgggattacaggcgtgagccgttgcacctggtcatttttatttttttctttacatccacattttctggcaggagtgaggtctcaagatgtgactcagtgcctgggagagataacaggaaagaaaaaccatgtagctgtccccatgataaatggcatccagtagagggtactgatggtatgctctgcccatgaacttgctggttggatggacttcgaaatcctaaatacccactgtggtcccaccttttctagtggcattgatggaatagagccttccagcttaaggaagagaaagaagtagcatctctaacatctctcttttggacctctttatttctctcttaccgagatcaactagcatttcctcttgctgcagctgcacagcccccaggctcctggctttgtttatacaaacatgtgtggaatgctagggaccagcaggactggattccttaaaagccttagtagcttaaagggcttttacctgctatgtccaacacgtttattacggctgttctctgccaagagtttgaaattattagatatctcaattcccactggcattttttaaaattatttccagttaagccttcaattttaaaatgactcaccagcatcttgtcaaatctgtgtattttgaacatacttttaggtgaaatgtgtcattgtgtgtatctgggaaatgtcagaactgtgtaagaaatcacgagaacttctaaacagtaattttagctttatttttgaatcacctccatttctttccttctttgcatttcaaggtcaagatgtgaagtgggaacatcttagcatttagatgtggctaacatccgcatgcctgtgtatttgggagtgtgacaataagtaaatgtgatgttcttttgcagagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgaggtgaggggctgctgctggggatgatgcctttatgagctcaggtgtcagcccatggtgactttgccccagttagagcaaggcaccagggcacacagcttgaaacacagcgtggcctggatcttagccctcatttgtaccccttggctgggtctacataactgtgcacagagtccccatcagacacatccatagcatttcagtagagggtcccagctgcagatgcagactcacttaacaatagacaagggtgtgctatttctcttcagtacctgggcgctgaagcagactcttttcttagcttctcgaaaggaaccaattagccatacccagcattgtaaaaagtgctgttgtttcctgacacatgctaaggagggcatactccctaagtcaggcgagtcaaaggtggcccaggattgtggctgatctgtga

SEQ ID NO: 126811 - DNA, 1023 bp, Homo sapiens
ttgagcccggaaattcagggctgcagtgagctattatcatgtcactgcattccaacctgggtgataaagcaaggccccatgtcttaaaaaaatgtaatccttggattaggatttctacatgaagctatgctttacattgttagtttgctcccaacatgctccacccccatgtgctcagaagctaaagtctcatgtgctaggacctaactgtccacagccgctgtggcctctggggcagttgcaacactgttagagactacaaaacattagattggtgcaaaaagttactatggtttttgccactgaaagtaatactgccttcctctcacaactcaaagcctattctttccccttcagatgtgatcaccctgggctctttaaacagtgcagtgaagatgaagcaccgccacgatcagctctctctaggcatgagtgtcggtgcactggtgagctttcagtcaataagctaaacatcttgtgtttggttttatcgggtgacaggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccagcaggactgtcgaagtaagatgcacatttattctgcccacttcttagaatgacttccacctttttttcattatcagcagattttattcttcctgtatttatttcacttgggaaaacacttgttcagagaggtaaaatttcactttcaactaaggaaagatgagaccaattttttttttttttttaatgagacagagtctcactctatcacccaggctggagtgcagtggcatgatctcagctcactataacctctgcctccagagttcaagtgattctcatgcctcagcctcccgagtaggtgggattgca

SEQ ID NO: 126812 - DNA, 1051 bp, Homo sapiens
ggctgaggcaggagaattgtttgaaccaggaggtggaggttgcagcgtgctgagatcgtgccactgcactccagcctgcgcaacagagcgcgactccatctcaaaaacaaacaaaaaaacagccaggtgtggtggtgtgtgcctgtagtcccagctacttgggaggctgaggcaggagaatcacttgaacccaaaaaacagaggttacagtgagctgagatagtgccactgcactccagcctgggtgacagagcaagattctgtctcaaagaaaacatgaggagtggagaagagtgtgcccaaacagaacagttttcaagactttccttggaacaggtttcttagaactgtggggtcatggcctgttctcttctgtgactgatgcaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggtaagtcgtgtgcatactttgggaggcaaagagagagaaaaagatgtctttatgagttcattgttaatgagaaaaaaagatgcaaagtgaaccaattaagtctacttttataatttttaattaaaaattagaaaagatgctcttttcctatttggcacatggagtggagtcaattcatattgagtctctgataagaacgttataacacaaagcaggaaagtaagctcgtggaaatctagaaaccctgtggaacacttttctgttattaaacattagaaagattaacttaagttttactcctgcctttctttatccaactcctagcaaaagtatctcaaagctgtgaggttaccaaatagtagtcagaagaaagaaataatatcatccagggaatcacaagatggccgaatatattcttcactgttaatgatactcacattatctatcaagattcaattaatctagctgggttgttaaaaactccctcttatttcatcctt

SEQ ID NO: 126813 - DNA, 1085 bp, Homo sapiens
tctcagttacagtttgtctttatctttttaagtaatatttcagtgaaagagcaccactgaagatggaattgatattcaagaaatatgcaaataacaggtgaccaggggaaaagtccatgaggataaagcatttccataagcagggtagggagaggggaatggaatcagagaagcatcaaatacctgaaatgtatgtttttctctttgaaacgtcagaccatcctctgaaggtcactgggctttggtctaatgtcctgtgatatttgagctttgaaggcaaggggagaaaacattaatgacctcctgcctagaaaaactgttttgatctgccaactctgcctcccctttcttcccttccgctcatcatagggatgatactgttttaaaccagaactctgaataatccaaagtagttaaaggagaaaggatcagggagagcccgatgatgtgctgctccgtgtcatgggttctggcctctctttacccacagcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaacgtaggttcctcaaaagcattgttatgcattcattcagattaactcagccattgtggcagggttccattgctgcagagccgatgcttccctcctgaagttgatcacaccaacccatgagcattctgaattggggacagggtgcttataaaaggagcatgtttccattgaatgagtttctcaaggcagttccttgtttgcctgtttctttagcttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtatgcaga

SEQ ID NO: 126814 - DNA, 1461 bp, Homo sapiens
taaatgtaccattttctttctttcttttttttttttttttttgagtctcgctctgttgtccaggctggagtgcagtggtgccatctcggctcactgcaatctccgcctcccgggttcaagcgattctcctgcctcagcctcctgagtagctgggattacaggcatgcgccaccatgcccagctaatttttgtatttttaatagagacggggtttcgccatgttggccaggctgatcttgaactcctgacctcaggtgattcgcccgcctcagcctcccaaagtgctgggattacaggcgtgagccaccacacccagtcaaaacgtaccattttcttgaatccagtttctcaaacgtagtgatcttttgtgaggcactcaaccttgctgacgactgaggtggtgatgaggatgtatgagatcctctccttccctcacaacctggctgtgcagtgacagactgaagccccgaactgtaacgaaagactgaaggtgacggtgtaacagcagagagatgcatgatcctagaagatgggcatgcaccagccagcccgagccagggctaccaaaacgttttcctagagaatcagagctaggccttaaagtgtgaatggaattgtggaaagttggcacaaaagtaagaaatagtgtgagtggaagagagaagagagggttttgtttttattgagaatcattccacatagcttgatgagagatatggttggagatgctgttggcaaaaatactaggattagtaaaggaatttggactataatattcacaggaagctattgaagcatttcaagcaggggattgtcattatctgagctgctttaaagtggactgaaagggacattgggaagaggcagaaaacagttgagaggtgtttcagcatccagggcagaagggatttgggctggaaccaggggagtagcagaggtagtagtaaagagaaaagtgaagagcaactgtttgttttccatttcaacttggcaattgattgattcagagaggtctttttataaacaggcagtggtgggctaactatcttttcattgtttgtttcttattctagctacccgaccactgggaaaaagctgtcatcacagtgcagcgacctggaaggattccaaccagcagccgatgtggtaataccatccccgatgatgacaaccaggtggtgtcattatcaccaggctcaaggtcagtgtgacggtggtttggcagctcaacgggcttcatatgcaaattagtatttttctaatattttgcgagttttcaagtcaccatttcagagccagacgttgactgctgacttttttcctttggaattatcgatgcagagctttgtttttaatttttattttttggatgcatgaaggttgactttcgttgttgtctttcttttttgtttgggggcagatatgtcgtccttcctcggccggtgtgctttgagaagggaa

SEQ ID NO: 126815 - DNA, 1071 bp, Homo sapiens
cattttgatttgttgcattggttaatttctttattgtttatccccaattagactgtaagttcttgaagacagggactatttttttttctatttctctttctgtatatcatttagccagaaataatagacttagtgaggaagtaaggattcattcagaacaaagttcacaatggactaaaatgtgagaatacctgcactgggaagcaaggctgctagggccaatatttgatcagtaaatatttgctgaagagtatgaggagtgtggctcattggaaagcaaagagtcggcaccagaaagagaagccgttttcagaggatgggttatggaggctgcagaaagccaggcagaggcatcatggcttgatatcataagaaacaattgtgggttttcgtgaaacaatgaaagcagcactgtaggaagatcggttggcccgtggtagacaggatggactaggcagaagaggaagaagaatttgagaggtcagtttaggagattgttagagtaacaggtatggggtgatgccatcctggactgacgcagtggcagtggcagtgacaatgagaggaagctgctaagttgagaaacattttgaagtaaaagctgagtattgggataaaggaaagagaaggtgatgtctcacctataccatgagaagaattttaaatctactggcagaaacagcagagctgaggataagaagtcagtgtgggtggtgatgatctgtttgggacaagatgaattagagatgacagctggccagtccatggaaatgtcccattgatggctggaaatagagaagcagagcccagccacctgctgggtgctgagagctgtagggtgagggccatctgcataggaaagccacaagaatgagttcactgaaggagccagtgttgaatcagagccatgcctatctgtgatgacaattcaagcctgtggacacagacttgtgattggcagggccgctgttaagggaattcctttcacatgatcagctctcatggagccattccttgtttagaattgtgctgcagatagaggcagcaccgggagcctgctggcgcctttgt

SEQ ID NO: 126816 - DNA, 1077 bp, Homo sapiens
tgtatagtgagctaaatggatttttggtagtacaacaaaagtttaataatccatgtctattatattgacaactaacctgaactttggaataattaaagaagtggccaggcgcgttggctcatgcctgtaatcctagcactttgggaggccggcgcgccagatcacctgaggtcaggagttcaagaccaaccaggccaacatggtgaaaccctgtctctactaaaaatacaaaaattagccaggcgtggtggcacctacctgtaatctcagctacttgggaggctgaggcagggagaatcgcttgaacctagaaaacagaggttgcagtgaaccaagatcacgccattgcactccagcctaggcaacagagcaagactctgtctcaaagaaaaaaaaaaaataataagacctaattaatttaaataatctaactgaagccaagttaatgaagttttgcctagtagattacctgttttaatgaaaaagaattggcattggttgctaggtaaatgctacttgtaaatgtttaataacattgaaaaatataaacatttttacagcatccttcaagattattttaacaatgaaatgtagagttttcatatctggcttgaagcccacccccccctttttttttttttttttgagacagagtttcgctttgtcacctagactggagtgcagtggcattgatcttggctcactgcaacctccgcctcctgggttcaagcgattctcccacctcagcctcccgagtagttgggactacaggcaccagctaccacactcagctaatttttgtatttttagtagagacggggtttcaccatgttggtcaggctggtcttgaacttctgaccctcaagtgatctgtctgcctcaggctcccaatgtgctgggattataggcatgagccaccatgcctggccccacctcttttttgaactcaccgtggtgaagccccgaaccctcccttgatgcattgcttctgcatctcttttagcatttattttgctcttatagttgtgttaaaaaggtctctttggacagagattatgtcatctttgtttttgcatc

SEQ ID NO: 126817 - DNA, 1052 bp, Homo sapiens
aaacctttttaaaaaaatggtgatttggctaagtggtaaatcgtgcagtaatataaattggtttccaggtggtatgtatgcatttagttctacattataacttttgtagatttctattacaataggttttcttaaaaaaatcttaagtaactagtttttttttttttttttaattttaagtaattttcttcatctgggttcttttcatagatactcagtaaaatatttcttgtgcatccactatgtaataggaacattctagagatgaggcatgtagccatcaacaagacagacaactcactgcaggcagggagaaaataaaaacaaccaaacaacccttttctgtggtgagctagagattagtatgaaaaagggttttaaactttcaattgattatggagaaacgtggctattcatacatctcttcctttgttctctcctgtttttataactttcaaggttcacggacactgcatgtgcaggcataacaccaagggcttaaactgtgaactctgcatggatttctaccatgatttaccttggagacctgctgaaggccgaaacagcaacgcctgtaaaagtaagtctgtgttgaagggacattttaaatccattcaggctctagtatccatttcctaattagaggtactgtaacagtgtactgttttgcagagggtagaaaagttactgtcttttttccagcttcaccctgatactcctagacaaccaacaatctgcattcagttaattaatattcactgaacagcctctgtgtgtttgacactgagctgagtagtttggcagctacagtagaaaactaaggtgctgtccttgacattgtatctgttttgttttttggtttttttttgtcgcctaggctgtagtgcagtggcacaggcggctcactgcaacctctgcctcccaggttcaagcgattctcctggagtagctgagattacaggcacgcgccaccatgccctgctaattttttttgtaattttagtagaggagaggtttcatcgtgttagtcaggctggtcttgaactcctgac

SEQ ID NO: 126818 - DNA, 1665 bp, Homo sapiens
tctagttactatagaatgaattggtagcccagcatttacaataagcagaagtctgcagacctaggaagaagagggaaagataaaattgatttagaggtaacttgtatttgagaaaaaataatttgccccacatcctaatactaagcttatttatgcttatgtcactatataatattgagaaacgtggaaacgttttgtaaaactgggacaaaaaagttgtggaccaaaatgttgcttaaaaacttgaaatgttctctccttaggttgtagttattctatagcgttaacactattttggtaacttggatgtcatttaagcggtgggaaatttcaaattttcccttccaaaaatagagacaaaaatgtttctaactatcttataataacaatgagaactggagtgctttgataaatcttttcctacctgaatggaattttctcatgttgaaactgacattaattgctgtgggaagcagatggcattgtgctacttcaaattactgtctgcccgcaggttccagcagtcatgcagctgcgttcttataatttctccactttcacacttcttcctaaatagctgttctgcaaacagacccatcacagaatagctactcttttttgttgtcgttcaggcaactctcctgcctcaacctccagagtaactgggattacagatgcctgccaccacacctggctaattttttttttttttttttaaacagttttgctcttgtcgttcaggctggagtgcaatggcacaatctcggctcactgcaacctccacctcccaggttcaagcgattctcctgcctcagtctccctagtagctgggattacaggcggatgccatgatgcccagctactttttgtatttttagtagagatggggtttcaccatgttggtcaaggctggttttgaactcctgacctcaggtgatccgcccacctcggcctcccaaaatgctgggaatacaggtgtgagccaccgcgcccggtctaatttttgtatttttttagagatggggttttgccatgttggccaggcaggtctcgaactcctgacctcaagtgatccacctgccttggcctcccaaagtgctggaattacaggtgtgagctaccacgcccggccgacattcttatgaaactgatgagagggcagtaacctttcctctttgcagtcatgttatgttaggcttcactattggagtcatctagatcatacaagaggaggaacttaagctattttcatgtgtcatgcctttctctaaaaagaaatgatgcaaggaaaaaaaaaaaaacttcttgcttgtctgatcagacttttcatcttcttgatgaccttcctagatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggtaagtaagccctctgtgcacctttctcctttatgtggctggtaataaaatgcaaagtgaagctagtcttaccttaagccttttacattttctgggggttttagttttacag

SEQ ID NO: 126819 - DNA, 1767 bp, Homo sapiens
ggcaggagaatcgcttgaacccaggaggtggaggttgcagggagccaagatcgtgccactgcactccagcctgggtgacagagcaagactctgtctcaaaaaaacaaaaaaatgagatgtggaagttgcacacgtcacttctgctcacatctcattggccagaattagtcacgtggctatactgcaggagacactgggaaacatctctaggtgtttcatgtgctctactaacactcttggcgagggctcttactgtcaaaggaacaagggaagaaagaatactgaagagaaatcagaagtctctgccattctcaatatactcaataaaatgagggttgcatttccgtttaatagaaaaataagctgaagcttatagagttggatgttattacgtaaagtgatatggctattaaatggcagtcagatcttgaatccatatgttacggtgctcagttcagagctctttaccacattcaacaactgctcttattacacaattacattttaatcttcttgggaggcatgtatggtaattaaaagaatgggctcactgggcgcggtggctcacacctgtaatcccagcactttgagaggcctaggcgggtggatcacgaggtcaggagtttgagaccatcctgaccaacatggtgaaaccccgtctctactaaaaatagaaaagttagccaggtatggtggtgcgtgcctgtcgcttgaacccgggaggcagaggttgcagtgagctgagatcacaccattgcactccagtctgggtgacagagcaagactctgtctcaaaaaaaaaaaaaaaaaaaaaaagggctttggagtcacaaagtcctggatttaaatgtgttcataaatcataaatgtgttcagtacatcaaagctgttgctacatttgttgctgttgatgttgctgtgactatcagctttggtttgggttttgcacaggactagttccaaatgttggaatgaaaggtgagcctgcctctcctgctactaaggtgcaaccagttgagtagaggcggggctgattcttgctgatctttcccagctgcacaaggccctatttttaaccaaggccccaaaaaacttccaagcttgaagcaaggaagagtggagtggaagaagtccagggaatattgccagaaaaatgctgcttccccatttaaattaattttacatgtggcccagcctgtctctggtctgtaatttactcattcattctcttgtaaaacaaatatttaatagatgtgtccagctctgtgccaatttctgagtgagccatgaggcctttcctgcatgtctcaaaatgcagttatgaaaaacgtccacaagggctctgggacagacaccccctaagtccctaaaaggactcaaccatctgctccctttaaggtgaaatttgtgggacttggaggatgtgttgtctttataattttgattcttttgtcttttgtggttaaatgacatcggagaatctttttctatgttacggaagcatgcatgttagctgatcatgcatttgatttactttgtaatcaagggagcaatatctctttagttgtctattgttgagacctgagactcacttcaaaagtgatttgccacttagaatagcagtcaagatgaggctcgctttttaaatatggcaggagagagtggggggagcatatttgctctactgaggggtttccacaaaggtcagttcaagggtttctaaatactccagctgctcttcaagtttgttgtttggcctcttgtcaa

SEQ ID NO: 126820 - DNA, 2477 bp, Homo sapiens
gtatatatcatattttgtttatcttcatcagttgatgggtacatgggttgttcccgccttctggctattgtgaataatactgctgtggtgaacattcatgtacaagtgtctgtttgagttcctgttttcaattcttccgggtgtatacctaataatgtggaattgctcgattttccagcttcttgagttattaatttcttcctcttgcttttccaaagcacattgcatgcaaccctactatggtgtttgacatagcatattgcaaattattgacacccatatctgcacctcattggactgtgtataacatatacaacatatagtccactggctgatactaaggaggtagtcatacctttattgaatgattaaatgaacgaatgaaggaacgagcactcaaacttgccactcatattacagtggacatggtgactaaatatacgaaagtgtgtttgctatttaggcctgtttataatcagcttctaaagagaaacagtttacttatccagtagggtggggaaaagtatacattttagaggttagacattttccttgcaagaagagtctctgtggaacagcttgaattatttgaaatccagccacagtctgaaatacaaaccatatgcagttcaagtttgtggcatgcagttgagtgacatttttacctgagattaaaaaaagtagagactaccaataaaaaacatcaaatgagatttttgctcctgcctttagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtttgtttgcttctgtgttttacattctacttgcaaatctactttttgattattgcagaagtaccaattactcttgtttccatttttaggtgatatttcgtgctttagatcctgctttcaaaatagaagatccttatagcccaaggatacagagtaagttcattttcaaacaaaagtgttttttgttagtttgtttgtttgttttgttttgttttttgagacagagttccgctcttgttgcccaggctggagtgcaatggtgcgatctctgctcattgcaacctccgcctcccgggttcaagtgattctcctgcctcagcctcctaagtagctggaattacaggcatgtgccaccacgcccagctaattttgtatttttagtagagacggggtttctccatgttggtcaggctagtcttgaactcccaacctcgggtgatctgctcacctcagcctcccaaagtgctgggattacaggcatgagccaccacgcctgacccaaataaaattttttgtttgtttgttttgttttgttttgtttttttgagatggagtttcactcttattgcccaggctggagtgcagtggcgcgatctaggctcactgcaacctctgcctcccaggttcaagtgattctcctgcctcagcctcccgagtagctgggattacaggtgcccgccaccatgcccagctagtttatttttgtatttttagtagagacgggttttcaccatgttggccaggctgggtctcgaactcctgacctcaggtgatccacccgcctcagcctcccaaagtgctgggattacaggcgtgaaccagcgcgcctggcccaaataaaagttttgatggtaaacagcagccatggaataagtcttactcagaatctaaatattcagtgctaaatctacctttttcattttccttctttctctgtgttacctgaccagagggtcttgaaattagcaataattactctccactgatagggaatacatttacatctgatataagatgtaaatacaatacatccgatataagattgataggttatcaagtaattgtgttgatcataataccttattttattgctcagtatattagggtatatattgggcttttgtatcaaagagtctccccaaatctagttgttcaaataaggtgaaagtttctttctctcttacaaaacccaccaaagagttttctagagaagaagtgtagctcaattgccataattaagcttaccagataaaatacaggatgatgcccagttacatttgcaaataaataattcttttttttagcataactatatcccatatatcccatataatatttgtgactagtacaagtgtgtctcatgcaatatttgtggttggtataaccatgtcctatgtgatatttgagacatactttatcctaaaaaatagttgtttatctgcaattcaaatttaactgagtgtcatttatatttacttgttaaatctggcaaccctagttataaggccatccatgtttccaggtttattcacatggttagagttagaccaccacca

SEQ ID NO: 126821 - DNA, 1066 bp, Homo sapiens
cctgatacaggaagaccacagtgaaatttcagggtgttacctgtttctaaaagagggcccaaattttagatttcaggggtcatatttatacaaagtcaaaagtaattttaaaagaagacacaaagtgtaaaatattcagaatcagaatacttttccttcatttttaaaaaggaggctggccgggagcaaaatggctccatgcctgtaatcccagcacttagggaggctgaggtgggaggatcactggagcccaagtgttcaagaccagcctggacaacatagactcagtctctacaaaaaatttttaaaacttagctgggcgtggtggtccacacctgtggtcccagctgtctgggaggctgaggtgggaggatcacttgagcccagtaggtcgaggctgcagtaagcgataatcagtccactgcattccagcttgatcaacaaagggagaccctgtctcaaaaaatttttttaaataaaggctgatatttctggcctctaacaaaagcagaaagtatcagtttcacattcggggcaagttccaagctaattgctcagaacatggtcagcccacccacctgtacaattgcccttcagaaggaggacagagtattgtgtgtggtttgcacagcagatcccttaaaatggagtcacttttacaaagcagaaagcccattctggagacctgatcaattagaccaaaggaatgtggtaaagtggattccgttcatttgcttccaggtttatacagagatgtctagactgcttcctcctgattagaagggaggctgtaattaaacttttttaaactttttttttttttgagttctggtgattgttctccagtactagtttccttgactacaagttattgaaggcagttgatgttacttttctaatattagcatttaaattttacctacaatattatgctaacacttacttgagaggccaggacatcctgtaaatgaatcaccagattctgaaatcagctttgaccaaaatgagaatcacactgtttgtattaaaagcaactggaaagactatcctctcagtgatgatttct

SEQ ID NO: 126822 - DNA, 1033 bp, Homo sapiens
aaaaaaaaaaaaaaaaaaaaaaaaagactgagagttatgtcactgataaggcttttaaaaggtactaattaggaagatgggtggcactcccaaagtcaaaggtcaaccaaataatggtgtctatcaccaacgggattaaaaagtcctctggatagatgactggattgtcagctccatagttcatgatttccaaataggatcactgagaaatcatttagtcccagatccttactagactggaggctaacactggcatttcattagccatgctgcagagaacaaacacatcctacaacctctttgcctggcaaacagcccaatatttgaaatagaacctaatcctggagtgagaccgagtgctgacttgtttctgatgtgataaaaacacagcactcagctctgggtgggctggccttcataaatctgattagcagccttagtagcaacaagcatagcagctatgatgaaataaatgctctctttccagaagaacaggctttttcttttagaggaactgtaactgtagagttaattaatgtagaaggccaagggcattatggttggagagaggagcaagaccacttctatttgagagaggagatggcttttactagtatttttatcacttctgaaatgtgctcatagcaaagatccatcttacccatcttcccagggtaaaaatactggattgaaaattaggattcgctttctgtccaagccatgaatagtagtagagtgtttaacttgctcattgaattgtttcctggatcaccctaggtaataattaacaacccagaactatgagatagtctactctattgctacaaacctatcactctgatcctctcatacaaagatattgcctgaaccttactggctttaaaataaaggtgaaataagcagcacttttcatttagaaagcatttcctgagtactgactatgtgccaagcacaggattaggaactcacagggaggtgtggtggggatttcagggactcactgaaagcagaacttgacctttcaaagagagaa

SEQ ID NO: 126823 - DNA, 1040 bp, Homo sapiens
gtaggcaccattattactccacttacccctcaagtcagagaggtcgagtacctgccaggtcgcccagtaggaacgtgacagagctgggattagaagcttgtcgttccgtctccagaagaaaggcctcactatacccccactgcagggtcacaaaggtccacaggccaaggaggacaggctgtctcagaaagggcagcttcggtcaacacttggtatatccaatcagtgattctggacccctgcaggctgcatgtggttactggttctggattatttatgaagaatctactatgtataaaaatgacctgttgttaaaattgttagaaatgtttaggaaaggaaaaagtgactttatccaaagttagattcaccctcaaaatcaagttgtagcatttgttgtccttctataggacaaaagacaactcctttagaaaattatttttcactcagcagtgtaatgcctacagttccagcagcaactgccagatagtttgaggtgaggaatcgtgataggtgggccttcttgtgtgccagtgatggagagacaggacaaggtcacaaccagttcttgtcactttttacatataaatgtattaaaaagaacaaatattgattcacctctagtgaccttagttaacacatcgcctgtaagagcaaatgctgccagcattctagaatgcctcagtttaccattacgctgcctcccttttcccagttcacaatgcttcatcctttggggctgctgggttaactccagtgtgaaagcaccgtcttccactgcccctgctcctgctcctgctcctcctctcctctcctctcctctcctctcggttccgcggtgtaaggatgtcaatatttggcatgaaagcctatcattggctaatttttaaactctgcattcatgatctacttctctctctttctctgatttctgctaattttaggacactggactcaactttatctatagttatttcatcaatcttcctaccattacaccatctctcccttttataccctggatttctaaggtatatttc

SEQ ID NO: 126824 - DNA, 1027 bp, Homo sapiens
gctgtgctaagttccaactactgaggtcagaatatatgcagggttaagattaaaggaaaatttcccttggcccctaccttaaccccagagaagaaaaatggatgcttatgcagatgattttcctagtgaaggtaacagattcacactcactttgtttcatccgtttcacttctcctctctgacatacatgcctttttttcttccctggttattttcctattgatactttcaaaagtacaatccttctagccttgcaactttcacattcatcatggtcatgttgaccttgaacatggcattttatgtctgacttcaaaatataatgtgtttttattctcattgtgataatttctgtaatgaaggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaaggtaaggcagaggtaatgtgtttaatttttaaatgactttgaacaaattctccagctttgccaaatggataacgatgactctacatttcagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggtatttgaagacgatttctttactttctcttcattctttctttaagctattcttgaactaaaggtctactatgtagtcaattatggtgatgtttttagtttctgaagtctgctgtctccaaaatagagagataagcattttctccctactgtaaaatatatgcacccaagaaggtatcaggtgattgaaataggaccctgagaatgtttgtctatctttgcgtgctggtctcttgtgtaattcaggatgggaaaaaaccc

SEQ ID NO: 126825 - DNA, 1002 bp, Homo sapiens
gtttttctctgtacatgtttaatcccagctgatgaaaaattataattcagtatcattaatataatagtaattcttttgattaacatagtagcttcatgtaaaaatttccaagagttccttattagtcacaacgttgaaaaaaataattaggccccatcagtaaagcaactcatgctggcattcatactgtatcattgacatcgaagtttatggtgtgccatcaattagtatagttctgattatgtgaaaacgtaaaactgtgagcattatttataaaagtgtggtgctaattaaaatatctatgtatttcttatgattttttaataaagatttgttacaaagttgcatgaaaattcatcctcaaaagtagtcataggtggattccttttttgtaacatcattatttatttatcctatcaggcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaaggtatattgtttaaaatccattcttcttgccttcatgagagaccctgaaactttaattaaatgtggttttcattacatttttagtaatggtaaatgtaaagttatgtcaacattcatggtaccttgactctcttctcattgctattggtagtgcatctaaatcaggttaaaaatttacttgttcaaatcttcctcacaaaagaatcccagttaatgaatataggaataatgaaggaaatagaaaagtcaatattagaatcccacagtaataactagagccggcaagatcaaacaatgaatgctaaaattagtgggtgaaactttaaggagaaacaggatatttgcatagcttcaaagtgtttctatcccgcagaaattaattactggggaagttttag

SEQ ID NO: 126826 - DNA, 1032 bp, Homo sapiens
aagaagctcctaaagttgtgccatgggcaacactgtgaagatcttctatagatattcagaaaccgttagaggttttctttttttaacatcagtaactaaacttggtaattctgtttgcttattgactaattaaaaaataagaggatataggagggagggaaatgctagggacctctcggggtgaggcagtgtgagatggctaaaagctccagaaccttccggaactggagctctagatctggtacttcacatatcacgtgacatttaagcaggtgacaccatcctacaccttgaattccttatcagtaagttaagaaatgtaataaaagttaccttctggaattgttgggaagataagttaatgcctggaggagactcatcgctgtgcctggcacatagaaaaggctcagtgaatggtagccattaggactggattattttcttgtctgttaaatgggtagaaatacctgtttttctgttttctggggtttttatgaatatcaaataagatcattagttatagtgctctgaggagtagagattttgagctattatcaggatgttgttccattatctgttattggggtaaaaaccacctgtttattgttcaccattccttaggtactagtccaggttctagttactacattcctggtagagcctctactgtggaagattcctttggactaggaggaaattagaaacgtggtccttaaagcttctcacagtttgtcttgtttgatcattatcatctctatagtcctattatcccggactacttttttctgaggtgcattaatgattgtgtagtggtgtagatgtaattgactctgttgatgtgttaattattagtcgtcattgtccatttctctctaacctttcctccacagtctcagacttaaaatctgtgattgaaaagcacagcatggctagagatgtgcatttgtgtacttcttccttaagataaatatttaaaatataaaaagtgaccatccccaagttgactgctgaaaaatgtctttcacagtcaag

SEQ ID NO: 126827 - DNA, 1058 bp, Homo sapiens
aaaaagacttttatcttataattaagttgatttgtaaaagtgaacctgtattttattacaaaatcctaatagttatacaattttaatgctatttatttatttaatttatttctttcttgagatggagtctcacttgtcacccaggttgcagtgcaatggcgcgatctctgctcactgcaaactccacctcccgggttcaagtgattctcatccctcagcctcctgagtagctacaattacagatgcataccaacatgcctggctactttttgcatttttaatagagacagggtttcaccatgttggccaggctggtcttgagctcctggcctcaagtgatctgcctgccttggcctcacaaagtactggaattacaggcatgagccaccatgcctggccaatttttaatacaatttaacagtaaagacagctatcaaaattttgtcctacaggatcattttaaggctgagtttagttgataccagtcaaatcaagaagacccagcacccacagaaagaatacttgccccatgaagctgaagattaaaagctcatgaataaagcagttactctgggatgcctagaacttataaaaaccaagacagggatctaactccaagtaaaaaatatttacctctttattgttttataccagtaaagtttgattcaatatgtagtcatctggaaaactagaacaatcttttcttatacaaattaacttcctccctcttcattgtgacatagcatgaaggcaaggcacagatttcaactaagtgacatctcttgaaacattagcatacttggacagtccctctattgtgatcgtgatgaactttttcacagaatgactacttaccactgaaatgcagcattcctggaagctgaatgacaatgcagtgaagaacattctgttctttcaacccaggcgactgctcagctttccatttccacatgaagtctgagcagtgctctctgtcctggggtcagatggaagcatattaaattcaatgtgcaacatttctgtagggaggctaaattatacatttcctgatatttatc

SEQ ID NO: 126828 - DNA, 1089 bp, Homo sapiens
gagcgacctgtcctcaggcctggtgcctggagactggggtgatgcgcgagatggcaccggggtgaaaatggaattgaagagtgacccagggagagatctaaagaggctctggagagaggtcaacaggagatgtcagaacagatggggaagtttgggaaggaagtgtcagaagctttagattttagtataagtgtggctgtcacagactgttcgtaggagtgggaggtgcaatgcattgagctggttattggaagttgccagatggctttactttccttcctatgcaggatgtaaaatatgtcatccatttctatttaggaaaaaacattcaatgttgttttgttttagctgaagcagtgatagtggtcagcagtctggaaattctacctttttgcaggttacatttctcttaatgctctgcacgcgttgatcctacctaacctcaaattcctgcctagcctccatcctgtgaccaaagtgaatctcactcctctggggccgtgtgagactccacagccaccttctctttctaggcaggtgttttgtgccttccctcacacaaacagctccctgaatatgtcacacccctcgttccccagcttaagggctccattcacctaatttcattttgcaatgccttgtggaggtaggaggcgacaaggaattgaggagggtgacagtcccagttctcctacccgccccgcctctacagtcatcccactgaacccaaggaggacatttcttactgaatgagggtcggctccatttctttctcttctaatccctttcagggagtgctcagcttggtgaggaatgaaacccaatgctccatggcccctttccagctgggtgcagttccaaactgcattcaaagccaacactaattatgttcaaagtttcatattagtaacggagtaaagacatatgtgagctaatattaaatatcaattttccctaataagaggctttggctattttattgtggatatgaagctgtcttggtatctgtatgtgaagacactggcatagaacctcatatgtcaggaggggaggatggtgccctctggcaggaagcttccaattttccgg

SEQ ID NO: 126829 - DNA, 1087 bp, Homo sapiens
cgcaagcgctgctggagggctccccgggccccggggctggcgaacaggccgcttccttccccggatcgcctcccctcccgcccgcgcccgcggccacatcttcgtcccccgtacgctggcgggtggcccctgcgccgcgggcaccgagggagggcgccgagcggtggcgtttctttcgcaccccgcctctctccttcccttttcttcgcatcaggggctccagcccttggctaccaccggcgcagaactgtcctgagaagaaagctttcttttcctttccgagtcccagatggttaacgctcagaagtgcgggtctaagagactgggctcttcctcgccccaggcttttgcaggaggagatggagccaagtgtaatgaggcaggaagcattggttgtgcaccaggagctccccctggggtggtcctggaaaggaacacagtaacctctgaatacaaacctcggaggctgggctgctttatgggactgcattgtgctaaccatgccctgctgttaaaatattgtaataatggcagtacttgctgaagtactgaaatggagttaggcaactgatacttgctgctttaatggtaacgatagccaaccggttttgagagctttagatgtgctgggcgctgcgcatgttacatgtatcatctcatttaattctcacagcaaccccattttaaaaattaggaaatgaaggcttagagaaaccaagtaactttcccaaggccacacagctaggaagtaggggagtgggattgtttttgtccttgtgctttacaatccaagactgagactgtggccttttggaggcttatcagtttaggggaaacctaaaccactgagtgttcaaaaccagggagatacattacaagcccatttaattcggagctctgcagaactcacagtagcaggcaatattgtgattcagagaactgtattgtggaatagccttttattcccatgtaactcctttacatattcttttattcctgttagcttttaagtacgtggctgttaacccacaatccaacccattacagtcactgaacaacatgttcttagtaaccagggcctctgtga

SEQ ID NO: 126830 - DNA, 1065 bp, Homo sapiens
atgtacctgaaactattgtatttgcttttttctgaagtttgagagcaaaaggaggaaaagtcctcattgggcagtaaataattgaaattgcatagttttctttgtttttatctaattatattatgcattcccaactcaacttgccatatgctgcttagaaatacctcacagcttgtagcgtgctgctattatagatacattataagtccttaatatttttcttaagttaggcttaactgagtcatctgccttacgcaattatagggagatgggagaaatgaaaatgctttaaaatgtactttttgaaagaatttctttttaagatatcaaatggggcttctcccttgtgctggtaagtagaatcacaactgggaccattctcctcagtgtgagttgggagactttctaaacaatagaaattgcacatttcctttcacctaatgctaaggtaaacttcgttcataccgtttgcatgtcttgtatcttgacagggactcagtatgggccttccaggcacagaataaaaggattcttttgtccgaaagtgagctttgagaaatctttttgaccaatatctgctaattctatagcagatgggtttgttgtacagattatttcatcacccaggtattaagcccagtacccagtaactatcttttctgctcctctccctcctcccaccctcccccatcaagtagaccccagtgtctgttgtttctgtctttgtgttcataagttctcatcatttagctcccacttatacgtgataacatgtggtatttggttttctgttcctgcattagtttgctaaggataatagcctccagctccatccacgttcccgcaaaagacatgatctcattcttttttatggctgcataggattccttctaatctggaatcttcattttgtcagatggaatcttttcattgggctataacaaacttactctcaccataactacattcacttatgagggcagagccctcatgacctagataccccttattagcacccctctcccattgcattgggaattatttctaatacgtgaagtttggggg

SEQ ID NO: 126831 - DNA, 2204 bp, Homo sapiens
aaaaaaaaaaagtacttcagatagagttgtccctagaggcatttgagctagatgggatttcccctagagggtagagagagcccagcctgggttataactacactgtgcactacttcttcctaaaccacatttttttttttcttgagaaggagttttgctcttctcgcccaggctggagtgcaatggcacgatctcggctcactgaaacctccacctcccgaattcaagcgatactcctgcctcagccttccaagtagctaggattccgagtactttgcaccactatgcccggctaatttttttgtatttttaatagaaacggggtttctccatgttggtcaggctggtctcgaactcccgacctcaggtgatccgcctgcctcagcctcccaaagtgctgggattacaggcgtgagccactgcgcccggcctgaaaggaatcttttgaggggaaagggagtcacaaaagtatgcagtctgagggcataaaggggaatctcacaactttgttttggtggtaggagggaggggctccctctgagctttttccccccagcaactagtaacagctgagctgctgattagtggggtagctaggacctctgaagtttgaagctcagaattgtacctaacccgctatgccctagaaatggtcctagtcacacttttgaatatttcacaagtgtctgtgccagtattgtgactagaacatagctaacacttgagtgcttgctgagtaccaggaactgagctcagcaggttacgttaaattgtcacaataagcctacaaggtgaatagcagtattatccctttgttagaaaaagtggcccaagataattacagctagagagcgatagagctaggaccagtccattgtcttagccacaactcttcctgtctctctttcccggaatgtctttcctggaatgttgtgaagtgacttcaaatctagtttactaaactgaatctgtgaaatctggggtttaatcagtggagaaatgtacttgtctcagtaaatgtcctctcagtcttcataacttcagagggtttttttttttttttttggaaaaacaattattacaacatcaaattatgtgaatacttctctttatctcttcatttattaacacagtggtcttggaaggtttgcaaatctgggagtggggagaagcgagattgtctgggggaatcgccagcattaagtactccaggagacagataataaatgttacgggatgcaatgggcattggacagcccctcatgaataattcttccacccaaaataccaacatttctcccttttagaaactctgagctactcatccacaaaatgcaagtaatgaatttcttccacaacaaattaaaggtatactttgcccagtcagggtgcataaaccatttgtaaaattccattccagttcaatcccaactggaattatttttgcattcattggtcctcctccttttttttttttttttgccaagtttaaatacaatcaaactgttcacttaatctcacttttttggagcaaatctatggcaattactcttccatgactaggaaataggaaggaggggatcacattaaaaaaacagtttgttctgttcctggcaggagctatgtaccatccaaaaaagattcatagagtacagatgtccctaggctaaaccgttggctgtgttggtccaaggtttgataaatgtctctctcagaagtcacactgattgctttgtttattgtaacctttattcagcttgatgcgagtggattgaaattcattacacttcacagatatgcattattagcttggataattaattattttgataaaaataaagtattgactgtaacgttgacttatcttcgtgataaaaatctttaacattcttatagattcattccttgcccctgaacaatataaattttgagatggtattttaaggacttcagtctgattgaataggaacaggttatatggtccaaaatggttgaatgttccagtaatagctgtagctaacatttattgccatttaatcttcacaacaaccttacaaggcaggtatcatcattattcctattttatatagtaacactgagatgatagcgagaaaagtcatatttcttgactgctttctcaatatcaatgggaaattataaaccacatcattaacatgtctatatagcaatctttacaaaattat

SEQ ID NO: 126832 - DNA, 1148 bp, Homo sapiens
tatgcatatttacatatttgcacctcatcataaggtcactctagtcctaaactgatgtagttcatctgttttacagctgaagttaagtatgtcccttatttgtgcttggcttatttctttcttaaataatacattacacaagtgaactctggccatggcttctttctttctttcttttttttttttttttttttttgaagtttcccatatatacaactcagttctttttttactgacacctaatataaaccacgtagcatggcacctaccatccctatttctttagctcttttcactctcaaacaaaaggcaaacccagttgtgtggtgcaccagttttcagccattcttgtcctcatttgtacttgaaactggttatctgaagaactgtaattcacctgagataaccctcattttataacaaggccagtgcttgctttatccaaaggaacccaaaaagtaaattctgcaaataatacaagatggcaatagaaacagatgtgaaaatgaattttcagtcttatacaggtaaaatatttgcccttttcaaaaaggcaaagaggaggaatggtctattttataaatgtaataaattcctcaactcttattttttaaatatagaataaaaattgttttaatgctcaggttttcctgagtgtctcagaagtcttatttcaatagtaaatggtgtactggtaatatttcagttccattcttgttgcagatactattctttattaaaatagtacttcatggccagggacagtggctcacacctgtaatcccagcacttttggaggcccaggcaggtggatcacttgaggtcaggagttcaagaccagcctgaccaacatggtgaaacctcatctctactaaaaatacaaaaattaggccgggcacggtggctcacgcctgtaatcccagcatcttgggagaccgaggcgggtggatcacctgagatcaggagtttgagaccagcctgaccaacatggtgaaactccatctctactaaaaatacaaaaaaaattagctaggtgtggtggtgggtgcctataatcccagctactcaggatgctgatgcaggagaatcgcttggaacctgggaggcagagactgcagtgagctgagatcatgctattgcactgcagc

SEQ ID NO: 126833 - DNA, 1561 bp, Homo sapiens
aagggaaagtgggcaccaactataaagaggcttaaaggaactttttacagtgatggaaatggctatgtcatgattattgttgtgcttacacaagtgtatacatttgtcaaaacttgtcaaactatacagttaaaattggtgagttgcactggatgtaaatgatatgtcaatgaagttgatcccaaaaaaaaggaaagttggaaagggcatttcagcagtggtgaacagtatgaccaaaagcacagagagaatagaagaagtatactaatttcacagaataatgtattttggaagatgaattttatcttatagttttacccattattatggattacttctactgtcagtttgaataatgaaattagtgaatctttgtaatgtgcctaaaaagaagttaattttaaataaagacaaattaacagttcattgctcactttatcccctcttttcttatccccttatccttttcttttttgctttaacagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataatctgttgttaaaaggctaatgtcattt

SEQ ID NO: 126834 - DNA, 1054 bp, Homo sapiens
gtaattatatattacatatttgattgtttacttattatccttctgtccaacaagaatgcaaggcaagaatttatccagtttactttgacttacccagtttgctgttgactccagtgcctggcatatagtaggcattcagtgagtgtatgttgaatttcaggttttggccttgaggtgtttgtgtgtgtgtgtgtttcttagaaacaggatctcactttgttgcccaggctggaacgcagtgacaatgatagctcactgcagcctcaaactcctgggctcaaccagtcctcccaccttagtctcctgagtagctgggactacaggtgcataccattgcacccagctaatttttcagacctttttttgtagagatggggtctccctgtgttgcccaggctggtcttgaactactgactttaagtgatcctcctgccttggcctcctgaagtgctaggattactagcatgggccactgggccttgccttgaggtttagatttcctcattttactattttgtttttaattattgggtgaaacgttttactaaattaaaaaaaattattaccacttaacagctgcttgtatttgaatctcattcttttcatatcagcatattattggccaagtcattaacataagtgagaatcttaaactccccactgaggacttttattcattgaatgaaaaccaaaaaaaagctcatgtgctagatttttcactatctgaaattttgttgccagatcagtaaaatactctttttctcccagctttattgaggtcagactgacataaaaattgtatatatttaagttgtacaacatgttgttttattgtaagtataccttgtgtaatgattcccacaatccagctaataagcatatctgtcacctgacgtagttactattttgtgtgtgcctggtaagaacacttaagatttactcccgtagcaaatttaaagtaaacaaaacttaatacattgttattaactatagttaccatgctgtacgtcagatctctagtaggtagtcataactgaaaatttgtaccctttga

SEQ ID NO: 126835 - DNA, 1904 bp, Homo sapiens
ttgttggtttttggcattcttaagaagtgtatttgagtggatttcttcttctttttactttttttttttttttctgtagaaatgggatctcgctatattgttcagctggtcttgaactcctggcctcaagtgatcctcttacctcaacctcccaaagcgctgggattacaagaatgagccactgcctggccagatttattcttaaagagatactgttctgcagaaggatgggttcagtgaaaaaacaagagagagatactaatataaattttaaaatgtgctgccttagtgtaggtttttttatcatttagatattagattttcaaaagtaatactaaaaatttggacaggcaatttttactgattttgatttatattattaattttcatgttagcatataaactctaaaagcaattattagattgttttattcaacagcttaaattattttttctttaaacaggaattgtcattttgtctttaatcttttctgtaggggcgtggttgctctccagaccctacgaaaattagttgaacttactcagaagccagttcatcagctctttgattacatttgtggtgtaagcacaggtaattattattatatggaagtggtgcattctggcagtacattaaggaaaagaacattaagcacttatgtttaagatcatagtcctttgccttcttcagccctctctccataccccaaaattttgtacttccttttttgtcttttgttcatggttatgccagttaggcacactaggtggcagtgtgtcctacctattatagctagatatggaatcagctgtttaaaaggacatccaagagtacctaatatgtttaattacattggttcctaggactaacttgaaggagaattgcttagtgatttggtgagttgtcaaatataccatattctgtgactaaaactaagtaattcattgatgttagaaagaacgtgaattatctaccatagtatcttatatataatttaatgtaaaacaacacatttgtaaatatttttaaattattattattatcattattgggggtagcatttatttaatcctttttgagacctggtaaatccctttacatttgttaacccagtaagacacatgaattttggttgttcttattactcccattttacccctgaaacaaatggggctctgagaaggaaagtcatttgtcccaggtgacatagctagaaagtatcaacgctaaaatttaagccaaaactatgattcaggaaatcttacatcataagggctataacttaacactgataaaagctaaggattcttttttccaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaagtaagttacaattactctttttaaatcttctgattatataggtagtatgtgcatattataatttgaaaaatgtcaatattaaattatattcttgcatattataatttgaaaaatatcaagaatattaaattatttgactaattagagataaccactgttagtattttggtgaatcatagtttagtaattgttttggggggtttgtgtgtgtgagatttgcatgtaaaagttgcaattgccttttttaaaaatatgagatacttgcatcctgttgtttttacttaacatattaaatgtgtctcaagtcattctaaaatattcaattatttttatttttatttgtttttcgacacacgctctcactcccgttgcccagggtagagtacagtggtgctatcttggctcactgcagc

SEQ ID NO: 126836 - DNA, 1034 bp, Homo sapiens
cctttgttaacatttgtttgtattcttttatgaggcaaccttgaatcccatatgcaatgtatacaagatggttcattatttctttttaataacagtttaacttctagtagttactgtgaatcagttttagcctcttaatctcaggatttggactaaatattatacaaaatttataatgttaaccttttgttataataatttgtaaatttctataaattatattttctctagttaagtattacatcttttaatgaaaacttttgaatattggttaatttttgtcctcaatattagaacaaatgtaatctagaaaattgacattaatatatcaaaaactaatctgtcttataagattactgagaaagtaatgaacactgtcaccttggttgtcatgtggtgaactgcatgtattggttaataataatcatacattttcagtcttgatttgacaaaagcaacaaagtatcttttctctcaatataggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggtaaggctaggaacatgattctttttttttttttttttttttttttttgagatggagtttccctctgttgcccaggctggagtgcagtggcacaatctcagctcactgcaacctctgcctcccaggttcaagcgattctcctgcctcaccctctcaagtagctggatttacaggctcccgccaccatacccggctaatttttgtagttttagtggagacagggtttcaccatattggccaggttggtctcaaactcctgacgccaggtgatctgcctgccttggcctcccaaagtgctaggattacaggcgcgagccactgcgcccagctggaacatgattcttaaaaactacagattcaattcagctttaggaattaaaaaaaaaaagatttgatata

SEQ ID NO: 126837 - DNA, 1813 bp, Homo sapiens
ttcttctccctaaacattctattcctcattttctttttttatttacctctatactgaaagtgaattattttctattagcttaaaaatgaattttctatcagctataataggaatattttgtctgctttttttgagacagcttgctgagtttagtccaaatagtcttgtgttttctgttatacccaatttcaatttttaacttgaattctaattttttttcttgccatttcaggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaaggcaagttgttcagtgtgcttttcggttctattactttttgtcaaatttataagttttatttcctaatgagaactaagaaactttcattgttctttagagcagttttgtattctaatcatatctatttaatatgtctttgtagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggtaatttctaatttatttaatctagttttgtcttggaatagaagtactaaaaaaaatctaaaatggagaaggcaaagcctttcatttttccatttgaattttgtggtttttattatacatgtgatgtgtattcagtaattaccctattta

SEQ ID NO: 126838 - DNA, 2426 bp, Homo sapiens
ctagctctaaaacaaattgcacctgctgagcattcagtaattattgttggatggaggtaactgagtagggagttagaattaaacagtttactttagtaaggaggtgcaaaatcttaattcctattaattggttatagttgatggtttaattttttaatacaattaatgatttcacacgaataatatgaagattaaagaactctgattgttgcccacatgtttatttgtagtaatggtaacatttaataactttattgagtattgcagatggcattgtgccaactgctgataactcagcagttaataagacagtttctgctttattttataattttgattaacttgatgcttatatttgtagtgttttgcttttatttctgatgcgaaattcttccctaaaataatagtattcagttcacttgcttgaagagatttgaatatatgtaattttgaatattttaccttcagttactaaaaatatttttgtcactttcagcatatgaaacactctcagatgctaatagacgaaaagagtatgatacacttggacacagtgcttttactagtggtaaaggacaaagaggtagtggaagttcttttgagcagtcatttaacttcaattttgatgacttatttaaagactttggcttttttggtcaaaaccaaaacactggatccaagaagcgttttgaaaatcatttccagacacgccaggatggtggttccagtagacaaaggcatcatttccaagaattttcttttggaggtggattatttgatgacatgtttgaagatatggagaaaatgttttcttttagtggttttgactctaccaatcagcatacagtacagactgaaaatagatttcatggatctagcaagcactgcaggactgtcactcaacgaagaggaaatatggttactacatacactgactgttcaggacagtagttcttattctattctcactaaatccaactggttgactcttcctcattatctttgatgctaaacaattttctgtgaactattttgacaagtgcatgatttcactttaaacaatttgatatagctattaaatatatttaagggttttttttttttgacaaattcaacattcaacgagtagacaaaatgctaattatttccctgattaggaaagtttctttaaaaaacacgtaattttgcctagtgctttttctctacctgcccttgggctcactaatatcaccagtattattaccaagaaaatattgagtttacctgattaaactttaaaagttaattgtagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctcattctgtttgtaaaaccagccagtaatttctgtgcaaccttactatgtgcaatatttttaaatcctgagaaatgtgtgcttttgttttcggatagacttatttctttagttctgcacttttccacattatactccatatgagtattaatcctatggatacatattaaaacaagtgtctcatacaacattgtatgtgagagaaatataaatatttacaacctgatattcgttgttgttttattgttaaaagtttattatgcaactctggaggtatagagggcatataagctatgggacatatgctgatcacaggctatattcatgaagttacttttgaccaacctgaaaactgataggattttgtttgtcatttggtaatttctactgcattcttaccatccttctctcacaaattttgatagcttgaagatctttttaattataattttgttgtatttgtttcctaggagcaagtgttcctgctgccagttctttcctctttaggcgtggttgagaaaaagcagaaactttacataaagctgtatttcttaatcatctttaatttgaaacttaagaaaatgaatttattctgttatatttatgtaacttatttcctggaagttatatctactagttttgtttgataata

SEQ ID NO: 126839 - DNA, 1659 bp, Homo sapiens
tgtttttcttagaatgtaactgccttccttctgtgtttaaagcaagttttgattcaactggaaaatgtagccttcgagaccacattacctagtcataagtgcaacacacttgtactcactctgagtctcaatgaattcccgtgcttccttgatccactagacttccgcgctcatggagcaatgctatgtgcaaatggaatgacaagaatgggagagcacacagatggtgcctactcaatctcctctgcttgcatacatagtctttgttaaatcagacatataaaacacagaatcagttgcagctttccttgcatcactgctgggatgaagctggtcctactgtagggccatgagcaggtcattaggcaggtgaagtataactgtgaaggagacctcctcttcaccgtggccaaggaacctatcattaatgcatgatactctgtgaatggtgagaggctgggcatctacatgggccataccagagctgtgtggtatgtggacgctgactgggacaccaagcatgtcctcacccattcagctgacaaccatctttgggcctgtgaaacagggaaacagctggccctactcaagaccaattcaactgtgtggatctgcagttttgactttgggggcaatatcatcacgttctccatggagaagcagaaaagctatcagtgctttgtgagcttctttgacctgcaggatctgagccagattgacagcaatgagtgctacctgaagatcccttgcagtgactctaaaatcactagtgccatttggggctcctgtggggagtgcatcattgcaggccatgagagtggaaagctcaaccagtatagtgccaagcctggagaggtgttggtgaatattaaggagcactcctagcagattaatgacatccagttatccagggacatgatcgtgtttgtcactgcatccaaagacagcacagccaagctttttgactctatgactcttcaacatcagaagactttctgaacagaaagccccatcagctcagctaccctctcccccaactgtgaccatattgtgctgggtggtggtcaggaagccatggatgtaaccacaaccttcactaggattggcaagtttgagtccaggttcctccatttggcctttgaagaagagttcagaagagtcaaggggcactttggacctatcaacagtgttgccttccatcctgatggcaagagctacagcagtggcagtgaggatggttacaaccataatctactacttcaacctacagtactttgaatttttttttcaacctctaccttttatgaattcttatttttttctttttcttttttattatatttaagttctgggatacatgggcagaacgtgcaggtttgttacataggtatacatgtgccatggtggtttgctgcacccatcaaccaatcatctacattaggtatttcttctaacgctacccctccccttgcctcccagcccctgacaggccccgctgtgtgatttttccctccctgtgcccatatgttctcattgttcaactcccacttatgagtgagaacatgtagtgtttggttttctgtgaatgatttcatgtcccttgcagggacatgaataaaatacttcaaatttgagttttaggcataagaagctggatct

SEQ ID NO: 126840 - DNA, 1030 bp, Homo sapiens
ccaatcatgtaggctgcagtttagaagatgataaaaatattcatgcttgcctgcaagctgatgtaatattaattctattaaaataccacatttatttataccaacctaagtaaatgcacataatgtaaaacattcaatcagttgagaattctgtagtatctatgctatctgcctggtagcacttcatgtttttggcagttgcgatatcatctttatggtaatatatataatataattttttgcaataagtgcaattttcttgctatctctctggagttattgaaagatgataaaaaagattgatttgtaataaggttcattgccaattcattggtgtttcctttcctcaagtcataataaatatacttagagtcatttacacatggggccaaatttttcccagatttcagttctcgcacaaagtttgactaaagggtttttctctcgttgcctaaccttatttagtgtctgaggccttctatgctttgtgattgaatgtcaagacatagatttcccactgggtaagataacaaatcaaacaaaagtagagttgagacagcaagctgggcaaacaaacctgtctttacctgcagcaccttccagaagattaactacctgccttatctttttagtctgtctactttgtgctggatcttggccagtttgagtcttttaatattctctttgtcacagtgcctagggactagtgacaaaggagtctgttctctaaagatccttgcaattaattgcacacatacacacaataaattttaagtgagacttgatataagaatacatttaaggcagaaatcttggtgatcttggagttgctccaagggaatcatggaaataaaatgggatctttctccttgtgacagtcaacattttcagcatggccatcatacttccagttaccatctcttcctcacatcacctcctgattgtctcattttttagaacttgttacttcttcttcaatcaatctctcaattctgaaaagaaagaccataaatttaataaataatatgac

SEQ ID NO: 126841 - DNA, 1146 bp, Homo sapiens
cctatagacagggcccccaaaatgtacacctatagaaggccatgttcacatagttgtgcctcagggttttccatttacatagaccataatgtgaatatcagaacttggagttgtactcacctcgtggctctgaccatacgcattcgagttcttgatttctaatctcgtccaagcctcttgtgtttcatgtctggaaactgaagtccatagacatgatgggacttacctaagattatagagcaatatagtgtcagagttagataaatactacttcttaattcataagaacaggtacctgggtcaatgcaaacaccacactcagcagtcccagctccagaggaaataaggacagtgttgagattaaagagtccacccagggaagataaatatcatgccacaaaagtcctgccactgaagtctccacttcccagagtcctacagtcaatctgaggggatcaagagcaatgaattcagctccactgcagtaaatgttcccattccaagagatttgggtacttgacagggaaggcaagggaggcagccatgtcactcagtcagaaagaagagatgataataacttgttccataggttaaaaacagagattatttttcctaggacttccacttggatgttttggtcttcatcatcatagaagaaaaatactcatattatgaagtcagaagtatcttagcagattctgagggacaataaaaggattaactgaccaatggaagagtagccctcttgatgtctttggacaagctggatagggtgactgattatgaggtacactgtgtttctactgaagtatgagatgttgagggacatttctccataggtgtctggtgttatgagaagaggcacttagtcccaaactatcttttcgaggatatttgtagaaagaacacacttggaagatggtgatagtatctccctccagagcaagcagaaagtttatttactgccctgtataataaagataatgtcttctggccaggtgcggtggctcatgcctgtaatctcagcactttgggaggccaaggcgggcagatcacaaggtcaggagatcgaggctatcctggctaaaacggtgaaaccctgtctctactaaaaatacaaaaacattagccgggcataggtggtgc

SEQ ID NO: 126842 - DNA, 1019 bp, Homo sapiens
aactctaattatggctctgaggttacagttgaagcaggcaatagggagatcccaaaatcgagacaccagggcatgatactcagttgagacaactgaatatgatctggtgtgatacctgcattttgtttgtatactgagggggataccctgttgggattgtccagctggccactgagaagataatcaggtctggagatcaggagaaaggataggactggaaatacgaatttgagggttattggcagtgtggtaggtgttgaaactatggtgtggatgagtttaccaagagaaagaatataaagagagcaaaaaaacagaggagacaaacctcaagaaataggtacattcaggaaacagggggattattataaatcagcaaaattgtataatgtgctcagagtgctaggaagataaatagggtagctacttatcttttgcagagaagactttttagcaggtactgatcagcagggttaaagattgcagagggagatggagactaaagacaagccatggaaggtgttggtgacttttaagaatgcagttctgtcacatagtgaaaacagaagccagcaaggtttaaggaatgagtcagtgatcagaaactggcaacatttataatgcagtgttattttgctaggaaaattcatacttccaatggaccttttaactgctattgaagagctgagagaaaaccaagaaaatattgctcatttaactaaaagccatttctttgtgatctgtcacacatgtaatttaaagcaacaatggaagtcttccattcttcttttgttcattactgcaaatgcctctaccagaggcaaaggtctcatagggatgttaccttaatccaaaggattttatttttattgagctcatcttagtatatagaaaagctccttcaaagcccagctttgtgtcagaaaaaaaaatgaaacataacagcaaccacattttattgctattagagatagattttctaagaagaaaattggttgggacaaaattttgcaatcatt

SEQ ID NO: 126843 - DNA, 1095 bp, Homo sapiens
ggccgagatcgtaccattacattccagcctgggcaacagagcaagactctgtctcaaaaaaaaaaaaaaaaaaagagaaaaaggaatgtctcagtgcagatacttattccctcttacctggaatactgagtctatttctaagtgctctccctgctggtagtccatttttcttcttacacatacctgccagaataattttcccaaagcaaatctcatgtcactcactacttagaaacctccatgcttctctattagctgataaatacagtccagatttgttagcctggcattcaggtaccagtctggacagagtcctccttgccagccttactgcttatggaaccccttcatgcatgtgacatgccctgtgtcttcatgtgcttttccctcttttcattcaccctactctgcaatcactcagtaagagatggtgcaaatgtttatggagcttttactgtttccacttttgaaaagtggtttctctttcttctgaatgatcctgacatgtacatttacctctatcatggcaaaaggccgtcctctgaaagtcacagctgtattagagtgttagcttttggagacaaagacttcagtttattaacctgtgcagttcccacagcatatgtcctctgtggaatctgtcattcatcttttgtctctgtgctctgcctccttaattggagactatcattcttaatggtctgtcggactaggctgtctgagtcttcctttcagaattctgttgctttggtgtctctctacactattagtctcaggaagcaccctacattatgctgctgccctgaggtttgggctgttctagaagcatatccttttctatcagggactgccgctccctcctctactctccccttccctgccctcccgcttctatctttttaaaaattcaattaatttttttaacctttgagactatctttattattctcattattgaggggaaattcaaataacataaaattatccactttaagtgaacatttctggctgggcacagtggattacatgcctgtaatcccagcactttgggaggctgaggtgggaggattgcttgagcccaggagtccgagacta

SEQ ID NO: 126844 - DNA, 1024 bp, Homo sapiens
atctcactatgttgtgcaggctggtctcaaactcctggctcaagtaatcctcccacctcagcctcccaaagtgctgggataacaggcgtgtgccaccatgacaagccaagaattctttctgtggtcactgttagttaaaattccaaaccatgaataacactgtaaaccaacaaaataatttgttgtgattctattggagattccttcaactactcagtgaggtaaattagccattctttttaagggtataaacatttgagtataaagttaatattttttaggttctcctgtatttgtgttcaggtcagcaatgctgtggtaatcaatgtgtttcagctatgattagtcaattaactctgaatccatctatatctgtttttgtacccagcatgcttccattttagtcataaggatatcatgagatactgtcacatgtttagctgaaatcaagatatgccatgtcaaaacgcttccctgattgtgagtctaggtacctcatcacaaaggaattgaggttaatttggcataactagttggcagcaaactcaggtttgcttctggttgatttctcttcatttccccaagtgctcacagaccatctgcataacaaacttgaatcgaatttcgaccctcatacctttaaggatgtctcctgcacttcttatctctcctcaggctttattgctgtttattgagccctccacctggatcttcctgcccatttgaaacacaatatatgtcaaatggaactcatctgtgctactttttttaactaatgacataattacccatccgtccccccaatcaaattcttattctctttgtcttctacttccagtgagctttccgatacccattttatctgtccctttactctcataccacagaaatgtctcaatgcaagcctgggtgcagtggctcacgcctataatcctagcattctgggaggctgaggtttgcggattacctgaggtcaggagtttgagaccagcctggccaacatggtgaaacccgtctctactaa

SEQ ID NO: 126845 - DNA, 1061 bp, Homo sapiens
catttctggtttagaactcatctcctccatgtcccagggaccataccttatcagtcatgcccttttttgcttcttgaatttcttccttcctttggcttccttccctacatataaacctgcttacatctctcctaacttacaaaaagtgttctcaataatacttcctcctctagttttatctattaataattcctgctctttgacagtatttttgaaggtgaaagcggttttcaacatctccactgcttcattatccatttgctcctctatccatctcaatctgggttctaccaacaaaactccacagcagctattcatcatgaggtttttaatgactttctaattgcctaatccaaggacatcttaatgccactataagtgattccttcttcttgaaactccctttgcatttggttttcataacatcactatcttggtttgtttgttcatttatttaacaaatggccatgtactgtgttccaagtagagtaataggtgctatggatatatacaatggcaagcaatacaagtaccttccctttgggtgcttacactttgagttgtttttgtttttgttttgttttgttttgttttgagacgtagtcttgctctgttgtccaggctggagcgcagtggcgcaatctcagctcactgcaagctccgcctcctgggttcatgcctttctcctgcctcagcctcccaagtagctgggactacagacacccgctaattttttttgtatttttagtagagatggggtttcaccgtattagccaggatggtctccatctcctgacctcatgatccgcccgcctcggcctcccaaagtgctgggattacagccatgtgccaccacgcccggcttgagttgtgttttaaactgagcctttatagtctacttggatgctcttgattgttaaaataaacccttagttgatgccagacagtaatgctctatccgctaccttcttcttcattccaagttgtctcctaggtagacttacccaaatcctctaattatcttattcctcatattcttataacattcagatatttcttca

SEQ ID NO: 126846 - DNA, 1029 bp, Homo sapiens
agcattaaattaaatgcctttgcatattatttaatcttcccatcaacattatgaagtatatattgttggtacccctgttcttcagaagaagaaattgaggcaagctcaggtaaactggctccaaagccagactcaagcttcctgtgctgccttttacaatgttaacagaagtgagcagaattacatgtgtgtgggtatgcaatgcagagcttgttaggtatgtagctgttatgttgacttagcacaacttgttagatgtaattatttgtaaaaatttacctcatatctgtttaaatccactcggtgaagcaattcttttcttacgccttgatataagttcaggtaagtcccatgactttcccagactctcttagataataatactctctacagtagcttcggaggtaagaatacggattcaatttaataatttaaatatctagctcatgttatatttaatattctaatattttttaaagttaaagcttctctccttgaggcaggaaacctgcagtggggaaaggatacttggtctcctctctctttccctaccttgtcttctcctctaccttcaatttgctaacatcagtttctgactcttactggtttggagcactgggagggagaggaggaaacagtgataggaaagttcttccttgataagttccataatgttagtctagcattggtgctgtctgaacttggaggatttttaatatttatttatttatttatttatttatttagagacagagtctcactctgtcatccaggctggagtgctgtggcagagtctcggctcactgcaacttccacctcctgggttcaagtgcttctcctgccccagcctcctgagtagctgggatttcaggcatgcaccaccctgcccaactacatttttttgtatttttagtagagacgtggtttcaccatgttggtcaggcaggtctcaaactcctgacctcaggtgatccacccacctcagcctctcaaagttctggaattataggcgtgagccattgcacccag

SEQ ID NO: 126847 - DNA, 1045 bp, Homo sapiens
taatagtttagaattcagcatttcattgaaatgtgagcttctttatacacaaatcctatataacactatatgggattttggtcatacaagttaaatgtcagaaggcattatgcccatttgcaggaatccgtaatgaaagtaaacctggtctccacttcttggctatgaattagcaaatgaaaagaagtattctgatcaaaggaagccaccgtgggtcatccatacttacctctattcccttttctaatatctaagatcatgttgagtagagtcttctatttaagtaggtagtttgaaagcacattggactaactagattatttgaggtagaaggattccaggtgattttaaaactaattgttgatttacaaaaaagcaatggagtttggaaatatttgcagtgatttctttcattctccttaccttctgctcccccagcatcaaccaagcatttcctataaagcataactgctacaaaggaaaagcttatactccatactccattataagttaaagcaacttcatggaaaccatgataaacaagtgttagtgtggtgacctatgagattctttcctttaaaggacttagcaatctacttaacctcttcttgtatttacttcttcattggtaaaatgaaaggccttatttatttgttccctcaaatctgttccagctgtaatattcaataatctgtgatgtttgtcttactacaaattcaggtttccttctatttcccgctgaccatcaagatacattgtcaacccaacctcttcttttaggcaagctgttttctcttctcttccccacatcccttcagagtttgggggtttcttctttgattggctgaaagtgggcctgcctgcctctaccagtttgtccctgaagcagtaggagatgtgtatcagaggatcttcatgatgtcagaacaaccctgctgccgtagtaatggagggccagagaatccaaagaccctggaatactagacttgaaaacaatagagtgagtgtcccagtgactttgtattgtttaatataatcataacca

SEQ ID NO: 126848 - DNA, 1016 bp, Homo sapiens
tgctctctcctgagtcatcaatattatcctgtctataagatcttttccaatagcatactaacgtgctgtttgttatcctatatattttttaaaatctctgtctctctgcttctgcctccagtgacttcctatttctctccttttcttcactgtgaaactccttcaaaaagttgtctttactcacaactggtgttttttctcctcccattctcttaagtccactccagtcagattttcacccacatcactgtacagaaaccagtcttctcagtgttaataatgactccaagaggctaacttcacttatccattcttcatcctcatcttatttgaccttcagctacattaacatactagctccatccttccttcctccttgaaacattttcttccctaactcctagggcaacatattcttctagtttttcttcctatctcatatttacttggtggttagtagaaatttcaagctttaaatgaatgaaactgaactcatttactacatcactcctacttctacccaagaattcccaatcccacttccttctaccaccttcccctcggctatttccagtgcctgaaattctcttcctccaaacagctgcatggcttcccctccccactttcaggagtctactccagtgctgccttcctaatgaggttttttccgtcagagtgctgacaaaacacagatgacaaactcaaagtagaaaaatttaagaaagatttaacaaaggtatgggcagggagcagagggagtctaggaaggatatgcatatcccaggcctgataaagcagagctgttaccactgctggacaagggctgggagcacttatagaacccggtatatgagatatgggtagacaggcctcccttgagaaaagcagtgacctttgaacttcaactggggatcctcattatgtgtaccaaatcggaagccagagggcaaaggagcccactactacaatccacataacctcctgggacaaagagttcaagagaaatgtggagagcg

SEQ ID NO: 126849 - DNA, 1065 bp, Homo sapiens
gattactaacccattaaccaaattaatagtgcaagcaagattggaagaacaaattatattaaacacccttaagcactttagaagcacccatatacctacagacaatctaagctccatatataaaatattcgcagttttctttaaggaggatttctgtccaacaacaatgatgatagtttaaaatggcccttatttgaaatacttccctaatttactattgccctgctttaaatcaagttactccaatttgtgaggtttggctgaacttggcaggcaaattatgaagtttttataaagatttaagtggtttgtcagtgttatatggtaactattagaaaagtgtataaaagaccttcccatttagtagtgttcaggtgggattttgatgtctggcttctagtatagccagatatttgagatggaaacatttaatttgttgtgtatataacactctttcacaaagatttatcctattaaaaactaatgaacctggaccctagtacactgcccaccgtagggctttgcttgctcagagtaggcactcaatgaatgctgaataagtgaatgaatgaatcaaattcagtatatgccggaaagtgtgtcgtcagggttgaaagttattttcttctccattgaataggaagtgtatttttcatttcttcaggaagctaaaacaaaggaaattccataactagcatattgaaatgttaagcttgttctatcacttgactccattttccttcccccactctcagtaacctctcaagatttctgatttctttttctcaggatgttatcccaaagaaggaaagaaacccaatgtggatttcttcattttcctcctcctcctcctttgctgaactgtgatcacacactaaaagctccatcctgtgctgatgtttgagaatctgttaccatggagctattccccagctcaaaggatggttttattacatatagtgttacaggaaaagagaatggttaaaattaaactttaaacaaatcctgattaataataataggaaatgggagaaatgctttcaaaaacaaatgcagggtggagta

SEQ ID NO: 126850 - DNA, 1142 bp, Homo sapiens
caaagaaagccccgatcccaggatgcgatatcaaaagatcatgactaagagttctctttaataccatagaggaagtctggcatagtggttaagagcacatcttctgtaaccaagtgctgggtacatatcctagacttcaaggttgtataacctttatctgtctcaagttactcatctgtaaagtggaggttataagattacttacctcatagggtttttatgaggattacactttgtaatatgtgtaaagccattagaattatagctggcatatattctgtgttataggagtcttcgttgggttttgtgttgatgtttttcgataagtcctttgagtaactctaccctcgtatgtttagttaacatttaatatgtatcaggtactattctatgtgtgaacatattctagctcatgtaagcttcatggccagcatgatagataggtaattgtatttttcttgttttccgataaggaacttgagacccagctaggttaagtaacttgcccaaggtcacacagctgaaagtggcaaagctgggagtcaggcagtctggtggtccctgctctcaaccaccctgctccagtagctccactgccaaggtccttttcatttgttcagccctgctttctcctgttaagatgagccttgtttttttctcattatgtctcaaagctttattgattagaggcatcaacctgtagcaagaaggccctgggcagctccctcatcccccttactaacagcatcaacactaacgtgtgacttgatcctcctcagtgagattctcgtccaaaccagcagtctcatagtggttttcctgacctagtctcaccctcaacttctaataattctgctgcaaagtcactaaaacagcaaccccttctttgaagagactctggatatttcccgtcagaaccttccaaaggttaattttcccttgacattgccatcattgtcttcccccttttcctgtcaacatttcagtcccctgcccaggccttgggcaggtgaattctgagtatccctgatagaccctgtgagtacagcacaggccccacagagcaagtgctatgtaaatcccaccaggaacaacacagctctgtgggagcaatgttcatgttaattacatggtgattttgc

SEQ ID NO: 126851 - DNA, 1695 bp, Homo sapiens
tcctcaagagattcttacctaagcgagccacataaataactcatgtgtcaaagatgattttaaagacagtacaaaaggtagaaaaataaaatattttatttaattaacattagaagatatgttcgtgacagtacccgtgctaaaaaggttgtagcaatggttatttcatttatttcttttatagccaacgtgtgttttcctctttctttaaatcaaattcagagtccagatcctttactaacttcctagttaggcagttccctaggaactttactcctgtattttccttactattacaatagtaacaattgttatcagcatggcacatggatggctgagtaagatcctgccaggaaaataaatattaactcttttaacctgggtaattttagttaatccctggtagaatatgctgcggtgtcctagggccctgcaaggtgataacacccctcttaaatagtttttccttgcttaccgtaaaagttgggaagtactagataagccatctgtctgttcctagaaataccacaaatctgtgcattgtagactgttttgctacacatgctgtttggagtttaagaactagctacacacagtagcacatcaccaaaaattcccctgagtcagaaatgcctttctccccctgccagacctcagttcaagtcatgtttttctcgataactaaacctccattgttcaaatttagtaagaacagtgcctgctgacccaaatttgctttgcctccattggtattttttgataacttactatatttttcaggtatagaagatgtttgaatgaaaagacaattatttacactcattgcatataaaaataactttgatttcattttatttgcttataacaaaagctataagaataactagtagaatctcttcctttatttgttacttatatatcagactgttgtaaagtggacaaaataaaatgactcttatggccagtttgtgctgggactggtttgtattgacttctgggagatggttattaagttttcagttttttgattgattgttaaaatgtagccatgattaaaagtcaaattttataaaatcgttacttataattaaaggtaataaatcctcaagacttcgctttctattcatgttactgcattttactactctacatggtggacaaaatggtataacactgagcaccacttcccagctggatgttcaatcattttaacccgatgacttgattttggccatggtgagagaatttgcaccacaaaataggcagacactacaaatcagcttcaccacactgaaaccaaagtgttaaacattttccaacacaccacttatagctgaatagtatttggaaaaaaaaatagatgctgttacagttctagggccacatatctaaaatgatggttcttaaagcacctgtgtttctatcctctgcttaccttattttaaaatgtaatttctttggttccatccttattcttctcagtaaggttctcttgtccaagtaattattgtatacactaaaatttaagagcagctgtcctagagctttctgaaatatggaggaataaaaataagtttgctctattttagtttatttttacattgaaaaagaagctaaattctggtggtaatagtaatgctacagcaatgagaataaaatcattcactaacttacaacagaagtaaacgatgatga

SEQ ID NO: 126852 - DNA, 1047 bp, Homo sapiens
atactaaagtaagtactaaaactgtcagaaacacatagcaggttagattcttatgctgtttgtttattttttcccctactgttatttttaatttaaaatagtcatgtgtattgtctcactttgatagtctttctgaggattggaattgtaccatctaccttaggcttaaaatatgtttgtcataagatataagcctagtggatatctcagaatctctcttttatgtgtacatctggatttaaatgctggggagacattgaagtaaggctgagaggaggccagatcttcctgccgactagaatagcccattccaggtgtttattgggctgactcggctagcggctaaattaatcttcaggtctcagctcttacaaccactactgggttataaagaaactaggataaacttcatattcaaagggaaaggctttaaattaattgaagaaagtgatcattctctttcttggaaaagagaatttgatttctattgcctgttaatttttcaaagaagtttaagagctgtatagcatatcaccttagacatataattataatgaaactttatatgtactttttgttattaaaataagtataattaggtaggctgacttcccttataattatctccttaaagttttattttaggcacagtctgttgttaatagtttatatgggtctgttttattttggatgaagagttttgacaattcataacatattgtcaggtaaaatccatttatatcttgcctaaattatatctgaacgtaggaaaatgaatattttagtccattttggaagcatattctatgcatggttttcttggaaaaatacaaaatatctatatctcagaaaaaatatactgactcaatattgagtagatatttgatgaaaaaaataagaataccatatggcaaattagaatttggtagtttattttttgccatttagaaattagagaatatattttaatattcttaactcaaaaaagcattgcattttattcaccttaaaaattaatttaaaaatctgaattgtggagtttacatt

SEQ ID NO: 126853 - DNA, 1050 bp, Homo sapiens
tcccatatttcaacatgtgaacatttgataatggcatttactgacatgatttagtcctgttgtaatagaaacaacatctgatttgagctagaaagaacagattacttaaattgtgacttaagaaccagctctgtgacctcagacaagtaaattatttttgctgacctttagtttcctcattgtaattgaggatgttggtacctacttgataaagctattataaaattcacagagataatattaatattaatactgggcttcaatctctagcaataagatatagggctccacaatgacaaaactcagcttattagcatgctatcattttccctattctgtatggtccctgatagctgagtttaagctaattagacccaagatagaaaacaaagaatcttgttaacattatacacctcgagatcctgttcctgctccaacctcggtgtactcaagaacgcacatttccagctcatatcctttcaggaaaaatcataataatcccttacttattcctcttccattgcctcagcctacacactaaaatttatttacttcattattttattgggcttcaggattgtggcattttcttcagtttcattttcaggatcttttctgatctttctacatccctgtcctttgaatctctattcttagtccaaggacacagtaatttctatgctcctatgcccatactttacccaaggcatgtgatagttttgtacatagctgaagatttaattgacctctaagcaaagagtttctgaaggatctggtggtgtaagacaaattgatacagatttatgtagctgagtgcctagcacatagtaagtacctattaagtgttagcttaagctttgggtttataagcgttccttatgtatttttttaagggacctaatatatgcaaataaacatgccctgaagagactactgtgtcaaactgcttgacagaccatcaaaaacagttacaaaaaaagtcttaaaaaggactaatgtggttcatagaggtgcctttccatctgtcccccacctctaccaataaggctg

SEQ ID NO: 126854 - DNA, 1062 bp, Homo sapiens
tctccagggtggggtccaggcattaggattttcaaaagagctttccaagtgatttcaatgtgcagctaagatgaagaccactgcatgaattggagacctcattgagaggttttgtttttatcctagaaccatgatacatctttaaagctttaagcatggatgaggggtgatcacatttacattttttaaaaatcactctggtgaaagcacagagatcagattagagggaaatatgatagatgtaaatgttggcagatccttttagtggcttgggcagtagcccagttcatggatgatggcttcatggtagatgaagatggaatcaagagttatttggaagatgaaaggtcttgattacaaattgaatgtggaaggggaggggaggaggtgctgttcagtgtgatggaggatactgcaagtagatgcagtcgttacatgattttttaaagatcaaatatatgcaaaaacttgtcatgagttttgagaccatgcagacagatgcattaaaagtaaaataaggtctttccattgctgaagaagtccataggttttgctatcgagtatttaaattactaactgtaacactgacggaggttaggaattataccaatgatgaggaatattacttattgtattcttgttatctagaaagtaagtcatccaaaggaagggcaaattggagagtaattcttttattgtgggttcttgcatgacccactaaggtccttctgaagaaaatatttatttgtgccataaaagacataaaattaatagtacttgatttttaattttaatagttataatgaacttaatgataggctagtccaatgtctttttatggagggaccaaagctccatggggtttaggaatgtgttcaggtcacatggttttcatttctccacactacaatgaacttgttggattatgtgctaacctgttctctgtaaacctttgactccttagagagcttgcttctccacatttacatacatttctgcattttcttaaacttctatgtatttttcctcttcttgtattgaaaatacaatgtaacctgagac

SEQ ID NO: 126855 - DNA, 1127 bp, Homo sapiens
gctactttatggaaagtgtttagagaatacctaacaaagtgactcatgagtagaagcctggaggaaatgaaagagtggccacataaatatttggggtaagtacattccagggagaaggaatagaaaatgcaaaggccctgaggtatgagtgtgccaggtgtttttagggaagagcaagggcaccagtatgcctaggatgtaacatgtcaggcagggaggacggtaggaaataaggtcagtgaggtggtggaggctcagaggatgaagggccttctaggccattaaggacttaagcttttaatctatatcataaaggaagccattggacagttttgagcattgaagtgacataactgatttatacttttagagaagtactctttctattgtgttgagagtagacaataagggagggaaggtgaaaacatgaaggctaagaggctactgcaatagtccagacaaaagatatgatggtatgaagtcgtaggatcctggatgtatttcaaagaaagagctggacttcatagggtttgctaacagatttaaggtgggtatgagaaacagggagaagctaaagatgagtacaagttgttctgagcaactggtaaatctgttccatttaccatcatcataacaaacttagtgtcataaaacagccatgttattttactcacatgtttgataggttagaaattcaaatgggacacagcaggggcatcttgtctgttccctctattcgacaatatctaaagccttggttgggaagacccaaagcctggggttcactcagtggtgagagactggaattatctggaagtgtcttcattcacatgtctggcaattgatgtttgcttttagttaggacttcagctagtttgtcagctggaacacctacacacagcttccccaggtcgtctttccaggcaagtgagtttggacttccacacagcacagcagctaagttccaagactgactgacccaagagagccaattggaattgcattttcatgatctagtcttagacatcacataactttacttccactattctctatggaatgagacagtcacaaaggttcacacggaatcaaggataggaaacagatgtactaccatttgatgggag

SEQ ID NO: 126856 - DNA, 1090 bp, Homo sapiens
accatgttgggcaggctggtttgtacctcccggcctcaagtgatccacccacttcggcctcccaaagtgctgggattacaggtgtgagccatcacgctcagctggataagttcttcaggggtgatttctggatacattttgaccagtttctccccatttccccaactgcccaccccagtaaccaccattcttctctctgtttctatgtattcaacttttttagattccatgtgtaagtgagatcatgcagtctccttctttctgtgtctggcttatttcgtatagcacaatgccccccagttttatccatgttgctgcaagtggcaggacattcttttttaaggctgaataagatttcattgtatggttgccaggggctgggggagggggagatgactaggtggagcacagaggatctttaaggcaccaaaactcctctgtatgatactataatggtggatacatgtcattcattgtatgtgtgtcaatagaatgtacccctagaatgtacaacattaagagtgacctttttttgtaaactgtggactttgggagataatgatgtgtcagaaaaggttcatggaagaataatcaatgtaccactgcagtgcaagcagcgtgaaagacattgttagtgggagaaactgtactgtgggggagatcgaagtatatgagaattctctgtgttttctgtccaattctactgagaacccaaagctgcttaaaaaataaagtctacttaaaaaatttttttaaaggccagaaaagccggatgtttagtctcagtgactatcaagagatcaaccaagtggcagggtctggaaaaaacttacagggtttgatttcatacagattttaatttctaaactagtactgaataagacttagagaagggaaaaaaatggtatcaactcagtacctgtatgccagtcctttcacatttatttccatttaattctaactctaggaggtaagtatgtataatcccttttcatgtaagaaaattagattctgagaagttagattattagctaaattcaacaagctaagggtagagggtgcacgtgtcaaacctgtctgcctctctctg

SEQ ID NO: 126857 - DNA, 2104 bp, Homo sapiens
cactgtaaagtctgatcatttattgtagtgctgtgtaatggttagaactgagccctctgagccaaactgcctagattctaatatcagccgttgactatctctttgattttgggcaagttatttaaccttttttataagacagaaataatcagagtatctacctcacaggttgttgggaagagttaaatgagttagtgtatataagagttaaatgagttacctcttgggaagagttaaatgagttacctcttgggaagagttaaatgagttagtgtatataaagcatacaggtcagtggctgatgcataatttaggtctcagtgtatattagatatttttacaatcatcatcagagacagtaacatcataagcatttgtcattaaccaatggaaacattttagtggagggagattggagataatcatattggttttatagatgaggaaaagagagctcaggaaagttgaaaaggtgtgttcaaggacgcataaatatctagagaaagatggcactgaggccccaacacttcttagttcggtgtacttcctaccaccccttattagggtagagtctgtgccatcatgagtaggttaaccaaaaatataatttgagttgaaaaattatgtatgccttatagacaataacattgcagatattctcctttattgataaatttgctaaaggtcagaagtttcctctttacagatgttagatcaaatttagcatgaactgttatgggtgagtgggtgggtgggtgtgtgtgtgtgtgtcagataatactcataatatgaaacatatatgttcagataatacttactagttactgtgttgcagttgcagaccacccagtattcaatgggaaacaaaacaccgatattccataagctactttattgatatagcttattttataattttctttgtgatttattaggtgaattaaacacataagaagagattttcttgttttgtaagtttatgatgcatattagatctcagggtaaagttattgaacattagcacatatgcacacaaaacactgtgataacatcacagaatatttaatgatacttgagtttcacatattttcacctgcaaagcccagagcatttcataaatatgaatgctgttaatcaaaaatttgaataagtagatggattttgtattgtaccctgaagataagtagatttagattcttattgaatttatgtcatctattttaggagttaggtggaggtgataaaactgagcctagatttttatcatctgccataataagtggttccaaataaaacattttagaatgttaccagaaataaagagttgctagattgtcatactctagatatgaaaaacaaggtaaatatggaaaattaaataaaacaaaatgaacagcatgtaaatattgtttaaaagatatagagaaattaagaaaaaaggtatagtcagtttataaaacacgtttgtattgtcttgtttacacacaccatggaaatcaatagttgtagttttacttgaaagatataatttataatgattatttaactaggaatttcaacttcttccttttaattcgtattattatccattttccccattctgagctcctctagctctaaaattcacatgatgttctacagtgggacattttgcttagtaaaatcattggggcctaatttgctaaaagaattcatactgtgtggtttaagaaattcatagtgagtacctaacaattacatgttgctgaggtcatggtttttggaactttgtgatagtgatggtttgggtttgcacagaaaagtaagtggaagcagctctccaccagcacacttatgggatcactttcattatccataccctattttaattagacatcctgggagttcttcacagttttcaaaatggggacatttctgcacttcagccaaaatatatgcatcacagttcatgtagggtaaagttcatatcatatagaaactgcttgggcttgaaggcctttctcagttccatcacagcctcattctctcccagcctccgaacctccccaaacactaagctgcttctcttccgctgtaacctatctttaccttaccatgacttcca

SEQ ID NO: 126858 - DNA, 1033 bp, Homo sapiens
tcggaagcagttttaaaaaaaaccctgctgggacctttagcttcaattagggactttcaccgaagcctctaacaagtctgagagcactgtttgttttaaagcactaaacactttagacttcacctggaaagaatacctgggtacctctgaataaatcagtgaccccaaatgtctagagaacaaatgaagattctgcagattctttccctctagtattttcgtcaggccagagcattcttcttttagtgcatggttatttttatacttgctattgcaaccctttattgaaatatttgtaacctctcataacagcctcttttgataagtttccatttcggttttcattttgcaaatgagatcttatttaccaagttggctgcttgtgtcttttggctaaatatgcagcatattttaggggctataacaagatacgtttgaaaggccaataatttgttattaccatatggtagaaagaataaagaagttttctcaagattcccattcccaaattgtgtaatcaaacactcacccagatacttatgtgaagggactttggagacagaattaagtttaataattctgaccttaaattagataaggaacctgaatgtttctaggggagggggcaatatttaatgtaatcacacaaacccttaaaagcaaagcaggaaaacagaaaagttagagagaagctgttgaagatggaggcagaagaaagatgaggtagaagggaaggtagagagatttgaaacatgaggattcaacccactgttgccaactttaagggtcgaggaatgcaagtggcctctagaaactgagaacgaccccagtccacaggcagcaaggaagccagacctcactccttcagctacgtggagctaaatttgtccagcaatccaaatgagcttggaagtgaactctcccccagggccaggccagcagacactttaatttcggccttgggaaacccagagcagccagttctgacttctgacctactgaactgtgaggtaatagacttgagttgttctaa

SEQ ID NO: 126859 - DNA, 1656 bp, Homo sapiens
ggcatctgaagcaaaaaagaaaataacttagttgatctagttctcattgtttacctgaagagaactttcatattcatctcagaggccttcatgaatcaggctggtaagtaaatgagagaattgactgggcataaaccaaagagaatggtacagcttgtgtttgccccattcaaaggagtttgagctaaagctaagcagaaaccaaaatctttttcactgactaaataaaaccaaagggctgagatgcacttagacagctgagttaccattgaaatacaggggaaatttatcctgaatttgtcatattaggccttctgtaacatgaaatgtaatgtttaatatgcaagttattttatttaaaaaagtcattgctttaaatcgtcttctaatattgaacttctgaaaaagctgaaagattaaatttattgttttgcctcagtgaatgtactatgaagtctctaaaaatcagccatccccccagatggtctaagaatgcccctaggtggcaagacataattaaaaatactctaattttgtgattaaagctctctctctctttttttttttttttttgagacgaagtttcactcttgtcacccaggctggagtgaaatggcacaatcttggctcactgcgacctctgcctcccaggttcaagcgattctcctgcctcagcttcttgagtagctgggattacaggcacccaccaccacaccctgctactttttgtatttttagtggagataggatttcaccatgttggccaggctagtgtcaaactcctgacctcagataatctgcctgcctcagcctcccaaagtgctgggattacaggcatgagccaccgtgcccgacctcatgattaaaactcttctaagagctccactttttcttgttctagaatgaatatctccagcaatgcaataaatgttctcccttgcattaaataggaagcaaggccataatatgacaattaattacatcttatgtatgaggtagaatgtggcagaggggagtgaggcattactgatcaccagtagagttcccagaggaaaacatgtcaggagctgtactggagggagcagggaaacctgccctaatcctttctcctactggcctggttacctaaatgcattctcagaattagaaaaactcatcacgacttctgtgtctatttctatatgtttatgttattcatatgatcagagaaacctgaattctccctctgcattctcatactccagtaatttttatctctgtgatagcagaattcctatgaagaattctaagtttcttggtggtacttgtgaacaaaagaaactttttattattatcactatgtgcaaaatgcctgtccagggttaagtggtgatccatgtgacttaaattcagttctgggtaggtacatagctcgagacttgggcttcacaacgttctgagttcaccaatggtcaccaggccaagtaaagctacagaaaagctaggaagcacgccaccagcaggccccttttagattgtgaaaaatagggaaggcaggcttgtcagctgaagagagtggtctatgactactggctagaagagaaggaatgtgtcacatactgggacgtcctgaactttagcatggcttactttgctaagatgttatttagcaaaacc

SEQ ID NO: 126860 - DNA, 1116 bp, Homo sapiens
agatagacacatacatacatttttgcatattccccacccttacctctttcttgctctttctccctttctgtctctttctctgtctctctgccttttgtttccttcccctcttttctctctctttcctcctcacctcctttcctcccttctttactctttctccctccctttcttctctcctaaactggaataccatacacatattctgtaacttgcttctttttatacagtgtattatagacattgccttgatgtcaatacctgtagatgtaatccattccttttaatagttgtataatattccataatatgaatgtatcatgttttatttaatcatttctctattgatgagcaggttgtttttagttttgtgccattactaacagcaataaacaaccttgtacataaatacttaggtattctgcctttaatttttatgaaaaatccctgaacttgagattactgattcaaaaggtatcttcacctttaaatagtaatggaccttgccatattacttttcagaaaggttgtggtaattcacatggccatcagcagtgaagcagaatttctctgcaccctggggatccttattagttctggatttatcagtctttaaaattgttttccaattcaattggcaaaaatataagagaatttcattaatgctttatgtttcattataccacatcagccacctaaagcacaagggcaaacaaccaaaagcctagggccacagaggtttctaaggggattttttaataacttatgatgcatgagagaattttgccatgtgtgtttatgaggtgtattagtctgttttcacactgctgataaagacatacccaagactggcaatttacaaaagaaagaggtttattgggctttcagttccatgtggctggggaggcctcacaatcatgatggaaggtgaaaggcacgtctcacatggcagcaggcaagagaagagagcttgtacagagaaactccccttttaaaaccatcagattcgtgagacttatttactgtcacaagaacagcacaggaaagacctacctctatcattcaattacctcctactgggtatcttcctcaacacatggaaattccagatgagat

SEQ ID NO: 126861 - DNA, 1285 bp, Homo sapiens
gtactgtctgaaaccatttccactgctatcctaattgctatcctaattacttcacatcacgacatacgcgctcagtgcctactctctatagaaagttgatggaagaataaaagctcatgaacacacaatctagagattaaggtgtatacacattattttacaaaagctaaggtttttttttctgataaaactaatacatgtctttgtttacagaacaataccaatgaatacatatgtgtataaagtacaaatttcaagtcccaccagaacaaaccattttggcctaacatcatgattttttgtgcatttgtgtatgtttgtgtttgtcttatttctatgcctgtataaatgtgtttgtgtgtgtgtgtgtactcagatatatgcgtgtgtgtgtgtatgcaaatgtaatcaagttatacattttgtttaggaactgcttatgtgatttattatggacatgttcccatgttgttctagtaatcttttgctgcataaccaactcaagatgtagttgtttaaaacagcagtatcttcagtctttggcagggatcaccagggacagagcagctctgctccacttttgtatcatctgggatggctcaaagtctgggagctggaaccatgaaaagacgttttcactcatgtttctgacaaattatgctggctgtgggcttagatcttagtttagtctatcagttggaatgcctccacttgggctctctatgtggccggggtttctattggaagacaattctccatgaatatttcatggttctacatgatccaggccctctgaacaaaggcatttacaataacgtttttataaggagacattccaggatagtgaagcttagagacatctcccttcctggagacagtccagggtagtaaagataaaaacctgtcctcctccccagatttgcttgcattccagaatgaagataatgtttctctttctcctgaagggaggattggcacatcatcaacagccctatagaagatcaaaaattttctaatttggggatttctgttttataatgcaccccgttgcatgtgcaggtaccattctggccatcatgttgccctgcaaggacttgggcttagaaaactcatgcaaggtgttgttcttgctgtgagtaatgaactgtatttgtctatgactcagaggcctcatgtttcttgtgtgtatgtatatgtatgtgtgtgaatcaagcaatattcataattttaatatggatgtttatggctatatatgtgtatacatccatccatccatccatccatc

SEQ ID NO: 126862 - DNA, 1168 bp, Homo sapiens
aaaagattaatacaaatgtaattgaaaggaagaaagaaatcaaagagaagggcagaaacaaatttgcttactgtgagacgagttcagctgtagttaggcatctgtttggttatgagcttcctggcagcctagtagaaagtggagttattatgaataaaagagttttaatatcagaaaagcgaatgtatatcatctcttacaaggcgatggagttaatgctgagtggtgtactagcagtgtctttttaatattttttaacacaagcagaaatcacatacttgttttctgatagttatcaaaataaattaggactttaaacattgaaacccatcttaatcaagcagatgcttcaaataatgaagttgtatgaatatccacagaggttaaatgctacccaaatatagaggagcctcaagtgcctcaggactgactggattttgaatcccttaaagtggtatttgagtactcataagactaataaagttcttgttaaaaatacagattgttgagctctattcctggaatttctgatttagtcagtttgagatgagatccaggaatctatatttttaacaggtacctaatatgattctaatgcaactagtctcagtagcattttgaaaatcagtggcttgggctctcttttttcatatgtcttttatgttagtcaaatttttcttaggaatcagatagaatagtttaataatatacaatctgaagacagcctgcagggcaggtgttttataatgctgattaaggggagaactatacaggatcacacaattggtaggacttttattctatttatgcaaattatagagccagactggtatgctaggctagacaaaaggccagccccccataggtttcacctgatcaagaccagatattccccaagaaagaattttgagtttgctccagtacttggattactgatgaattcaaacatcaagttagaacaaatcagacatagttttgtgtttgaaaatccttagagaaagtattatctatggcacacaaatagctatcccaaaagccttaatgatgaccctttgcaggtctccagatatgcctgccaggataagtgagctgctagatgttccccagacaattgaacacattgacctgttacatggtgctatttaatatcgatcagatgaatgtcaga

SEQ ID NO: 126863 - DNA, 1997 bp, Homo sapiens
cctgggcaacatatggaaatctcatctctacaaaaaacataaaaattagctgggcatggttgtgcatgcctgtagtccctcctactcgggaggattacctaagcctggggagtttgaggatgcagtgagccaatattgcaacactgcactctagcctgagtgcagccgacgcaagaccctgtctccaaaaaaaaaagtttgtcgtcaccaaaaagcattatattaatggaaaaatgtttcattttctccttctaatggaaattaaattagcaaaaattaatttagcttatttttcttctctctgtcttacagtagatctgtctctctgtctctgtctctctgtctctgtctctctctctctctctctctctctctctctcacacacacacacacacacacacacacacaaactgctggtggtagtcattcttttacctcttggctttgagataaaacaaatacctttgaggaatttttaatttttttaatcagtaaataatgacattagtatttttgaatagttggattcattacatacatttttatccattattatttgactagatccatctaattgtgactactttgctttcaaaattgaaaggattgccctgactttatttttaaaagaaggaaatttagttaacctttgttttagttttcttaggtttccttttttccaaaatggctttaacacaaaaaatgtaggtggattcacctgcaagccttgtgatttgggagctgttgatgacagatgtaaagggagctataaatttaaactctataatttgtgaactgtcagtatagttgcagcatcagtgcggtatacattattgttctccaattttgtagagtatgagatgagcagtaatctagttatatgaatctcaaggccaagattctgataatacctttattgtactaactataaattatagacaaacatgcttgcagagaataagacattttttcttcagcttcctgaaagtatagaatttaagatatacttaagttctataattgtatctgtcaacattcaattggtcaataaaaggtattaccatcaacatgacattgccttttaagtaatcttaagggctccaagaatgtactacatacagagatatctctcaataggaggtaatattttctatgaaatttattactctagtcatagcatattcacgtgactgaaatattttttaaatcttaggataaatgaaaaatttgctatttataagttaaaattaaatttttaattatcttgtattttcctcttttttccaattcagtttcttggctttatatattccacaaaatggaatataatgctgccccacagttgatttgtttattctgaccatctaaccattgatgttgatctctacttaatcagttcagaatgaggtgaagctttgattataacaacagcaaaactaaacaatgacacatgtgacaggttggttcatgaattcctcatattaatgttttaggttaaaaatataacatcagtttaagtccagagtagatgagaacaagttttaaaagtacaattcataattttttatgagtatgattgtgaaggatggtctgtaataacatgaacaattttcctattctaggtttagaactaaaaaaactacactttactcctgacaaaagacacagattttaaatttttatttgcacaactgtatactcctaaacaacgtatttttttttttttttgagacagggtctcactctgtcacccaggtacccaggccagtttcagtggcacaatctcagctcactacaacctctgccacccaggctcaagtgatcctcccacctcagcctcctgagtgtctgagactgcaggtacacaacaccatgcctggctatttttgtatttttttgtagagacgggatttctccatgttgcccaggctagtctcgaactcctgagctcaagcagtctgcctgcctcggcctcccaaaaatctgggattacagt

SEQ ID NO: 126864 - DNA, 1351 bp, Homo sapiens
tgcttgcaaactaatgtgtaagccagccattggatcatggattctaacagaggatttaagactcaggtcagagaaaaagggcagtttattactcatagcaacagcagtagccagagtatcagaatttgtgctggttctccgatcccccagtttccacagggtaatgtgtggagggccaggcgttataggaggtgggtcttgaacttcaggaatctgaattttttatatgaggaggtaagtgggccagctctctgctttttagggagagacgtttattttctaaggctgtactcaaacttgctctttgttctagagaaagatatctttatcttccaaggctgttcgctgtacaaatgtccttgaaagtctaaaataaagtaatatgttcacaaaagacctgaaggtcttttcagagatctttataggcactgaaatagtggggaagatttagttattttgagaatgcaaaagtaaatttattttttttctattaaattttactttcagcacagtggctcacacctataatcccaatactttggaggctgaggcaggaggatcacttgaggccaggagtttgaggccagcctgcgcaacacactgaaaccctgtctctacaaaaaattaaaaaaaaaaaaattagccgggcctgggagcacatatctatagacacagctgctcggggtctgatgtgggaggatcgcttgagcccaggagtttgaggctgcagtgagctatgattgtgccactacactccagcctgggtgacagagcatgaccctgtttctaaaaaaaaataaaaaatgtataaaacaatatgactttaaaaatctcctctaaagacattctggatccccactggaggattttataaaagtataaaacacagccccatttctaaaaaaaaataaataaaatatattaaaaaaaattgactttaaaagtcttctctaaagacattctgaatccccactgggggattttataaaagtataaaaatccacatgtatttatatatgagtgtaatatgtgttgcttatccatacatgcacacagtttatttaagaaaatacaggcatgctagagatgtcaaaaacttctaatatacaaattaatgttgtacatattagtcacttaaaatatatattttataaataaaccatgcaggtcatgtggacataatttatacttgtaatataatagtgttgattggaattaatatgttttcccatattttctgaatctgctttaggcatttggatattataatagacacatatttggtaaacagattgacaagtttcatatcttctgaattatccttaaaatatttttgtaatttggttaaagt

SEQ ID NO: 126865 - DNA, 1049 bp, Homo sapiens
atacctgaatgtactttgacatgcctagagaatttctgaagaagttctgctttgtatcaatttttagcctatacttaagtatactgatgtccatgttctcctcaaaaaaaaaaaattagtttggagaataaaggtagggttcttacataattttcctcattaaaaatggagctgaaatcaggttaaatactaaaaatgaaaagctgtcttaaatgctgcttgattaatgaatagggaaaaatacagaaggggtatctctacagtgacttcttttctcggggttcatcggtgctgcctacctgattgttttttgaaggagggtgtcttttgtgattaagtcacttgtcagatttgtattgatatgcaaagttttgttttatttaatctatctctagaagctccaccatctgttactaagattcttccagcaggaagttcaagagaatagcatttgtaaggtaaaaatatatcagccatagctagagcttcaaacaatgttttataattaagatatagaactcagagtaaatgttgatgaaatgtagttggtaagagcgaaatgaaggctaacactggagagtaggcaagatgggaaaagctgaaaggcaggaaacatatttacatttctttttgaaaatattcagaaaagtccgtcttaattttatttacttttagaggatgtttaaaatttagtgtttgtcagaatccatcttttcacccattcaattaatacttattaaacccaacaatgaatgaataagcatagttacagtgtgtgtgtgtgtgcaaatgtatgcgcttcctgacacgtataatcttttacaaataatacagaaaataggtaaagtttatctttaaatatacaaattttaaatactgaattaaaaacatgttaaaagtgggtaagaatagttaaatatttgaacatcctaaataatattagacaggtagctagcatgacagtggggaaatatttagatatttagataaatatctatggaatggagcatagccacttaaaaaaggaaggatgtagtcaatggatcaca

SEQ ID NO: 126866 - DNA, 1117 bp, Homo sapiens
cagaacctaaccatgcaggcactctgatcttggacttccagcattcagaactgtgagaaaatgaatttctgttgtttaagtcacccagtctgtggtattttattatggtaccccaagcagactaatacaagtgcatagtgataattatatggataagttattgagtgaagatggtgtgaataaaaaagatttcatctgtgtaaaattccctttaaccaatagtgtatattgaggtatatatatattttttgtacgtgaaaatctgccactgtgtttgcaattggtaattatagcttaaggttcttttaatgtatttcgtgttctttgaacattttgtaaaatacagccatggcagtactgaagcagaactgaagctatgtgtgtatgcttagatttaggaaacattggaatcttccacaaacagatcactaaataacaaacacccaagatttgggatttactcctttgggttcaaggctttgtgtctctcggaaacctttggtaaaatgtaaatatccttaaaagagtaattaacttgaactttactgttatttttccaagcgtggaatactttttaagattaacaaattgtcattttagggaggagagttatgactctgaggaagagcagattaaactagggaggtttcacagtggggaggatgggccctgatgtgctaccaagagtgaagcaatagagggaagagcaaccctgagagagctcaggtggcacagggaagccagttggtactgagttcctggaataccctgtcctctctgatctctgtggcttaaaaatcttccttctgcttgcctcttccctcttatctgaatgttctcaaaccatcgcctttgtgctgttttaaaactcactcccatctccacaaccaactaccagattttatgcgattattcctatctccatttctctttctgtcaccgaggcttcgtgctgaaattggtagttcttttaatcttttcttctcttcaccccaattagaaatttcctaaagtagagtaacagcaaagaacctgaaacctgagccaaaacaacaaatgtaatagatactcaaggataagatttatgatcaggctttgctatgggaaaaaaaatgtc

SEQ ID NO: 126867 - DNA, 1658 bp, Homo sapiens
tctgatttagtagaacttgtgtgggtttcaggaagctgtacttcagcaagtattccccaaatgaaactaatacagttcaaatgcaaggccaggccatgcctcaagaaacactggcttataggggcctatagttttgtctgtgttcacatactgtttaaacacagtttaataatgttgtgaatgcctgaggaagtgggttgtatgtgtatgtaagtgcacgtatgtgtgtaattgttgattaggtggatatagtggaactaactaaaaagacatttcattctaaagattagacgttctcgtttctattgactttatttacaactattgcacttatgtataatctgcccttttattggttgagttttaaaaatgtaattagtttcagatgattttcaaataatctgaatttacagaatcagatttttaattagaaattggatggtagaaatgaaagagtgtgttaattaaatatgtgttttattttattagaaagtttcaatagccccacctgaaattgattctacctggttgattttcctgaactctgggaacaaataattacagtttctgttgcgtatgaccaagtaaaagctgaagaaactatttatatagtaaaaatgagcaccctggtaaaagtgatagcattctctagagaaaaatattcttgtgttagaaaaacttaaagcttccttttccaagagaatattaaaataattggagtctccctcttttttttttgttttaatttttttcaagaaattttgttcctttttcagaggtttctttttgcattcagttcaggaactgttaaaacctggctgttttccagaacaagaaattgattagattgtagaaagaataatggagacaggctagtggattcaaggaaaattgtatgtgtaaaaagcaccagatacaatgcttagtggagtattcttcccattgcaattattcatttaaagacagttgctggctgacttcttatgtaaacagagcaatgcctgcccaatgccagttcatattttcactgttagagattttctaaagatagaaaatgttttagtaatctttgtgtatgtctcctttgcctagcccagggcctgacactcaaaagtttaatgaatgtctagattagactagagcaggttggaataaaatatgtgataaatttgctatgatttgaaccccccagcctctgggcctggatttgatgatcacaattataaaaatataacctactgtgccactttacacttggggtgattgattttggtgcttatcgctaaactagctcaaagggttgtcttcatccaacataattactattcctgtaattactgaatctataaatttcatgcctcttttgtttcaaacagaaaaatgggcttgggaaataagaaaaacgaagaaatccttagtcaaaataatatacaccaggtgttctttgtctcggcttgatttagttagtcttgctcatctaatacgtcatgcttgtctctccgtatcactgaattttcagcttggttacacacacacacacacacacacacacaaacctcacaagaacctggtattcagaataaaaagagctacagataaaaactttttgaagcttgagtttgcgtctctctgaaggtgagctgccttcagttaattgc

SEQ ID NO: 126868 - DNA, 1047 bp, Homo sapiens
actactcccagacctactctaacatgaagttttgcttctgactaagccagttaccccacacagcatttgcagtataattgcacagtgattctgtgtgtgaaaagactgtgaactttgccaaggcaactatgggagctaactcatccttgtatccctgtagcccagaactgggaacagagtttaacagctgtttcatgacacagctaatggccaatttctgcacagcaaaggttcatctagaacagggttcagtgaaatatggcccttgaaccaaatctggcccattcctatttctgtataaaagaagttatgttggaacacagccacactctggctttcatattgactatggctgctttccctctgtaacggctgagttaagtacttgcaagagagacttatatcccacaaatcctaaaatatttattatctgctctttatttaaaaagcttgccaacctctgaccctagtgaattagtaatagataactttagaaagattagtttaggactgattatgtctggctgttaataggaaagtcagaaatttgaacattatctagaagggactaaaaagccgtttacattttggaacaggagagtaataagttatgagaggtatcctggcaagactggtttgggaaaattatgaatgaaagattagattggaaatgggatataggtagaaaatgcaattatttgataatactattggttcaaatgggagatgattaggcattaggcaaaggtggtagtaataaaaatatgaagtagattgactcataagagtccttaggaaccaataattggtttgatgtctgttagattctgctccctcgtattaactcaccacatctgtcagagaaattcaccagctggaatactgaactaacttcatgcttatctctggtgggtcaaaccttaaaattaagcacgagcagcagtcttggctacctgatgagaattgtgctgcctggtaatgattagatttttgtccctgacattgggagtggcaatccagtcttgttcatgactccttaagcttata

SEQ ID NO: 126869 - DNA, 1430 bp, Homo sapiens
tgcattgaaaatattctgcctgtacaatacagaataatcttgtgatacacgagaatgaattttcattgcattttttattgtcgaattgtagcattttccttgtgtaacttctctagagcagctagaatagcttttatttaaaatcagccatttcaaattttaaaaaaggtcattagacagtgttgacaggatccaaatgaagtattctcttcacactttctttgaaaaaatggtgcttagactttaattggttatattttcttgttgcttgtagtacatgcttattctttagaaaattttgataggaactaaaataatctgtattttatagaaaaatattggtaacaatagttttatggtttttgttaataagtcataaagccttaccttgtggtttttcatcaaatgtttctcatggttcccataaacagtgctggaacctggcaacctcacatgctttacctagatataattttcatttgactggtatagacaaaggcatacatctcataaaaagatcaaagccacttaaaggagataccattataatgaaaatatttgtgtaaccaaagataactaagtctcaaaagagagcccattctcagaagctgtgttcaacaccaagaaatgtccatgcagtaaaatgaaacagaaagtccctcaagattagcttcattgtttgttggatttgttgctgtaattaagacatgaaaaaaatatatatgattttaaaaagagagcttggaaacataatatggtggtgaaataaataatgtcacccatctccccaagagaagaggcagtcttagcttccattcctaccaaatcaaattttgtcttatgtcttaattattctgctagtgtagaaatcattttccacatgatttcatttttagatagaagaatgtcagcagaattgtcattagacttcattgctatcacagatactgttcctttgggccgtttaattacagaattaaacacattcattttattagaaatatatatttactgataataggtcaggagccaagatttagtgaaacatatgcaggggttattaatttagcaatttcataagtgcttagaattttttttaaagtgaggttgaagcctttattttacttgtaagatgtaattggtgcctacataactgagtgtacatagaaaaataaaatggaaaatatgaggcgcccataagacaaaaaaagtctactattgaatatattgagattcaaagtttgagattaaattgcctcatttacatggatatatacttataaaatatttgatgggtaattatttactctccacttcttttaataaatagcaagctatgtaaataactttgcaaacaccaaactacgtaaataacgttcttttgactgagctggaagacagctttttttggaaatttttaattttctgaa

SEQ ID NO: 126870 - DNA, 1090 bp, Homo sapiens
ctgcttctcattatctagtgtgtttaaaagcttggatcttcactcattacattttcctaaaggcagacatatctatactttttaacgtatatataagttgagcatcccaatccaaaagtctgaaatctgaaatgctccaaaattcttagattgctgagcaccaatatgatgctcaaaggaaatgttcattggagtattttggatttcaaattttgggattagatatgctcatccagtaagtatagtgcaaatactccgaaataaaaaaaaaatccaaaatttgaaatacttctggtttcaagtattttggataagggatattcaacttgtataagttaatattgaatacctttagatatgtttgtgaaaaaattttatccatatagtttttttctaaaatttaatgtcggtggtctctaataaaataatttctttcacatagtatgagggcacactcctgctgtcactaatggagcagccactttgactcatctttggctgacagtacagtaatagagctagagttggataagcatatataattgtgtggaagatgactttaggaaactactcctacttcttttttttctagttgcaatgatgataataaatactactaaggccttctcttgcttttgaatagtaattattacaaaaatataatctaatttttgtaaggtatactaaaggtgaaataaacagattggaaatgttttaggtcacttacagtatagaagtgtctcttgtgacaaagtttgtagcaactcgcaagtgaaaaagattacctaaaagccattttatgtctctctcatcacagatatgattgggtatgaaatgtttccattgcgtgtgatgtctctgtgaaatatctttatgctaaccctcttgagtatatgatcattgcacaatgatggaaaatgtcctatcgtcccatgatatggatttgccaatttacgactttagtttgcatttctagtgtgataaatatctttcataagtttattttaaaattgtgataattgtctggtagtgttgttcagtgcatattactactggattttactggattatatcataaagacatggtgat

SEQ ID NO: 126871 - DNA, 1051 bp, Homo sapiens
tccaattcaaatttaaccacattctagtgggttcttgtaatgcatttgtatatagaaatgttattagtagataattaaaacataaaaagaagggttaaaaagccaaatgcaaaggtcattcaaaagatactgtatcgttctgtactttgaagatcaaatagtttcataatcattgcaggcaataaataatgagttgagttaacagagaaattattaaaaaataaaattacaagctctataaagatcaaaagaaaagaaagcacatcagtcagttcatatgtcttgattaaagagttgtctttgtggccccgaaggcctaaaaagttaaaaatattattaactctgaaataggagcacaaaggcaggtttcctgagcttcccacctagaagaggataacaaactttattgtaatgactgtgtagattggttgctaagttctttatttaaaaaaaaaaaaaaacaaactcaggaaaaagagctgattttctagctggagagtaccttctgattctttatgaattatatgacaggaagagccagtgtagactcagcccatcagtatgtgccccaactcttaaatctttcacttgtaattttactcacagatggggagcaatctccagggaagtagataatgtgttttatttgttctggcttttgtgtttgtgtttttgtttttgtgttttcttttgcctccccaatctatgcaataaatagcaaactttttagacttctaagtatgaagacattttagtatattacttaaacaaaagtgattattttaacaggcatcctgttagaaccagcatttgagaaatccttagcttagcgtagtgagcagccagttgagggcccttagcaacggcaaaatgaaggatatttccatgaacttgattcatcctctgttcttgccctctaacatttatttactgatgcattcagtctcagagggaaaaaacaaatgggaggattcctggacatattgcccttaattaatactcctagcttttataagttagtgtttgttttcttcttttttaatttctgcta

SEQ ID NO: 126872 - DNA, 1084 bp, Homo sapiens
tgcctggtttgcttactctgaaatggcctatcatgtctagcctccctccctaagcctaaccttaggcttaactgaagtttctgtacttaaaagttccattagtcaactttagtccatagtagtattctatctccttccttggcacatttactgttttaatggtctctctctctctctctctctctctgtctatctctctctctctttctctctctctctctctcctctgtttaacactgatgcttttctaactcacagaagtaagaatcccttcccttctcttggagagtacagatatactttaatgaatggtgggaaaggtaggtagagtttatgagcccactgtaggtagaggatagagatggatgaaacggctagatgaatggagggagacggttgttgttggatagggaggtgctcaactcaagagggcctgaaagtggagagagtttttgttaaccccagagagtagcctctgagagagggaagtaagttcacaaaaaaagactgcagacatgaatgtttccttcttcaaaatttgaccttaatatagcctagcctgatgtttcctgggcaggagaaatagaataatctcacagcaccgttctcgtgctttcactgcattagaagttttctcaagtacctttaggtgaaagtcatgtaacttcattacaccctgccatgctacattgtctggcttataaggtatttattttagggccatcagtcactgaatttctgtgtaaaatgaactcatgtctcttgtcgcagaataagcaattgtttgaactatcttgactaaactatttatttaggcacctaaccaattgattaaataataccactggactaagatcctttgttcttccagcaaagtacagcacagtttggtcccagctcaccactcctgcctcatttcatactgtgttcctactgcctttgcctttctgccactctggcctttcagtttctcagatgcactaggtttcttctgaacacgggatcttggcatacgctctcaatctgcctgaaactttgctttccttgcctgtgtagctctctccactatctcagactaggtcat

SEQ ID NO: 126873 - DNA, 1021 bp, Homo sapiens
tgccactgcactccagcctgggcgacagagtgagactccatctcaaaaaaagaaaaaaaaaactgcattctcaataaatacacactaggaaagtagattctgaagcagcgatttcagaaagggcttaaacatctaagacttctgttgggattcattcgatctagaaatagttattcagctcttattatgtaactggtgttgttctaggcaacgtggacatcgataagaatccccactctcgtgagtctgtatgcaacagtagtgtagggatgtggaggccagaaataggacataaaggcagaccacacacataaataaataaatggtaatggcaagtactctgaagaaaatagaagggggtgtggggctagccattgactggtttcagtggggtaggtgtgcatgagggttcaggtagtcagggaagtcgacccaggctagaagaaaggagtagaagaaagatgtagtcctgtgagaacatagggtctgtatttaaggtagcgagaaaagcaggaccttaaggtgctaatgagattggtctgtctgagtaagggaaaaaggggtcctctggtggatatgaagtggagtgtagtgggagatgaggctagagaatgcactaggatcagactatgtaaattctagaccatggcagagcttatattttactttaagtaagataggaagccacgagagggtttaaaacaggcaggtgacatgatttgattaatatgtttaagtgatcattggcaccagtgtgggggttctgtagtaacccagggaagcaatgatggtgactcgggccagggagatagaatggaaatggaaagaaactacagtagatggagtctggatatgctctgaagaacacgtcaagattagctgaggattagacatacgggctgaagtaaacagaggaatcagaggtggctctttggatttcaatctgaacaactgaaaaatacatggtgaaaaaatgtttgtggagatgaggaatataaggtagagaggagaacaagttagg

SEQ ID NO: 126874 - DNA, 1002 bp, Homo sapiens
gtctgaaactcctgacctcatgatcctcccacctcggcctcccaaagtgctgggattacaggaatgagccacattattttaactttttaaatggttatcccactgtgatatctctggaattagatctcccttatttccagataaggagactctctcagtcaatggtgtagtaatgtagtactactgttttgcccacatgagtatataatgtcagaatgtgttttaccttttagcaaaatatagcattgggttcccttcttttgctgtgtcagaacttcaacagtcttttctgtgtaagccctcttttgctgcacttgggagcttttctaacagcctgctatgttctattgttgatgcaatgaatacagcgagatacccacattttgtttaaagatagtcactgagctgtaccctactgccagcctagatgactgcttaattataggcatgcttttctaaaggacatatatttgttatcttccataaacagggagacagtaaaagtcatttggcttaccttcctagggatgaaggttcaggaaggggagcttcattcagtgcttcatgctgttgtcaacactaactttacaggtgacccaggaaattgtgaagtagttggggccgtagaacagacttcgtgccacagcacaaaaaatcttattacttttttttttattccctgtgtactcgctttacaattttagaaacaactgatttttttttttttttttgcaattttgcattagatcaatggttttaaaaatctggccaaacatggaagctcttgggacactgaaaaacacagatttctggaagtcacttcagaacaacttaattggaaacacccaggaatgcagcccagggatcggtaatttgtaaaagcttccctgggacacaaaaagtcttggtcccatttcagaccagttaaatcagaatcccaggggtgatgccctaggatcaggcattctaaaaactctccaggtaactctcatatataaccat

SEQ ID NO: 126875 - DNA, 1012 bp, Homo sapiens
tgagttattcttcaatttaagttcagcatttggttgtcaaagattcccagtcagttggaaaattataaaatcttcccacattatgttaatatttattgcaagaaacttaactcttgaatgaaatgtaattaattgacaaaaataagtggtgagcttatactttagaagtagaatttattaggttagccaccaaataacctagagcaaccaattaacaaattgttttattaccaacagattctgtacactaaaacaaaactgacaaaacagatttaatattcagttgtgttttttcagcttatttttcagtcctttaactagggtatgatttctttttaaatgtactaaaggatagctgtttcgttttgacaaaaattgagctccccagtacatccataattctgtggaggaagaacaaaaaagcccaatgaattagaatttgttaccacactgtcacaagctaagaaacttgcagatgcattcagttattgaattgagttcatgattttcgtttgtgttcttctgtgcatggactctgaaggaacattacttaatattagatttcactttctcaatagggaagacatacaggaaaaacttgaaaagcataaaggtatttcaattaagtctgctgagaatgaatgcagtaaataaaaccagattgtgatttatttatattactcacaagtttaaaccccttgtctctcattcgacaataaatatcctgcattattctctaaatagaactatgaagcataaagcaaacattgactatatgcttaaatgcattaatataattataagaatttcaaaccgttacttaataactgaagagatgtcttttgtttgtgtaaagcaaaaggatcacagatactgttcattcagaagacctccaaagaataggaagatatttgagaccatctatagttttcccagacagtcacaatagctgcagataaatgaagatttagaaagaaattatgctgagcaacagaagttatatggcatgtta

SEQ ID NO: 126876 - DNA, 1089 bp, Homo sapiens
gaatttgagtgaaaatgattaaatgtttttccttatttagggggctgacagttgttgatattttctttcagaagagtaaattgtgtagtgaaacctgtatatttggggtatggagagcagcaagtcattaactttgggctctgcaactggacatctgggaatcaaagagattttctactttgtttattacacaaataaattatattccctgaccactgtgtgatacctgattttaatatgaagccaggagcagacagtgaaaattgctgcatcccacgctgcttcagctctaggtgtactgatacttccaaagaatacttctgaagcctagatttcaattttacatacatcaaaaagtaaacgactatttaatcttttactgtaacatgaagaggagtgagtaatacatactggaatggagtttagtaggatggaaagccaaaatggaaagattttctatttgagatgaaagtataataagcagtaagctttacaaaaccctggaatatgcttttgaggagaccaatgaacagattagaatttggtttatgtatgggaaagtaaggtgacctttaatggatttctggggccgtcttttgaggattatgtaaatgaagcctgaattctaaatctaatacagctatcattaaaatcaagagaatgtttactgcatgatggtaattgaaatgactcctagctttataatgttcctgagccctagtattctcacatgactttcaaaaaataatgcctattttttattaaaacctgcaacatccttaacaataaagtggaaggaaatcaaggaggttatgataatgaaagttccccagcgatgtacgaaaatttcactgtagagtaagccactaatgagtattcaaatcattttaatctttgctaatatgaaaggtgaaaaaaattcttattgttgttttagtttgtattattttcattgctaaaagaatgaatattttatgcatttattatccttttatttccttttgtaaaagctattccagaattgtccattttaaaaaatggtattaggccaggcgcggtggctcacgcctgtaatcccagcactttggg

SEQ ID NO: 126877 - DNA, 1078 bp, Homo sapiens
atttatttgtgcctagttatttatttggtgtgatgtagaagccatgagcacaaactatgaactcaaactgccttggttcagatcccagctttgccactttggcaaattacttaactctgtaaattaaatcttcctcatcaataaaatggaaattgtaatagtgtatactccacggtgctttcttgagaattatatgaaataatggatataatttggttaacacagtgcctggctcttaaatgtgttcagtaagtatcagatagtgatagtttttgttgtgatttaatcatgatttattgagtgccttgaatatttcctgtgtgttaaacactgttcctgtctctgggattataaatattaaaagccaaagattaattcttgcccttttaaagtttatagtctggtggaaagacaacaaaggcaacaaaagaaaaggaatataacaagagaattgccactatgaagatgcactaaaacccctggagcttagcaggaacatctggtgggcctgagtggcccagctgtgttggagacaaattttgtgtaggagtttcagatgagaaggagatctgtagcctccttcttaattgcaaaaataatgtgtgcttagtagggaaaattcaaacaacactaaagcataaaacataaaaagaaaaggtctcatttctctctcgctaatcacacctccagacatatgtctggtatatattcttctagtctatgtcacactgaaaagattaggcaaacaacaccatcaaaaagtgggcgaaggatatgaacagacacttctcaaaagaagacatttatgcagccaacaaacatgtgaaaaaagctcatcatcactggtcatcagagaaatgcaagtaaaaaccacaatgagataccatctcacgtcacttagaatggcgatcattaaaaagtcaggaaacaacagatgctggagaggatgtggagaaatagaaatgcttttacactgttggtgggagtgtaaattagttcaaccattgtggtagacagtgtggcgattcctgaaggatctagaaccagaaatactatttgacccgcaatcccattcctg

SEQ ID NO: 126878 - DNA, 1038 bp, Homo sapiens
tttcatcttcctaaaacaacatagacataactgattgtataatgttatcttcttgttctaggtctcctaaaaacccagaacagaagatcattaagagagtgattgctcttgaaggagatattgtcaggtaagtatttactgttgtttctgagttcaagttttaaatatctagagttctgttacctacattacttgggaaatacatctgaagtccatgagggccaaagttttggagacattccaaatgagctggtacatctttagtgagcatcattaacctttcaggttgtaaggaatatagataaacttactgatcatattgttattctttaattgtgaagtataggataaatattaatttaaattaaccatatagtctaaaatgatcattaaatcattattgatcagatattaaaagtagcatgactattttaagattaagattatgatgttaaggttcatttaaaaaaattcaagaacatttaactattttagaagcaaatgcagaaactaagaggactcttttgtactcatagagatgggagaaaactgaaaaggatatgaaacagaaacttccgaatcagtgacaagaatgaaagctttagatgataagattgtaacaatcaggtgtttaagcagcctttagtaatgtcgtatttattgtacttgctgataaatcaagaacaattgttgacattcagcaagtaaatactgtgtggcatgatgtgtctcattgtgatcgctttctttaaacaagttgtagccaggcctatacaatgtggtagccaaaatgctttgactactacattgaggaagttttctgaccctgttttctaaaaaaacttgatcctaaagtatttgtattaatgatagtacacatattaactaatctcactgaaatgaacctcagtcagttttagagcagattctaggctagcagttctcacagcatggccagaggatcccaggggatccccactgggggcctatgagattaaaactactttcctaataatactaaagtgttacttgccgttt

SEQ ID NO: 126879 - DNA, 1019 bp, Homo sapiens
ttaaagatcttgttttacaaataagccagctgaggccaagagaagctatgagatttgaccaacaatcaaaactaaatttcccaactctggagtttgtattctctcctccattttatgctgtttctcatttatcttttaaaaattctgttagctggaagaagcttcacaccagggataataggtgacaagctctaaggcaagattcgtaagagacctgggaagcctcaaaactgagattattttccccacaacctgtcctgtttgatacagtagagatagactccttcatatctttaagatttttccatttttaatggcctctttaaaaaaggtaaatatgcctggaggaatctctcctaaactcatgctgagttaaaattttatctcagattagctgatcaaattggtttctaaccacgagagctgagaacaacaccctaggtgaggagggggcatcatgggccaggggtaggaagttggtgtaacagggtcctagaactttgcctaaccaagtgtaaccaggaaaagctcaaactttgttttttttttaagctcagcatattttaaatgaaattaattctgagcagatagatggaatcattgatactgtatgacagaagttagagccaggtggcaacaacttggatttgccaacgcacatctatgttgaaagcttaaatttccctcaaagagttaataaactaataagctaattttatctgatattgcctttcacttagtatgatagctggttatacttggaataattttcttttattttgtattcctagtgagcttcctatgtttgctcaagtttgtaagctgtattcttattaaattatcattacgttggtaaatgtgattagttgctttttgttttcacttttaaaacttgcattctaatgtaattcttctcctttggggatagtattgttttcatttttattaatgacattcaatttctgtcaatggatatcaaataaaatacaactttgtcggctttgagaaaaagtactttc

SEQ ID NO: 126880 - DNA, 1029 bp, Homo sapiens
tatagcttttaccaaataataggaacattttggcttaactgaagaaatggtttgcaacagtgaagttagatgtgggcaaaatcttttctagaacaatctgataaggccagaaaaccaagtttttaaatcgcttttagagagaagataataccagcatatcgttatggcagcacatagtagaaaaacaataaatacatactgattgtattaatagaacagcccccaaaattgtaaaatgatatgaagcaaatactgactgtgacctgtggaccatataggacacaaaatttaaatttgaaaacaatcaatgtaagttagtcaggggatgtcttcatgaataactgacactgagatgactcaaagtggcacagaatccattcatattcctgcttttgtttagaatttcctattcaatttctggaaatacctaattcattctttataactcaagactagcccatattgtatctttccattgtaactttgctgaaccttctcacacaattacttccccctcactactcatacaacaaatagttttgagtgtcgactatgtgccacatagtattctaggcactgaggatacagcagtgaatccatttgactaaggttcctgtcagcatgaaaattacagatttttttttttaatagggggcaggtaagagaggagccagaagaataaacaatagcagcaacattgtgtgtgtgtgtgtgcacgtgtgtggccatatatataagtatcatggagaaagataaggttaagagggataggaggtggctaggagcctaggaacagtttcttttatataattgtcagggaagatttttctaatacaacatttgaccagagacttgaaggtaatgagggagggaaccatgaagatatctgggggaagagcaatcttaggcagagcaatcttagtacagagtccctgagccagtagcattcttggtatgctcaaagaatagcaaggcagtcagtgtgatcaagagtagagcagttgaggttgatggtaggactttacctca

SEQ ID NO: 126881 - DNA, 1129 bp, Homo sapiens
aagatgaaagctatatgaggtggtaaaccagacttgttttttaaaaaagaaaaaaaaaataagcagtctacttaatgtttaatcaagatataccacagataaactaaacgaataaaagatatacataattaagattttactctataatattgcctaagttacagggaatcattctacttcactgtaaaatgaatgattttttccacttgtaggcaaggggcatatatgggagtttgtatgtgggaggagttagtttggagtgatgcctgtgaacataacctgcttgcactcaaatcctcctcttctcctccttctgtgttcctttttatgttgaatggcttcctgttcacccacttactaaaacagaaacttgcacaccctccttccgttttcatctccctcacacctcccatccaggcagtcacccaattctttcagtcttacctcgaaaagtaagcctgtttctttctgtccttattgctactttccttgtgcaagacttcatgttctgccttaaagtgttgtagaagccttttcattggccagcctgcctgccttgacttgcctccttcagtcagaaacatatttataaaatatgatttgctcatgtctacctcttacataaaactcttaagtggttctcaattgctcttagtactaatactgaagttattatcgtggcttataaggtcttttgcagtctcacacatgtttaccacaacagcctcatctgtccttaggtacttttcccttatataatctttatctaggggtcttctaaggccctctctccttgtttgtttctctcagtggattgtggggttcatgaatttaggaatcataccaatctagctcactgctatagttcttgtacctagtgcaatgtataatacgtcaggtatgcagtacaattgtgctgaatgaatgaaagctgcagtgcacataagctatatggaagcccttcctcttcctaattgcaaattttcttacaataatttaggatgttcgttattttctaactcccaacaagcttgaacaagttctgaaaaaataagatacagtgaaccctctcagctttcatttcctcatcggcaagttaggggctaaagcctttactaataaatctgta

SEQ ID NO: 126882 - DNA, 1052 bp, Homo sapiens
gaagtggctgaaattatagctggtatggaaaatgatgagcaatacattgaaatacccaaataccttgttttctaactataacagtcatttcattttcttctaacttggtaggcttactatttttagattcatgacaaaaaagccagaagacatttgaccatcactaatggactgtagacattgatagggtaatttaggtagtctggatgacttcagtgaaaacctttggatcttaggttaaaacaaatctttgaaagttgattcctctctggtcagagccacctgatgcaaagaaatagctacctgtatctcttcagtggcttactaatagtttgatctaaatatgtcacttgacctttttatgtttccattttttcacctccaatatggagagagtacttccctagagggcccaaccacccacaagagcactttgaaaagtgtgaagatattgccggctctcatctctgttgctcccagtgagctgaaaccagatccttccctgatgtaattctctgtttgaccatccttgaactatgtcccatgaaagctgttaaactctgtgttgtacctaggttatgcagtggtttatggaaattggatcaatgtccatgacttttaaatctattgagaactcaagcaataagtgactattttatcatgacagctgatttataactacttagaagaatcatatttgttcccattagtcatgtctggatagtttctgcaatatttttaaagcagtattcttttagaaggctaatagatattttatgtaagtataattttaattgatgcactatatattctaatccattagatgtatttctgattttcttaaaagggaggttcagagtccagtgacatttgaagaaaatcttattttgcagcttagttttcacagtcttgctcataagatttcttccttatgtcaaatccaatcattttatatgcagatgtatgtcatttattcttttaaaatacataaccttttctttagcaacatagtgtgatattaagagaaaagaaagaatgcaaggaaaaccatg

SEQ ID NO: 126883 - DNA, 1108 bp, Homo sapiens
gttattcttctcccatcacacctaccacctggcaactactgatgtgctttatgtcactatagtttattctcagtgatctattttattttatagctgagcaatgttccataatatggatattaccactatttatttatctgttaatctgttgatgggcctttgggttatttatagtttggggctattgtaaataacactgctatgaatattaactacaagtttttgtattgatatgttttcatgtctcatgcataaatatcagaatgtcatatagttggaattacatagtatgtagcttcctcagattgccatatttcactaagcaatatacattaatggttcttccatgatttttcatgacttaatagcttacttctttttattgctgagtaatattctgttgtatggatgtatcacagtttgtttactattgaaggatatcttagttgtttacaagttttggcaattatgaataaagctgctataaacagtcctgtgagggctgttgtatggacataaatttttaacttatttgaataaataacaaggagcacaattgatggatcatatgatgagagtctatttagttttgttagaaactgccaaaccctctttcaaagtggctgtgccactttgcattcccaccagcaatgagtgagagttcctattgttccacatctttgtcagcatttgctgtagtcagtgttttgggttttagtcacggttgaatgtgtaatagtatctaattgttttaattagcaattatcaaatgacatatgatattgaacatttcatatacttgtcatatgtattcattttagatagggcatccatatcttttgcccattcttatttttatttatctatttacttattttaatttatttattatttgagatggagtttcgctctgtcacccaggctggagtgcagtggcacgatctcagctcactgcagcctctgcctcccaggttcaagtgattctcatgactcagcctcctgagtagcagggattataggcacatgccaccatgcccagctaatttttgtatttgtggtagagatggcgtttcaccatgttggctaggctagtctcgaactccggacc

SEQ ID NO: 126884 - DNA, 1052 bp, Homo sapiens
tctcctcttaagttaggatatgctgctgtacctactattgattatgagaaaatattttaacttcaaattaaggttcttcattgtaacatttgctagttatggtgcggtcaatatttcactataatagtatctatcaatcacacactggcctatgggacagagtttttctgtgatggatagattatttagacacagataggatgagaactttaagatatccccgcaacttttttacctcttaacaaaatacagtacatttaaaactgtcatctacaaacagatatgtgaactttaccatctcttcatcttacttttgctattttctgcacatagtttctcccttttcattatgccttttattagaagcaattgtacataattaattactgtaaattgttctagtaaagtttgctttatgttcagtgttaacaaggccaatatctattatgcaaatctcagtatgtaagataagctagaaagtaaatgcttgaataataactaccttctttgaagcaaagacaactgaatttatttatattgtgaatgtcatttcacagttaccttgctgggcaataaaagaccctgaaattaaaatgaccccttttcacaaaatatagctggatgattcatttactacaaagaagcttggcttgagagtactccttctgaaatataaaatgatatcctactaatgcatctgaagtgtgctttaaacctatccaaggagactcatgaaattaatgactgcattacatgttgtgattctcttatattatgtttacttttccactgtttctcctctgattttatatcttatcggttgcattcccagtctttggaaacctccacttgagaaattgtatatgtttacagctgccttgaaaacctttagacctctacaaatttgaaaatataaatcttaagattaatgttccatactatgtatatgttagtttggtttaagaatcttagcattttaagtattgaagcacctgccaccttgttgaagaaaatcagttatagcacaacagtgtaatgatgacaaaatgtta

SEQ ID NO: 126885 - DNA, 1039 bp, Homo sapiens
agttaaactgcctggttaggggatgagaaaagacattcccagcagaggtaacgatgtgtttccagcatagagacaggaaacagcaaaagtgtaagcaaatgattccctgccacttagtagctgaggagctatatgaaagtagcaaaggagatatatgatcttgctttagcaagatctgctttagctttagcttccatgggccctggtttttatttttatttttaatataatgcctatctgataagtgcttggaggattagcttgtgttagatgtacgctcttggcccaatgcccgagtactcagtcattgctccgtgaatgaaagtagtgaatgtagagtccccaacaccaggcttggcaagtggtaaacacctcgaaatgtaaattattgttatcatttcatcccttgttccctttctttggtatatatggacataatttcattattaagataaaatagaccttgaatgatattcatcttttatgtagctcattcttgactaatagtttagctggtatagagttctaattccctcatattttgaacatagtatttaatagtcttctgtaatctgttgctaatgagaaaagcttttctttttatcttcatttattatagactccctatcatgtttctacaggtggatttattttttgttttccttcttgactttcagtgtatacttttctatatatctttattcagttctggaaacttctttttcattatttctcctaattttgtttccctttctctcttttgtgtgacacctactggatatatgttggagcttctcaatatctccctcatgtcctttaactgctcctttatttttttaattgcattatctttctgggatgcattgtgtgcctcttaatgctctttgaaaatttctacttctttcttttactgtggtaagtctacagtttatttaatctattggttctttttaaaattttaatgactatacatattttattcttgtgtttctaattgtttcttcttcatttgtacttggtattttttaatttgtttgaa

SEQ ID NO: 126886 - DNA, 1143 bp, Homo sapiens
ggttaggcctattcctcataatatgaaaggatatatttattagatttgagagtactagtgtcactgataggtgtgatttcactggcagttttaacataggttcccatttattcagttgcatttaatatgtaagctgctttctatgaatggtaaatattgttaaaccttctgtacaataaatgcccatggcatattaaccaagggataatttttatttgtcatgttattttaaaaaattcttacatatctgttctgtaagatttacaaaagagttttttttttttggtgttagactataattaataagaattacaatagaaaaagactattgttttaaaaaccaacttagtatcgtcttcttttctctgagatgattaactcaaagcagtctgagtccctttcatattctggaggaatggaggaggcagatggctggtgcctaccttatggaaggcatcagcctgcactatgggtgaatgcaccatgccaatgaatcaaatgtgggaagcaggctctaaaaaatgcagagaaggagagagtatgattcgtgagagcatcttaaaattagttattatcggtggcaaccaaagtgtcgtgtcctttatgaactcaaaaaagaattttattaacaatttgaaaaaatcatatctgtgagtaaaaatgaaagtttccaaggtaattacatctagaagtgaaatccaacttaatatgttaaactcttaagtaaatttggggtacttgtatacagttgacccttgagcaacacagggctgaactgcatttatatgtggattttcctctgtctctgccacccctgagacagcaagaccaagccctcctcttcctcctcctcagcctactcaaggtgaagatgattgaggatgaagacctttatgattaattgcttccacttaatggatagtaaatatattttcttttccttatgattttcttaacattttcttttctccagcttacattattctaagaatacagtatataatacatgcacaaaatatgtgttaattgactgcctatttatcagtaaggcttcaggtcaacagtaggctgttggtagttaaattttagagggagtcaaaagttatacatggatttctgatagtgcagagtcagcaactctaa

SEQ ID NO: 126887 - DNA, 1048 bp, Homo sapiens
taaatgagtgactatttcacatagtctttctgaattgtcagtaataggcttgggtaaaaaggtcatacccatcttgatagcaaatgaatatttattttttaaaaatttgcttttttggcttctttgggtttattacactgctgcttacaaaaataaatcagtgaagacttggcacattgcacactctgttttctagacactgaaagaaatgctggcaacatttccattagcttactaactaatgagacagcattggctactttcatgggacttggattctggcaagaagagttctttttttttcttttttttttttcacaattaggcatataatttttaagttattaccatatgctgtaaagtcaaagatatatttatatattcataccctgaatgaaaaggcagtaccttcttatggcatgtagagtgccatatttttagacacttgaagtcaccatcatgagaaggcaaggatattaagtttacccttggggagaatttactttgtggtctcctgttaaaattttgagcagtagcttattgcctatcccatttggtcagcagaatatgtaaatgacaaatactcatgctaaaatatataaaattaagtgagcatttgagtgccttatatgttttagccactattttagtccctgggagaagagaggtgataataacatagacccctcccctcatgaagtgttagtctagcaggggagataggtctgtaataattaaatattttagagaactacaggcttttgtcacttgctatagaggggaaaatgcttacttttccctagaacaatcagaaaaggtttatgttttccactatcctatatgtggatagagaagttaaaatcttttaaacaatacacttaatttcattttagtttatggtcctattttacatggcaaaggtactgcctacttatctaccattgacaagatgcgagaaggctgggcgtggtggctcatgcctgtaatccctgtgctttgagaggccgaggcaggcggatcacaaggtcaggagtttgagaccagcctg

SEQ ID NO: 126888 - DNA, 1563 bp, Homo sapiens
agatgcctaccacctcgcccggctgattttttgtatttttagtagagatgggatttcactgtgttaatcagggtggtctcaatctcctgacctcgtgatccgcctgcctcggcctcccaaagtgctgggattatggtgtgagccactgcacccagcctagactggttttatctgaaagttttcagcttttatttgtcttttgtcatgctgacttttttttttttgagttttgtggaatgtcttttatttttgggtttttctgatatttcctcatgcatggattgaggttacacattttgagagtaatgcagtttacactgcattaagttcatcatatcaaaaggcacaagataccagtttgccccagattcggtgacatcaactgtgatctctttagcaaacatagtatctgccaggtttctccactgtagggtgaactttttctggtattaagtattttgtatacatattatattcctcatcaacttttatgaaatagttttgcagtcaccaatgattcttgcctgaatcaagtactattatgatgttgtaaaatgattgtttctaactctgtcattccttttgtatttactagttggaattccattccgttgtaaggaagagctttctcttctcccttcttgtttagtgccagtaaggactaatggattttttttcccaacaatgagttgtaagctattagtatcattatttattgtgattcttaaattgccctatatttggctggtgggtaatatttccttttaacattttcactcatttgtcatgacccctcatttttttagtggatggtatcatcagcagtcttgggaactttatgaaaatttgtattaacttaaaaaaaattgaagtgaaattcacataacataaaagtaatcatttataaatgtacaatgtataaatttgctggcatttaatgcattgacagtgttgtacaaccaccacctatatcaagttacaaagtgttttcaccacaccaaaaaaaaactgtacccattaagcagttatttcctgttctccctttccccttgctcttggcaactacccatctgctttttgtctctgtgaatttacctattctagaaatttcatatagttggaattatatgtgacccattatgtctggattctttcacttagtataatgtttttgagatacatccacattgtagcatgaatcagtacttcttcttatggctgaataatattgtattatgtatatataacattttgtttctccatttatccatcgacagatatttgtttctttttttcatgttctgactattataaatagtgcggctatgaacattcatgtgcatgtatttgcttgagtacgtatttttagtttcagggtatacgtacctaggaatggaattactggcttatatggtaatcctatgtttacctttttgaagcatcatcaaactgttttccaaattggctgcaccagtttacattcccaccagctatgtatgagggttacatttcttctccactttcttaccagtagtctttattttttgtttttgtatgtgtggg

SEQ ID NO: 126889 - DNA, 1021 bp, Homo sapiens
ttgatcgtagccaaaagtactgcaaaactatccttattgctaaaaccaaatacgtgattgcaatcttggccaaaaccagaaatgaaaggaaaaacaggtattggaatgtggaagttaaaaaggcatttgaagaaaaattgagactctgtcacccttttctattgtgatcaagccccattaggaagaacattagaattttggtttccagctgtgtctgtgtagatgaaaactctgtgagccaacttcccttttccaaagtgatctaaatattgttcagagaattctagttagttggcagagaaacaagtatttaggcagaaatatgtccaaaaatgagaagactaaagatatgcatcatgtgcccatgtattttacataggaccaagattaactgggttttgctccgaaccttaagaaagaaggctttttcagcattgctagaaataaatcttgctttaaaagtttattgcaagtgtggtgtttatgaaaagcaaattagtattctataaattctctcaaacacaaagtgataatcagctaaatgacagtcgatgagtcatcattgtaggtggaaagatgacagtcaggtcaggaagtgaataaactaggtttcttatttttgctctgacttcaatttaacgtattagtttgggtaggtcatttaacctgtctggaccttatttatttgtaaaatgagggtataaacctggttgtctctggtgtcccttccagctttgatgttttgtgagcatgtagttcaatagtcaaaattactgggtaacaaagcagagtccagcaagtgttatctatgcagaagtgatttccatttgaatggtcagatattagagcttggacattgtcctgggttctgtggacagaccaagggatagagaggaacagaagactgaccaataacacatgcatacttatatgcaacaatttatcccaaatacaacatttctcaaatttccctacaacaaagacaaaggttaataattaaagaacattagtgtacagacca

SEQ ID NO: 126890 - DNA, 1441 bp, Homo sapiens
atgggcagccattagacaattttaagtagggtggagatattagtacacttaaaatttgtactcactgtttcaaaactcactaggctgctacatggagaattggttagaggcaggtaggagttaaggggagcaacagatgctgaatactggacttccctgatagctgaagagatgttgagagatgacagtattccagagatattttaaacccagacctataaagactgttaatggattgtgtataagggatatgacaaaagaggatttaagtcagacttctacatcatagtagacagtggtgctgctatgtggataatggtgctataaagtgagaggcgggattccgagagaagagcaagttgccctcatccccaaacagaattctgtctttctcatgtaatgtaagggtaatgttttaaaatgcttaaaatgcttttatctgttgcttaaccatgtaaaacaaaaaaaccaaccaaacaaaaaactttgccctcatcagccctagtcatttatttccctgaagggagattcagatttgtaacaagaaattccaagaagtagtcagtataagatgcagctttgttttgcaaaaatataactatgcaaccagcagaagaaacaactaatacaaaggccttaggttgtgaatttctgcaccaaatacagcaagccagcctttcatcttgagataagattttcctgattccacctgagcctgagactcagctcatgcaatttttccctagttggaggagagacctcattcactattgaggtctagctagagtcagaaagaagaaaaataaaatatagtagaaggaaagtaaaagccttttattttgccctgaggatttttagggagaaaagagaggagagagatgagagtaaggtagttagagaggtgtattctgacgtacccttgtggctttagcttggagatgggtaggtgcattaagtaaacaataacatcattgcccccatctctggtaaaatatcacctctttgttctcccatcacttttatactgtgccacagcaaattgaccacactattatgtggacagagggattccctatgatttagcttttctgaaccacagatgctgggttgagagacagaaggctaatggacaaagggtcccaacagcagaggctgggctgattcctgagctacagactgaatggaagacaaatgagtcattcaggaggttgctgccagtggaggctgaggtgaggctgattcagctacaaagaactatcaggctctcagcaaaccaatggggccaaaaaacaaaaaatccccacattaaggcaatcaaccatccaaacctccacaaaaatgttaccaaccatagatcacagctttcaatgtcagcagtgcaagtagtactcaggggcacattgaatagatatcagatcttcagtgcttctcagacttatga

SEQ ID NO: 126891 - DNA, 1376 bp, Homo sapiens
aggaacaagaataggacaggcttaggtttttaaggtaaggaaatgtaaaatacaatcaaacaaaagagcaacacgtgtcatttttttttttttttttttggcaaaatcgcttatctttctttccattccatagacatgatgcagaaaatgagcaaattaaccctcgccattaagagcacttcttacatctttaaccttttataaagggtacatttgattagaaatgcaatgaatattcagtgctttggtcagtttagactttgggggtgctccccagctgtataatgctcactgagagcctatgtgtgaaccacaagcctgggagaagcctggctgtctgaaggggctgtgctgaaggctttcacatagttcccattactaaggaaaccactcgttttgtctgaacactctctgaatagatgtctcatttgaagtctagtgctcaaaccatgaggattgcattatggagctgagaaagaaatgaggagaacaaaaaatgcttgaaaatgccaacaagcattcacaaagcgttgtactgtaataacattccatgagacagaaggtgcgtttatttttgccgcattccaagttattttggtgttataaaagcaaattcctttgcttgcccacgtaatcaaaataagaaaagcagatgttcttctgacctattcttaattcctgctcttgttagggtctcactgagaagtgtgacatatagaaaaagcaggacaaaatatggattctcatattaatgtagatttgctccgttgtactttataactaaatggtgtagtgctatccctgtgccaataaacaaacacatgttcagagtcagacctcaggatttgtagcctccaaatggttactgttaaattcagaatggctactgcaaactggtgcttggtgctcattaatgagcatccaactcagatttggagtgagaaaacactgcttctaggagactcctgctccactctccagcttctgccaacctacagcaaagaaagcagctcctacttaaaatatcaggcaatcattctttcttcctcactctggaaagtagggtttgcgggactttcattacagtatattctttatcatccctctccctgtttttgatatggtcaatgacgttattttaaaagtatacaatttgctatgcagacacctagtcagaggttgccacctctacacccatatagaaagtcacaggaggaagtcattcttacctctgtgttgagctactttaatcctttcagcaaacgagagatgtatcaacacagttaatccacaaatgcagaaattaataaatatgtatagattacttgttgttttactttttgctgactgtcatagcagttagtgtcttgcctgca

SEQ ID NO: 126892 - DNA, 1673 bp, Homo sapiens
aagtgggagatcagagtgctcttcctgcaattgtccttttaatgtaggtacatgataaatttaaaatattttatactcatttttataaatttaatatcatggagcactagaaatgagattttaatgtgaaagagaaaatgactctggctttggatgaaaaggatggcgattctgttctttgactggaatttctatcttgttccaagagcatcagcagctttatggaatcagtgtgtgttttgggtgttttttcacttatcagggcgttcagtccttaactgtaaatatgaaatgtggctctctccaaagatacatgaaaaaattattttggtatcacatctatataatgaagtaccatatgaagacgttacattgtaatacagtaaggattttagggtttttgaattaatacaattgtgagtgatcatcaaatgagaaccatggaatcttagcacacagttggcacattaaagccaggatagagcccctcaggtattccaggttttttccaccatattaccctatcatctactggatgattgacaggtctctgctaattcttcttttccttcttctccttcttttcttccttcttcttactctccctccttctctcccttcatttttttttaagtttcttcctttagaaggcactaaagcttcagagaaatttcacattgtaaaccacagtattacatggttgtacatgttacctacattgtaggaaatgtctacagggtttcctagatgaatactgagttttaatggaaatgtattgaaatggttttaaaatgtaaatgaataattacaacccttaaattatactgaaagagttttgccttcatcatcaaataagaaaatattgggtacagtagatattcactgacttagtggttgggatttttaacttgtttattgctatttcatcaaatcctgggctttattcgcctgtgtgcttttcttagaaaagtagcctggacagtcggtagaatgtgggttttagagccacaatgtctgggtttgaatccttaccttgccacttcctagagactctgagcatcatgttaagtatcatctctgttaagtatcatcgtgcatcttggtttaaaagtattatctctgcatgtcatttttctcctagaattgttatgaacattaaaacagttaatatgtataccgggtttagaaaagtgctgaaatatagtagtcttgaacaaatgtttgacattattactggcattattatggtagtggtcattgttatcatggtcattgttttcctcctttaacaagatataatctctcatttgacccacaatagcactctttatcgctcttattacttaccatttttttggtattataattgtttctgtaattttacctgtttccccttttagcatataagattctcctagagggagtatatgtcttgttaagtttttaagctccacaatgcatataaaatggataaaataacatctgtcgagcactaacatatatttgtatattttatatatattaacttcaaaaatattctattcaaattgggattgatatataaattatacctattccagttgaattatagctattctagtgtttcgttgtttttttttttttttctttttttaagatggagtcttgctctgttgcccaagctggagtgcagt

SEQ ID NO: 126893 - DNA, 1913 bp, Homo sapiens
taaaatataaaggaaggcaggaggctgcagccgggattccttctttttcctggaactctttttctcagtcggcaggctgaggctctcaatccagtgaagagagatcctgtgagctggctttatttttccttgtttccatggtggttagtggtgcatcgttcacccgatcagttgtcacactgacatggtgctgcctgctcagcggtcattaataactgaacaccctccactccccagagaggagccaatcgcttcagacagccaagatgtagcactcgcagctgctccagtctggttggctgaaacaaactgtctgttctatgacactgctgcttaggatacaaataaatgaaacaggcttgcatgttttcctaggtatcattttccttcttttttttcctttctgagggaatgttgggaatttttgacaagttttctcaattttaggttatcagtcattcagagaaatatgttttcagtctgcaaatagagaggacacactactgataaggatttcctaaatattaaaaacacctggtagagactcaaacctccaactccgtctctgaagttcagcaatgactgcattatttaagaagagaagcttgcaactgttttgagtggcatttggttctctatagatcctacttaatttagcatatgtgcttggtgttcaataacacttttttttttttttttttagcaatgacatttcttgtctggattgaccagatttttaaaataaagcatatatttgcctctctgtaattcacaacattggcatttgagggggtactttttaaaaatatgtatttctaattatactcactgacttctctttatatgatgtaataaatctaggagctacatatgaatgggtacatgtgtaggtgtgtttgtgtatctgtgagtgtgtgtgtgtatttaggatgtattttttaccactctggggaaatatttcgattgtaataagttaaattatttaaaagactatctttattcttaggcctattaactctgaaaggatatttcccaggaaaatatactatataagccatacatgtaaaacatttttattaattaccagaaatttggaaaacacagaaacacatagcagtgcatatttctgaaagaacatacatgaaaaatcaaaaagcagttttaaaaatgcatgttttacaaccttaattagtatactagagaaacatcttgttgaggagaatggaacatgaggattaatatatcaacaggtcaaaagcaggctagtcatgactccaaccccagttttgagagactaccctctagtggagtaaagagaaatggcacttattagatttacttaggaaaaaaaaaacaaaaccttcacatctaattgctccttaagtgcttattgacatgacatagaacaatagtttgcagttattataataataataataccaggaaaaattttaaacagtaggcttgtctttaaatactgaatattttcactctgtagttttctagaaacagttcccaaatgtttttttctataagaatttattcaaatgaatcaaaataagttcaagataaaagtagcatctcatttaacctaatacttatttcagaatattattgtaaggttttattatttactggatactctagtatttactcagaaagcactgagtcagttctgtatgttagggatcatggttgagtgttgggatgttgtgttagagtatatttacatataatttaatgtacttttaataatagtaataatcatccttcttaccccttaattttaatctagcaaatcttagtttctttaatattccaaattatttcagtatctgcaggatttatttccacatatggaagaataatcttaaaattgtgataattatttgtaaaaagagaatttttattta

SEQ ID NO: 126894 - DNA, 1029 bp, Homo sapiens
ggcgaaagcaaaagatgttacaaaaaaggaaagaacaaagaaacagtgaaatatagttagtgcatcataagttgatcaccttttttgtaggtcactaaattgctggcctggaaggctggtagcaccgtttattaagccattaacaacaacaaccaccacctccaaataaaaaattccacctactcatcagcattctaactcagcatgttgcctgtgacaagcgacaccctgaaaaaaatggtcctttgaattgtcttgccaggaaggtgctatttctggtatagttacatgatttggggagactatgggtaaatcttccagtcatacacaaatgtccatcatctggcattcgtaggtgctgatcaaatcaccaaactcactggcacacactgagtggcaacaccgggggcctggagtgttggtatttctcagactgaagtgggcacattactgatctctgtaatccacaaaatatgtatgtgagctttactaaggttaaagagtgaatccactgttcttaggtgtcatctattgcaattttaaaataaggcgggttagatttaagaatgtgtgtctggcatgcaaactttccctggaaaaggtctaagaaaaactgaattaaatactgcaatgctacattatataggagtttgaaatcagagggttgagtatctacttcaagtcttttcctcttggttaggaacttaggaggtacctcaaaatatcagatctggtctgtttcaaaagcagcacttttaataaatagcagaaaagcaaataaaacactttttcctttttgtaataaatcattttggttttttttatagattgcatgtggcatttgaggcagagcgagcaaagctgccaatattgcaagctgatgcttcagcacctttcatttttctctgagcaggaaccctcttcttaaacttgttcatcttacagagagaaaatcgaagccactggcatattgtcagagctgctttattgtcatcatttacaaaggtcactggaattaattgacttctt

SEQ ID NO: 126895 - DNA, 1081 bp, Homo sapiens
ttgttgaaaaattgctctgtaaatggtagagctttaaacaaatattcacaattattgtgtttatattttgtatccttcttacaagttgagtcaattaattactattatgttaagcaaaatttggagagcacatttaaaaacagagaaatttgcccaaaagaaaagaataggattgtgatattaaggagatatcattgcctactggagctctcagtctgactctagaaatcaaaaagtaagttgggatggggtaggggagggagagagggagagggattgctgtcctgataatatatttattgttttccagtgagatgtataagcaaagcatggatcctgagagtggacactgtatataaaaaaagggcacatgttaagtgccttaaattatttacagtgaaaccaagtaaaaacagatgtggaaagcctcttcagaattcttggaaaaccttaaaacttatagtggatgatcaatagctgagtctctgtaggtgaaggatagcagtattattattaacatgttttaaaaacagggcaaaactctaatttttatgactttacagaatatggtaaactatattcaaatgatgaattatgggtttgaaatatttgggtgttatatacttaataaatcgttgcttctattattgaatattggcttttccttttagaatatttgattatctgaataaatatttctcttttttgtacatatctgtgaatttggggggattttttgcacataggaggtttttgagaaaacattatttttgaaagaccaaggaggcagaattttaatggaattctggaggaagtattgtaaggggttctaacctaggcctctccaataaatagctgggtgaatacaaagtataatgtattacattataacgatttcaaaccctttcagcctcagtgtttttcacctatcaaatgaacatattagactagctactaatgtctctttcagttcaaaaattttattctatgaaagcatgtctcccctctttattccccgtctcctgaagctgtgtcatgtgtttttattaatggcaccatagaaaattcttcccttattatg

SEQ ID NO: 126896 - DNA, 1050 bp, Homo sapiens
tagttatggcaagttacttttcttctctaagccttatttttcacgttggtaaaatgggttaaacatagcgcttacttagtacggtcgttatgaagattaaatgagaaaatgtatgttaagtgcttagcataatgtttggcacagaaaatgcttgtatgttgtaaatgagatctgccagtattattaccattcctttagccagtaaaggattgtctaagagagatgatgtggtttgaacgtataagggctctgcttacattaatttatgtcagaacatttgttttaattcatcattactttgattattttgcccaacagcagcatattatggtataatttatagcctaaatataaaaatgagactttgatatttacataaattttgcttcctcattaaaaagtaattgattgaggaaatggtttggaaaatgcctcactgattttaaaaagttagctgaacatcaccttatgaaactctttcaacaactgtggtgtttgtgtaaaaaatacgtgagtaataaatgacaataagaggaacaaatataaactatgtgtttggtaagtgagtcagttcagctagtcacacaacaaattgacttggatgatgtttatatcttataatggcattttatatatttttcattcaagaatgactgtgaatagagctttcaaagtttatatgttcttagagtatgtttatctttcatatatggcagtcaccttgttttgctctttccattctgttctgttgcactttcttttcaatgctacagcattgtgacctagacacaattctcttttcgcttgctctatcttttttgttctcaatgccttgggcacctgcagtttaaggtcattaaccccttggcctttgtagaaatcaaaatataatctgtgtagatatatattgaaattatttcctgcaactattgaaatttcagtaaaggtcattgtggttccatgtattctacagatgttgaatactttttgtagaacatgttcagtgtttggtatttctgagtgactgagttttgataaaaatagaattaa

SEQ ID NO: 126897 - DNA, 1062 bp, Homo sapiens
gaataaggttaaaacattgttctacttgttcaatttgcaagatatttatggtcaataaaactttccttatttcattactgatttccattccctaagaaatgataaagatcttagatgttcataaatcctcctggaattcaaccatgatatttttacatacattacacttctaaaattacaaaaacaaaaaaaccttaatccagttcagccagagcctaaatttttatcttttggctctatgcattttcaacagattaataagaatgtttaagtagaaaatccacaagtaatacttttagattagttgaattatattaagtgttcattatcattatattatttattaaataatattatactaatcaggttgtaccatgtggtaaaactgtaaagtttgatgcacttattgtatttattttaaatctgtatatgttataaatattttaatatatattttcattacatatattttattatatataaagtttaagcatattattatatatatatactcctgatcttggctgagaagtttaaaactgtagaaagagcctgttgttagatgcttctgcataaaaagtcaaatgcttctctaaggataaatatattatgcttattctaagaaatatgtgataaggcattgggtacagtgtacactgcttgggtgatgggtgcaccaaaatctcagaaatcacctctaaataatttattcatgtaaccagacaccatctgtttcccaaaaagctattgaaatttaaaaaaaagaaatacatgctaaggaagacaccataacatgggcttcagagtcagacattcagggttcaaatcaggacctttccaatgagtgaagttgggcaaatgcttctccatttcaagcctcagttccctcatggaatcaaagtgaaatgaggtgagttgtacaaagagcttacccagggtccgggctgtggagcatgttaaataaatgttgcccaacatcttcctcttctttctctttctcctcctcttcctcgtctttgttgtatgtaagaagtagcaggaaaaaaaccccaaaagtttaat

SEQ ID NO: 126898 - DNA, 1537 bp, Homo sapiens
attctttggatgcataatttcggagtttctgagttttatacatgatgttaactgaaataactagatgtcagattcatagaaggttgttgcaaaatgaaggttatttgacatctgttttgtaatttttcagcctattgacataagaattctttatttcatgaagaagaatcaaattaatttttaaagggcacttcaaaggttttgtggttattttatttgaaaacacatatttacagtctacagagttaagaatatatttttgtctcaatgagacctttagtaaggaaataggaaatagctctggactgggagcttctggaattctatggtcatgcctctctgctctttgcattctggcaagtagattcacattttagactcaaatcacttgtaacagccattatatttggaactccccatctcttctttttgtttttcttcctcttttgtgtgagagactgtccccttctctctgctttctttttctgtcttccccactgttctagaagccatgaccctctcgttctaaatagattttgccctgcttccaatgagatgcgaggctgggtatttctatgcatatttttaatttgataggaagtgtagcttacagcttattgtgaatacattaacatctcatcgcttgtgacaagtccttcacacttttcatccctgctattaattttccttttctccacatttaaaaatttttctttagcatttgctccccgaatcaaaaagactagatagggggattaatgatgagacttttctgttatttagcatgatttacaactattgctggcaaccatactaagtagtttcacatataatgtcccctcagccttttaaaaaattgatatcagcttcaatagaagtgatggtattagttactaaagtgacatcatatcaaaatatataaacatggagcattatcaacagaagtgagaacaatttctagaacaaaatgtagagtttggtaaatctaaagcagataacaaaagaaattgtttcattctctacaataaatttgaactgtggattacagaagtaaacatttacaggaaattgggacacagagggagtgggagaaggaaaatcatatgacttttgtctctcccctacctggagtttcatcatttccaactctgcaaaattggctcaagatgcgaatagtaaaggcaggtatgtgcatgcatgaatgaaggaaggtatcctccagcaaatttgcctttcaaaaaagttgcctgaatataggcccaaactcagagatatgaagagttgttatgctggggaagtgaaaatgaaaatgtaacttttcatttcacacacatattacaggagtaccacttttcagtgttcccattttgttccacatttaaccctaaaatttcttgaattgccaatacaaatgccttattttgctctctggtactctcaaaatggtgttcaatagaagcagcctagtcattaagggatcaggcatggactctcgttctttctgtgctgctgccatgtcattgtttcctcatctact

SEQ ID NO: 126899 - DNA, 1013 bp, Homo sapiens
taagccaatgtctactctcattatatctcgaataaatctgttgtgaggaaactaatggagatatgtatgttttgttcgtatatcttttttacttgagatatagttttcaattgatttttatatattatatctctagtaatagcacagtgtagtgggggtataatatatacagattagtttcttaaaatttgtgacatttgtatttggagaacatagaaaaccatgtaatttaggttaaaatgtattcttaatgattgaaagtgccacagactttcagaattaatgtaaaaagctgtatcaacaacaaaaagagcaataataaacattaatataattgagtgttaagtactgagaaaagtcctctagaaaattggtttgatgtggctgcaggccagaccatgcttgttgccagctgatagtgatcaaatggaatacatcaacaatctgtgaggtttttgtctccaaacccagactggggttaagaatctgcactagaaagtgacacttacagaagacactgtactttaggagaaaacaacaacaacaacaataaaaacaaaaacagtattgtaaagaaagccatatatactcggttaagaaaaagttgatgcaaatcaagacaatatctgctgtaagttgagactgggaaatatttttggtgcaaaatttcagcagaactctaaatctatgcagcacacatgaaactagtaaaatttacttaaaagtttaagctttgcatgctagagtctataatattatctgcagaattggaaatactacagcttgaccaagagctttgaaatgttgcaacagccaaatgttgcaaataaatctttgggagttcattattagccaacaaaattattactcactagatctgaaataacaaatctgtggccttgacatttaatcagagcatgaaacgcatctattgtatttcatatttgagattattactttactagtgccccaattaaagcatgtagattctaaaattctattcagataaagta

SEQ ID NO: 126900 - DNA, 1021 bp, Homo sapiens
tctgtgaacatcaaagattttttccaaaggtgtctaacaattgaatgtgtgtaaactcacttatctgattttaacctttgtgttttttaattgattacaagtttatattcaatactctagtcccatgccattaacaaatttaggatcagtgaattttagtcattatggggcttttaaagactatcaaattagttacctgccattatttctattttatctttttatctacacagtagtaaacaaactagagagttactttaatcattaaattaaggcagactaaccagtaggaagtaaattgcctcgattagagcacttcatctaaattcagatgtgaattcaaattccttcattttgcctctaaagctcagtcttaaccactaagttctactttctctcaaatgtttatttttaaaacagcaccacacaccttggtatcttctcagaaaggtgtttcctccaactgtataggtgcactgccttttttgttattattgttgggtgtttctcttcctttgataataaagtttcactcagatgaaattataaggcagttgagtattgtggaaggaataaaataaaaactgttttctaggcctagttttgctatgtgagagtaatcacatcgctctctgaatcttagtttctcacaaaatatgcactaaatttttactcttgttttcaagttgattgttaatgtcctgtgaaattgtagagattttgtgtgggattgccattataaagaaatttgtttattagagaaaaattatttttgttattgttcaaaatttatatagtaaaatgtatgtcatgtatacccatatatttaatggatgctgtcttttagagtggttttagagtggattctgatattttcagattctcaaatctgatattttgagattttcaaactggcaaaaatcctcttattatcattatagaaataactatagatttttttaaaaggaggggcaattttattttatgtccttgtcatgtttaagaacttttatttttaccc

SEQ ID NO: 126901 - DNA, 1052 bp, Homo sapiens
tgtcttcttttgagaattgtctgttcatatccatgtctaaaacaccaaaagcaatggcaacaaaagccaaaattgacaaatgggatctaattaaactaaagagcttctgcacagcaaaagaaactaccatcagagcgaacaggcaacctacagaatgggagaaaatttttgcaatctactcatctgacagacagctaatatccagaatctacaatgaactcaaacaaatttacaagaaaaaaacaaacaaccccatcaaaaagtgggcgaaggatatgtccttgataattcttggcctaggcattgggcaggctgagaaatttaatcgttaaaaggttaaacatttattattttaatgaatgtgtttccagaagttttctgttatttcaaatctttgcttgtttataccttgtaattttatttgttatattttcattagctttgaaatttagttatagggaaaaaaggaaaacaacttttaaatctttcaactgttcatggctttttttttttgcctgttagagaggcaacataaaaggccaataaatgaataatactgttcacttacaaccaaatgagttagattgcgattcaacaggttcccaggagacaggatttagagacaaaaattataaaatgttaagtaagctagatgtagtggtattagctgtttcccattttcattcatacttctctccatagtctcctttgcataaagtgacttgagttttgcagtattcagagaagattaagtttaacttgctgtagatgtacctgtgtgttatcattcgtaactaaagttcacaagattaacatttggctgttttatttttccctgagaataacttaccttccattactaacaatgaaaaaacaattttattacatcactgatatggtttggctgtgtccccgcccaaatctcatcttgaattgtagctccgataattcccatgtgttgtgggagggacctggtgggagataattaaatcatgggggcagtttcccccatgctcatggtagtgaaataagtctcaggagatctgatgttt

SEQ ID NO: 126902 - DNA, 2410 bp, Homo sapiens
gttgccacagtaccccttgaagccagttacttaaaatgctgaagttgtacatatttccattggtcaggagcagcattggtgaagcttaaacttctctctcgaaagtaatctttttttacttttttgtttgtttgtttgttttgttttgtttttagcacaactgcagtctttcgctttttttttttttgttcatttttggagtaggtttccttggtggtttttaggacatatttgttggtaaacctataacagttgcttttactttcagtgatgtacttttttcttttcctgcttcccagagatttatcagaggaggataaagctcacctaatgcaaaggttggtttctgtaagtaattcctcacatagctgtgtccaccatcacagttcatttctggagagaggcagctgataagacatatcacaccaataatccccagaaggcctccaagacaggccataagtgttgtggtattattcttttcatactctttttgatcagggtgcaaacctttggtggtgacatttacacatttttttctgtttttctgatagatggtgggaatatcaatacaaattttatactcagttgatggattcagatgagtaagattatataccttgacatcagatggtattcgagcactttgcgcagcatgagaattttcagtcttgacaaaggctgtccatttaacactagatttgagaattttagaacttgctttccaggacaccaaaactgaattggcctgaatatctcttattttaatattcaaagagccattgttatcttgtggaaaagatccatccactttgatcataacagacttcaagtcagcgccaactaggttagttgctatacaagtatataaacccccttctttgggagttacgccatttatatctagtgttccctcagaatggacatagaacttgtctgtcagggtattaggcaagagtttttgaccagaaggtgttatccagtagatttcaggctgtggttctgcagtagctctacagtgaaaggaaacatagctcccagcttctacatttagattagaaggaaagctctcaggagctataagagggagacaaatttccatcatgtccctgaaatgcacttgccgaacattctgaccttggaattcaggtgggtccacgcaaaacagtgaatctggctccatgaatcgaatgttggttttgttcatgttcatccaacggatgacacagtcacacctgatggggttactgtgtatgctgatttccttgaggtttggcagagactcaatggtaccatggtacagggcactgagagcattgctgttcagcatgagtgattccagcttggggagtctgaaaaatgcattggggtgaatgtaagacaatctagggttgttagtagcttctatttttcttaaatctggcaggttatccacagcaagactatcgatggaaatcagctcaggcatattatttatccccaactcttttaagtgtagcatattgctaaaatcaccccttcgtattctattaataggatttttatttagatccaaaaatttgagatttacaactttttgaagagcaacatggggtactttaataagcctgttatcgtaaaaagagatgctttctaagttttccagtccaaccaaggcgttatctggtatttctgtgaggtttataccagctataaccaggctgcgaagattgataagaggcttaaagttcatgtctttgattctgataattggattttccccaatcatcagaatctctagatttggaagagcatcaaaccacttactgttgatcatctgcaatctatttgaattgagatgaagtcgaagaagattatgtaggccaataaaggctccaggtgaaattgtagaaagcaagttgtgattaatatagagttcttgtaagttgctcagttcggacagacatttttcaggcagttcagtaagtttgttttcctctaggtacacagaaaggagctgaggcatcttttttacattaatattggtgactgaagataaattgttttgagataaatccaggccagtaaggtttactggaaagtctgtggagtattcaatttttgcaatattgttagtctgtaggagaagaatctgtgtgttagctggcaatctggctgggaaagttaaaagacctaaatcattacaatccactgtagatgcttccatataaatggatctgggtgtaaaccaaggcctgatttcacacgtacataaccgtggacaatccacttttttatctacagcttgtactagtgtagtgatagctaggccaagtagcacatgaattcggagtggcatgtccttcatcttagctttcttcttcagaaatgtaatgggcccttaaggattccacagtcagtgctagtaagt

SEQ ID NO: 126903 - DNA, 1028 bp, Homo sapiens
ttctctttgagtttgaaataggggtcacataacaggtatccatgttttatgcatagaaataatttatggtaactaaatatgcctcttttttttgagacggagtctcactctgttgccagcgtggcatgcagtggtgtgatcttggctcactgcaacctccgcctcccagattcaagcgattctcctgcctcaggcccccgagtagctgggactacaggcattcaccaccacacccagctaatttttgtatttttagtagagacggagtttcaccatgttggccaggatggtcttgatctcttgaccttgtgatccactcacctaagcctcccatagtgttgggattaccggcttgagccatcacactcagcctaaatatgcctcttaatttagccagtctaaagaatactattaggctagtttctgcagatatagtgaataaaatcaatattacatttgaagcaagcttttacatcaaaattgtgatgagtaaaacattttagaccaagaaaaaaaccttgtattttttctgagcattatcattttgtgaaagtatgaatgattaaggctgggactttaccaaattacacagttaacatgtatttgtgaaaacactgataaagaaaataaaccagaatataatctagtagaatataagttttagatggtcgaaaatttgtcctatttatttctctttttcctgtgactaatagccatacaataaatgtttattgaatataaacaaaagataattaaatgaataaactaaggaattgttttaaacttatgtttgtgtgtagttttacttaaaaactttttgtctaattagaataaaaactttaacactaaaataagtattaaatgactagtatatgtaccataaatctgtttcatttctttcttggtgaaatggttagcatatgtctgccaacctgttgctgcttagctttactgacaattatatacattataaaatacatattttgttttgcactgtttttatatatttttgtattcaattgggtatg

SEQ ID NO: 126904 - DNA, 1050 bp, Homo sapiens
acaatgacatctgactctctaagctgttggtgttgatgtggtgttctgagtttcccatgcctatagtgtcagtactcacaaggatgaaaatgttgaagagaagtttctgtcttctcaaacttcactttttatgcaggatgtaccttctaagattgagttattgtgcatgataagtgtaatcggagagttggcaagcaggttaaacataattgaccattctgtattttcctgtaatggactgagaaagagaagagctttatagattgggaatgtgaagtagatgcatggaaataattgcagaaaaattcttttaaaagtccctagccttccatctacttggaacttcatgtatattcctattttaaaggttttatttataagaatatgcataggttttcctttcttgataaactagtgttctttgtgtttggcaaataagtagtaactgcaatttgacaaataaagactctttatccccattttctgatgcgaaactgagataggaatattataaaagaacatactgatggggagagttagaagataataggaacaattaatgaatctaatgtactattgatggattgttccctctccaaaaaatcacctattagttattgttgtgagttatggcatgcttataaagttcctgttattatttctcttggtgttgagtcatttggttttttatttttttgctctatgttattatttttgttacagttaatatgcattcatattaactatatgaatatatagttcgtatgttttcttggggaaaaatacttaaatacttctctgagactgatatataaattggaatgttaatgctgaactcaaagaaatttcatgaggatcacataaattgggttgtaattatgtaatgtattatacacatttatatgtaatatatattacattatacatgtacagaaagagatgtgcaggcctgtctatcagcatgcctgtcatattgtaagatggcaaatgttcattttcccacacctcttctttagatctgaagtggatttcctaagagcacagcaaatt

SEQ ID NO: 126905 - DNA, 1214 bp, Homo sapiens
aaaataataatgtggcatcatgatggtaatgttgggatttcaagtcaagaactttggaagaggtttaatattaaaattattttctgaagccagagtatttaaagatcacagggttagcttttcccaatacagtaaaaatctttattgataaggcccatcacttctaagaaagacacagctctgtcacagtgctcactttggaggaatggaaagactcagtgggattgcagatttgtctgaaaatatttttattcagtttctccttccttatgaccaataattcatcaaggtaggttagcatggataataaattaaatcccaggcataatatgtatgagtatgtcttatatcttaaaaagtactttatagatatgtaatcagtagagtgttataatatcctcatatttgattttagtttcaaaatcaggggccattggtctcatagatattatggtgttttatatcttctggtttcagtaaagctaaaactggattcatttttttccagaatgagatgacagtttgtgccgaattacttacatgttctacctgatattctgagtattcacactgaaacaattggcctgagtagtatagcctagtattggggtagaatttccttatcaataaaatgaaaattactctgttaaatatatttagtaaatattttgtttaagaggctacctggcccttttctattattgataccatagtgaaatggaacggacacatctgctgtggtgagatggagtcctctccactaaattaggagctagcatcaggatattaaagaggtctttttagagtatattcaggtatgagtattttaaatgtcacaggaaggtggatgtgatgtgcttttatcctatttattttttgtttagaattttctctttggtttcaggcgaaaatctccgaaagtttttttcaaacaaaacattattgaagaattgaaaaataactattttcataatgcatgtatcagagttccccaaaacacttctgataaaatttcatagcaaaaatatctccaaattttatgtttttcataacagaagagataagttaatactataaaaatgcatcctcaaaactgagctttcaaaaatgctgtgacataatgcactttttactcttaataatccaaattagactaccttatcttagataatattaataaaactttgcttcttaggagggcacaatgataagaa

SEQ ID NO: 126906 - DNA, 1014 bp, Homo sapiens
aatttgtttaacatggagaacaaatccctgtcactaccacctgtaaaaacttgctagtgatgttccttaaagttcgttacctgaaatttcttactgataatataaaatatggttgctgaaagaatctttctcatagaggttaaatgagtttatatgtctgttcatgcttagcatttcctaagtgctggtgatgatgatattgatgatgctgttagccacatcatttgggatcaagtagaattatctttgtccgtttacagctggctttgcttccatttgaaaatagtgcaggaatttggttaatactactccagagattagagattagcacacctggaggactgcatccaatttctggtactatattttaagagagactttaatgacttgaatcatatccagagaagagtgacctgaattgctttaaggacatgggtttcttcagtatggaacaaacaaaacttagagaaaggctagcataatcaataacttgcagggctgccctatgggatgtagattagattcatttttttttatttctaaaatagaattggttaagattagaaagaaacaaatatctcaggctaccatgagatggaaaaatctatttactcctaggacttttaaaaaatgtaatagggtggctgggcgcagtggctcacgcctgcaatcccaacactttgggaggccaaggcgggtggatcatgaggtcagaagttcaagactagcctggccaagatggtgaaaccctgtctctactaaaaatacaaaaattagccgggcatggtggcgggtgcctgtaatcccagctacttgggaggctgaggcagagaattgcatgaacccaggaggccgaggttgcagtgagctgagatcatgccactgcactccagcctgggcaacagagcaagactccgtctcaaaaaaaaaaaaaattgtagggtgacatataagcaactgacctactatttactatataatggtaatgtctgtcagtcacatcattgggaggtt

SEQ ID NO: 126907 - DNA, 1190 bp, Homo sapiens
gaccatggaaggctaggaggtaactgtagaattaaaaattagagtttcagtttttgaagagtgttgccaacagcacaggcaatcttgtcagagaaagaattatcctagtttttccttttgctgggaaattgtgagttgaaccagatttccagcaagcaaaatacattttaataggtattctcttttcctagctcaaaatagttttttttatttagaggaaaatgtattttgtttctacttgaggaatttgaggtttattgctatttttataaagtgaatagacactattttatgtgtcttctgttacaaaaagaacaactttctagatgggagagatgattaacttgcatatcagggttaggctaattactactatctgtaattttcccaaaatatatctggaagctgcttaattgctatagcatttttaaaaaatctctttcctttctcatagtttttcccaccatagataattctcaattatttcagggaagttgcctatctttgtatcccctgaagcttctaacattttagtttcttagtaaatacttgttgaacaaaaagaaataccaatctagtccagtctctggcagtaaatacttgttgaacaaaaagaaataccaacctagtccagtctctggcccttgttacctgttttttgtagtttgttacctgttcatagaatcatttaggatttttgcttctgggtaatagtgccactgtaattcccagagctttaaaatggtgtcttaatttagatcttttgttagctccgttccaaaatttcttcctcattgtacaatgtaaatagggcaaagataaaaaaatccaggcttattccttttttttggtgaaatactagatatcaaatggatatcacattcatttatttgttcattattctcacaatagccaaatcgaatcttaaataaagggatcaatagagatgatttaaaagatcatgtcaactgaaaaacatttagcagtatggcattttctcctatagttgtggtctttgaatacatcataattttcaatattttcccttcctagaaaataaatacaggcaatctctgttgccttaaagggttttacaagtaagttttattacttgagggtgcagaaatgccaagctattccaggcaagtgaccaaataatgtctgggactctttttctggcaaaacaacta

SEQ ID NO: 126908 - DNA, 1519 bp, Homo sapiens
agtaagtctccttcctgcttctgtcctccagccatggttcctctctacagaggcaactacacatattcccttttgacttatgtgcatatgttcacaaagctgcttcttgctagatgaagatccaaatccttagtatatttcatatacttgcatgagtatatgtcttcagttgtatttctcagcatattctctagtttcctctcctccagccacactgtacctagacatattcttttgttgtagatcctaccttgcttttcccaaactctacacaacatatgcacatttctaccctgaaggttcttcctccttctttgcacctatttagctcaactctcccaggttagacaatatcttctcagagaaatcctccctgaacctacagttcagatcaggcccctttaagacaatattcatgttttgctttcataacatttatcacagtttgtatttatatatttaatgatcatttgcttaatgtctttctcctttgcaagactgttagtaacattagggcctgtgtgttgctcgacattgtttactcagtactggcacataaatagttaagaaacatctattgaataaatgctcaagaatcctcatttgcttgtgggaggtatctctttcattgtaatccattcacttatttcttgtctactgttttttatatggccagtctcctagaatttctgtcccccgtggatttaatatgttttaactcagcaactcttaaataagcgtaagtattttggatagtaagaaaggggaaaaagaagtgaaaactgtaggaacacaaaggatgatcctgtcacttctgagatagacacactgtatttgagctactgtaccaatgagcattatgatcagcttctctatggaaggtataatttctcccttaaactctccaaatatatgtgactcccagcttatgtgactttcgaactctaagatccacaagggcagaaattatgatctatcttgctcactgctatgttcctagaatttacgactattcctgtgaggtagacattgactagatattgtctaactggaagtttaaattgaatgtggccatattgtgtatttacagaagtattgtaggaagaggaacttgcagttattcagggaaactctggcacattatgttactaatgtcaaatactggggagacatagagaagtattatttgtgctcatagttttggctcttcttttctctagtaaatgtagtaggttttgtcacaacatgatgggtttgccttgtaagaaaaatagagattttgttagtccagaaacaatcattttatttgacaatgttgcagtgtatctgtgacactgagatggaaataataattttttaaagttttccaaacagggtagggtaatgaatgaataagggaaatagaaaactaaccattttaaagctttggttagatgattgattagtgcatatgggctactttgaatatacagtatctgcactggtttatttctaatggacaaagagattactagtgtta

SEQ ID NO: 126909 - DNA, 1081 bp, Homo sapiens
gtaataacttattataaaacatgaagggattggttttagttctgttttattttatcttctctgtgttgtatatttgtgatgtcttcaacataactacttactgtattacttttaacgtactctttaaaattttttattacagcagcagcacagcaagtggataaaagcacagactctggagccagcctgtctagattcaaattttatttactctatctgtgatcttggcctcattaagttatctctgttttagtttttttcctatggttaatgatagtcccaacctcatagaatagctttgaacattcagtgagttattccacatgaagcacttagaggaactattagtattcaagtgtttcataacaaagtataatcatttgacaataaataaactaatatactcatttggtaacacacacagacccacacacacacacacacatacacgtatgtcatccactgtttgcaattgtgagattatactcccagaagtaattttagaatgaataaaggtagaagcaaataaatctgtgaagtgtcctctgtgaagcttaaaagacagaaattattgcaataatctcaccttaatatgtcttttttaaatagtatttttgccccaggtaaaaactgtcatctactgaaatgtttttacaacaactttattgagatataattcatatactgtaggtttcacacttttaatgtacgtaattccatgaatgttaatatatttacagagttgtacattattaccactatggaatttcagaacatttgtccttatccccaaaagaaacgcacacactctagcaatcattccctattccttcctctaccctagggctagcaagcactgtctacttctactttctgtttctatagatttgcctgttttcactatttcatgtaattggaatcatacaatatttaacttattgtgagtggattctttcagttagcataatgttttcaagattccacaatattttagcatgtatcagaacttcatttatttttattgccaaataaaattccattgtatagatgtaccacgttttattatccattcaacagatga

SEQ ID NO: 126910 - DNA, 1578 bp, Homo sapiens
tctgaccctaacacaggcagacagagcagttctctggtgggaaacagcttttcctatggaataaaagccaccagtgcttgtaatctctccaggcatcaggaatggactgtggctaatgaaatggcacagttggttatatggaagccatgcagaaaagcaggtaacctgaagtaatctgctaggagaccaaagagaaaattaatctcaaaaaagattagtagggcatgcttatttctctgagaaaagaatagccaataaggcttgcattttccgccataaagtgaatatatacatatgtatatctgtagacacacttacatatttatataagaattgtttttacttcgagagcgtaaaattctatagtaatgagtattttgagtgcttggaggaaaaacaaaggacaaaacacacttcaaccttgcttctccttagttagctttgtttcatgtttgaattgtgaagccagctcagtggcagagccaattatagcaaatgtctgtcagactctgtcccagggactcagttggaggtttggtgcaagtttgtactgtcaagatgagtggttttttcacgatctttaatgtaatagcaggtaatgtactctttaataccaggaagttcatttgcctgtagtggaaagggagcagctattgagggaagtttgtcagggaggcagaaccaggacccccttgactgacagcctaggaatgagagtaaaccctgtgtcttggagatgcttgaggaataaagatttgaacatacgatgacaagacttatttaaaaattaaaaatagagagcatgtatctttggtgggttatgtcaacccctatgtcaaattgcaatacattgtcaaacctacaaagagatcataatattctatttggttttcatgtcatggttgagattttacgttttcttgcaagtcactgcataataaaggcagacatgacaaagtcaaataaaacgaagtagtactggaaataaaataaaaagtaaaatggaattttgttaaggtttggctccctgacatatccaaatttgttggtgaactgtcagtgtattacttcacggggtataagaatagccagcagttgttttttggatgttttaaataaaaatttgatgagttgcttctttcttcaaagaaaggtaatcttgaacataaagtgattctcccactttttcatatacatcattgtagatgactcaaatagctatttaacattttattttattaattttgttatgtaggttatataaatcacatatacttatttaaataaacagttgatacttgaacagtgtggatttgaactgtggggtccgtctgtacgtggattttttcctatatatgttggaaaattttttggacatttgcaacaatttgaataaactcagatgaaccaattagtctagcaatatcaaaaaagttaagaaaagttaggtatgtcatgaatgtataaaatatatgtaagtactagtttatttatgtgttaattgactgtttctgttatctgtaagacttccagtcaacagtaggctattagtagttaatttttgagggagtcaaatgt

SEQ ID NO: 126911 - DNA, 1055 bp, Homo sapiens
tgcaatgaaccatggtcacaccactgtactccggcttgggtgactgacagagtgagaccttgtgtcaaaaaacaacaataacaacaaagaaaggaaaccgaactaatgtacaatgatttttagatcgcagccatctcttgtgttaaatgtaaactcgaactgttattaagagtttattgattatccctagttcacagcaagtaagatttggagcaatgaggctcttacattccaagtaaaattccttcttgtagttagtttaaccagtattggttttccgtcactattttctttttactgaaattaatttgaaagtctaatataacaattgtagtggtaaaaagggatgttcttttcatggtgaagtttgggttttcttggtgctatttttcttattgtatttaaaaaatcacattctatttgctgatgtgatgcttataattctcactgggaagatcctaaaaatatgtatgtatatggtagataataatgctaatgcctatctacccttattatgtttctagcaggactttagaaatctaagaaataagtagctagccagttagtaaagataaagcagttgggttttagaaatatctattaaaggtactttaaagtagttttaattttatttttaacattttaagctaactattaaatataatagtgtggtataatagagcatatacttctttaattttaataaactaagaaacaagattgagtaataaatgaaacattgtactgtgaaattagtggggatcctttcatttttcataaaaagaaaaaagcaatgatacaggagagccttgttagtaaaaaacttactgggagaataatttgatgaaatgtgaagactctcagcagtgcagtttctagtccaaggaatttgaataagtgttaggaaatatgaatttgtttctgcttcatctaactagatttggtacaatggggtgtgcagttagggagaaaaagtctctggtacttaataaggcaataattcatgctgaatggatatgagcagtcattgaatgaaaaattgatttttatagtgt

SEQ ID NO: 126912 - DNA, 1024 bp, Homo sapiens
atgaattgtgtcaatgtcgacttagcaaactgagtatagatttaatgtaatcccaattaaatattcaacaggattttgtgggagaaatgcaaacgcccaagagtaaccaggtcagtcttgaaaaagaagaataaagttggaggactaacattagcagataacaaaatgcctgaatattaaaatttaatatttagaaagtaaagtaacttaaaatactaagtattggaaagggaagatgtggagcaactagaacttttaaggtgctgatggcaatgtaagttggtataaccactctgaaaaactgttgacagcctagtctaaagctgaacttaagcatctcctatgacccacctattctaatcctaaatacagtccaaaccaaaaaatgtgtgtaattataccaaaaaatctatacaagagtgtctacaacagtattattttaaatcaactgtgaacaatggaaatgtctgtcaagaatagaaataataaaaatcttgtagatataaaattaaattctatagagcaatgaaaaggcacaaactatgacaacacaaagaacatggataaatctcacaggtataatctggagcaaataagtcaaacacaaaatagtatgtattatatattttcatctctatgagttccaagacaggcaaagttaaaatggcagagtttaaaatttttgttacttttaaagaggcaaaatcactgggatggggtgtaagggaagcttcctggaatggtggacataaatgagttcatttcatgaaaatacatcgaagctatgcctaaaatttttacactttacaatatctatgttatgcaacaatgaaaagtttttaaaagtatatattatttttgttcagtagaaaacatgactgtctgtgtgtgtgtatatatatatatataattgcatataaatttccatgacaatgcacacaagtttccattttcatggaaatttatgtgcaattatatatatacacagacagagagacagaggaatataaatgcaaggctttct

SEQ ID NO: 126913 - DNA, 1029 bp, Homo sapiens
catctctactaaaaatacaaaaattagctgggcgtggtggcagatgcctgtagtcccagctacttgggagcctgaggcaggagaatcacttgaatctgggaggcggaggttgcagtgagtcgacatcatgctactgcactccaacctgggtaacagagcgagactccgtctctaaataaataaataaaatcatcagcatcaacttgaaccgaaaataccctttcttagtagaatgctgccagaaacattttaaatttcaaaacacttataattttatgtgacctagtttagaacttctaaaggtacattatgacatttggtggaataagtatgtggatattaagcatatgcttataaaagaagagaagactctccatttaattttggttatgtttatttcatcgatactctaatcataaagcatctattggagaaaggttagactagtccttgatttccagttagattttatattaagcttgggctgaatagtttggaatggaaacttagatattactcacagaacaaattatttgttcttcagtttgataattcaagaaaactggaataaataaccccatttgttatctacattattcaacacaatatgtatttgtggatctttgaaaaaacgtatatgcaatataacttcttaacctgtttagaaacagtatcatagacagttgtatagcacccatgagtatgggaatgtcctaaaagaactgaaaaccgtgattcgaaaaactagagttttggatgaaagttaaatttgcatcttataacagtttttcgtttagaaattactcttagcaattgtaagagcacatcattacctcaaggcataattgtcactactttctgtatgtagtgaacagtgtttagttgcaagtgctataatggattatattatacaatttaaaaatctcacccttatgaattatgtttttactgtcattagtgttgagtttatttggtatgcaacagtctttgatgattctctctatatgtgtatctatatctatctaccta

SEQ ID NO: 126914 - DNA, 1062 bp, Homo sapiens
aattttgaggaatgtgctctgaagcatttgtgaaatttgaatataccatgataggatacctaaaacattcatcattactgaaggttattttgggtatctttttcgtttcctgatttgctatttttttaaccataactgagtaatcagttttatcagatacttttttctatatctattgagataattataattttttcttatagaatgttgatatagtaaatgacatttatagttcctttaattataatccccttgtagtcctaaaagttagcttagtcaaacagtagaaatgtttttatgtatcactggattttatttttatagcattttgttcgggatatttacatatacatacatgagtaagagggcatattattttttgttctattgtcattttctgttttgtcgtcaaagctatattgacttcatagagttgggaaataaatcactcctcccttccatgcccttctccctcattctctagaaaagtataagattgaaatgctttggatattgaaagtctgataaaacttgcatttaaaaatctcggagtctgttgtatttatggaaagattttaaggaaataattccatttatttaaaagttgtatatttatttgtatttttattctttgttgagatcgactatattttataaagatatttctatttaatgacattttttcaacttattggcagataattattcacagaattcttttatatcttttaattctgttaaatctctgattatgttaccttttcaatttctaatatttatttggctctcttattaatttttcaaactcgtcagaagtttatctgaattctttgttttttcaaagaattaactttttgttttgtgattcctgtttaatcttatcttatattttatatttcttcatttttatatttattttatattttttaattttacttttactttatatttctttaatttttattcatatctttgttattattttcaattacctttatttttactttatttctcattgtctaacttcctaaatgacatacttagctcatgaatttatagcct

SEQ ID NO: 126915 - DNA, 1049 bp, Homo sapiens
catactatgcctttaccagtgttctgtttttaatcctctaaatgttatgttctgcttactgcatagtactttcttcttacagctatttcagatcttttgtgctatagcttgttccagtatagtaggaaaagctccttcttggtctcctccccatctattctagtctttacatctgtagttaaggtaacaacagcctagtctcccctgagatatagcaaagctgagttactttagaacaaagacattctcaataagagatatcagactattggattatagaccgaattccctaaaaaaccttcccttggagagtccctgggttggggcatcatccactgcatctcaagtctagctggctgcgctgcacacaaaacctatagaaaatctatcaagccccttatcccttcctaccctcatctaaagctcatgaaactccaccagctaagtttccaactgataccaatccacacaagccacttagggtttaatttaatgttctatgacaaggcagagacatacagatgacagaattgagactaacttccagaatattgacagttaggggattatcaactttttttcagagtgtcaaggataaacaaagctagacactagttaaagcactgaggagagatttgattcggtaataaatagttgcagtagggaagtgagtccagcatgaattgaactcaacttcaccaaaacaaaaagctggagactttttagaggccagggactggcactgaggggtgttaaggggttggtctatgtgatgaagccacgtgggtttgttaattgacgcctctccagaggagaagcaatctatctttatgacaggaggcaatggtattagagcaaggtgcccactcgaagttgggccttaactcccacagggtctgggagtgagagtgacagttgtctcccagaatgtttgcatctcatagagcgctcaggtccttgaggaaacagtttggggtagcagattgtcccaaagggcaaaaaagcatttataattgcaagctttctaaagcaactgctctataagagca

SEQ ID NO: 126916 - DNA, 1037 bp, Homo sapiens
tcccttatattatatcccggtgaagataatttagtcattgggaagcatgttcgtcaatacactaaaggtaagggaaactgcaacaatccatttgttttgtggagtttggggtaatatgatttcagttggtaaccttctgatattatttggtttgaagctgaggggcacctgagttaggatgtgcatataatcttgagcttgaagtatgctgaaaaatcaggtaaaccagcaaggttttgtgcaaaatgggatgtatggtcatttttcgcagagcagactgcttctttatggtgaaaaagaaatgttttggatttgtggttgatgagtggagtcagcagggaacccataaaaacagtccagaacagagcatggtgataatcagttagttagggtccagtcaaaagtagctgaaattgtatattcctggacataatcagaggaaagatctaaagacaggctttgatgagagcaggtgtggttcatgacgtggtcagatcaagtcccctcacatgggaaaattgtaaagtggtaaataagagatcagactaaatggtagaacattgccaagtgatatgcatcataacagcttcacatgggcttgtgatagtgttgggtttttctgtggtgtagtgggttgaatggtgacctgccccccctccgaatgatgtgtccatttctcagaacctgtgaatttcatcctacttggaaaaggaatctttgcagatgcaatttaaaggacctcaagatgagattatcctggattatccaggtgggctctaaatcaaatgacaggtatctttatgaaggagacacagaagagacacacagagaagaggtgaaagcagtggataggcaaaataaaggcaaaggttgaagtgatgcagcctcaaaccatggaatgactggaaccaccagaaattagacaaaataaggaagaattcttccccagagactttggaggaaatgtagcccgatgacaccttgatttcagacctttggcctccataactgtgagagagtaaatttctcttggaagc

SEQ ID NO: 126917 - DNA, 1434 bp, Homo sapiens
aaaacatacagatgatgtataccttaggtaaactgggagctagggagatgataggaaccctcagacctcattattttgacattctaggagatgtgtcgatttgtaggattatcttttctagggctaaccttttggtcacattctctacctctctaagtccacttccagtgctatcaatttcttctggaaatgactgccacaggctttatttcttaagggtattggcctaaactattgtattgtgggctcctattctggctacagccatctttcaaacaactgtgtttttggattttatgttactgccagttgttctggacttttgccccttctgtggtgatctagggtcactgcagaagaaattaattctgctcttaaattggcctttatctttttgccaatctacctgttgtttcctgtacatctagattccctggtttgaaggttgccttgatttcccaacataattgttggatttccttaggggagaaaaaataatactaacaagactaacgagagagagaccttatattcttttataagaaaagatttttaatattgggtttttttcttccaaatggcaattcataatatgtgccaaaatatactgacatagtttcagcagtttcaactgttacttgaatgtatgcatatgtatagacaaaacagcttatgaatgtatttcatcagcaatatagatgtgctattacaaatcatttttatatctacatatcttttgtgaaaccggattaacgtgggtgcttttaaaatctaatataggaagttaaataaccaaataccaccatgaacaacaaacaaaaggagacaataaaagaagagaaccactggatctgatagaaatgtagaaatactggtgtgccagtgtagtctgtgacatttcttcatgaatgaattttgttatgtgttgaattgtgtctccccaaaacatgaagtcctaattgtcagtacctgtgaatgtgacattattggaaaggtctttgcagatgaccaaatgaagatgaggtcattaaggttggctctaatttagtatgactgtgttcttataaagcagggtactctggacacagagagagagtcacagggcaaatgctatgggaagattggagttacgatactgcaagccaaggaacaccaaagattgtcattgtcaggaaaccaccagcaagagagaggcgtgggacatgttctccctcagaacgctgaatgtaaccaaacctagtttcagaagaaaccaaccctgaatgtaacccaaactcaagtttggttgttcactgctcaaaaaccaaatgtgagagatgagatttggtgggaagagaagcaggtttttcagaatcagccaactgagaaaattttggattaacgtcctgaagtaccatcttaagtcagtacaaatttcaggctatttttaagtga

SEQ ID NO: 126918 - DNA, 1036 bp, Homo sapiens
tttattttagccgtaagaagtaagcagaaatgtggaaacaatggtaagaaacccttagtatactttattattgtgttagcttttatcatgccgttgaaaatagttacggtcaactttttgttattgtttgtggcataaaactagattaaatgatgctggtcatttgtttaggtttatataaaacctgcacatttatcttagtatctgcttccaaaattggaaagttcaagtttttgtattttagggcaagagaaccttcatttattcctcttattggtcatttgagtttatattcattgctgtgcttccaactagtagctatatatgtggggccagagcttctccatcaagctgggtgctcaaatacaggatttacccatttgttaaattatgattcatctgacattatttagaacatggtaataatgaacaagacagggaagatccctattcatggacattacttacattctattaaacaaacaaataagaaaatagcagaatagtgataagtaaaatgcagatataggattattcattagaagcgtgtttcatgttatgtgtttggggaaatattatccattcttattttagaaagtcacatgaagatattgctatatttattctccagccaaccacacagcagaggaaattaggctcagtgatgttaaatctttcatattaagtggctcctaaacatatgtgcaagttgcctagtggcaacaaaaacaatatagtaataagaacatcaggtaatgtagactcctaattatatttaaataggcctatgtattgtgataataatgtaataatggtaaaataacatagtaataatggtatagtaaaagtatagaaatatggtataatattcggtggttataaaaattaatatcattttccttgttccaatagaatcaagtaaacactgtaatgtatgttattttaatattgctagatttactttaaggaatcatatttttgtatccaggaaacagcatagaaacctaatatacagtctgtcaaattttttctcaat

SEQ ID NO: 126919 - DNA, 1344 bp, Homo sapiens
tcttaaagatatagtaagtcttctctttctactcctaagccctctatttcccatgcctggggtgggttggaggtagagaaagcaccttaagctaagtcagttcaagatcataaaagctatgaagaatgacaatcctctgaagcttttctgtattaaaaatatcctccttattctcttacccttatctttgccctagttctttgctgaagaatgccatagtttcttcagtatttgtagagtttaggagaatgtggaccaatatttatttattttttttttcaggacttaggttatctgtgataggaaagttagagtataatctatgagtagagtgtaaacacactaaagaaaaagctgtagagaaaataactgccctatttattaagtattagtgctgttcttctggtcattaatgtcaagctaatttcttttctggcaggcccttgtagtatttttttttttttttcattaaaaaaggtgggtgacatgaaagcactgatgtcttttaatagttatcattgatacacaggcctctcaggcttctgacaccacaaaggcaaagtttctgcttttgagacacatctttctgcctcttttgtctcctctaattgattttgttattttaattgaaaacactggttttaaagaatggaattctgtagggccctggttagagaatagccacaataaaaagtatacatgaattatcttatttcttctgagtggcactgtttggctgtggtgcctctagaccattctctaccacttactccagtttgcacttgagggcagatttttctcaacggtactagtaggtgcagtaatggagctggctgatgctattggaatggtgcttgaacaggaggaacttttttattagccatatctgtagttctgatcttccaggaagttagctagttataataattcccttggcttaaaaagatcatattaggtaggaaatcttcctattgaaaaagatgttattctgtaggactaatagctaaataataagctaatatgagtaatgacactactttggagagtgtcagtaataccaagtttttcaagtggccactctctgggtccccttccattgtgtgcaagtgccaattaacagtttacctgtactagctacccactcactagcaagtacaagaaattaactcctcccaggacaaaacaaattacttccttaaactgccagatccaactacgatgagcagagccgtctaataagctcttatggactgaatgtctactccccaaattcatatgttgaaatcttaactccaaatatgatggtattaggaggtggagcctttgggaggtaactaggtcaca

SEQ ID NO: 126920 - DNA, 1546 bp, Homo sapiens
cctcctactcctgctcctgcttgtcaacaagctctctcacctgcgtctactacatagttcctggctgtagaaatggaaccaagtagctttcttttgtagaataaatggacttatccttaaccagcaatggatgattaggatgggaaggtagggtggagggatgtgtatagaaagaatgtgaaacttgaagtgccctttaaaaaaatgttttcttgttcagctcagagtagatcaacttctgtttggcctgactttatttcctaaagacagtaactggtctcaagacatgtttaagagtaaaaaatgctagaatcttcttaccttagaagccagtttgtgctactactgacctgtcaggaggaatacttccatgtcaggaggaaggaatatatcagtatttgcctttagggaatttgcctggaagagtacattaaaagtcattcccagtcaaggcaatttgtttagatgtaaaagcatataagttttgtgtgtgtgtgtgtgtgtgtgtgtgtgtgtgtgtgtgtgtgtatttgagcagcagcattttaccttgttacagattttaactatctttctggaagtattctgttatagtgaatgtgactgtaatgtaacaaacagattttacatgctttaatggaatttaaattgctctgtgaggctaaatgaaatagttaatctagacttttgcctgggttttcttacctgcattttgggggaggaatgttcaaagaatatttttttaaaaaagaatatcattcaaaatacaaaataatatactgcaaatgatattaataaaggtcatataactacattagaatgaagacttgtaagccaggctggccttggaaatagttgtgagtcaggcagtatgcttttgttgcttctcacccttactatctctttgatgccttcttatctgccactgcagtggtcagttctttcctattccgtttgcccgctcaaagcaaaaggaagaagtattattgatgtttgctatgggtcaggctttttattgggtgtttgacatatactgtcatttagatgactgttaaatttgtggcaccagctctccttccccagctgcaaactttgtctattcaaattgcctagttaagatgttgtagaatttgtttatatcacatgatgttatacacaaatacctgcttaccaacctaccttcgtacatacatattgataatcctgttttatatagataagcaatatactcatgtaatgtcagtgaaaagtgtggctttttatgccagactgcttgaagaaactaaggctccagagactgtcacctgcccaaggtcacatattgttagtgacatattgtagtaaatggatttcgacctaagtgtggcagacaccaactttcactcttgcaagtatttttaaccacttttctctaccttacgttcctattgttctattggtgcataacggagtgaaatatttctcttaattttgtattttttgtgttttatatatacatatattttatgcaaaataaaaatagttttcccttcggacaaatctaaaa

SEQ ID NO: 126921 - DNA, 1619 bp, Homo sapiens
aataaatgagctcacatatataaagcatcctgaagacagactcagtccgtaattagactttcaatgaaaatatatgtacatatttgcttttaaaaataaaaaatcctttataataaagtttctacacaataaaaagataatgtggcaattgataaagagacatgattgaaattttgcactttactttgacttctagtagtgttacctcctatattcttccagtctatctcttttttattccttgcaagtttatattttcaacttagtctttagaagcagctgataatgtccgtccagtttgtattgagatcatagaaattggtatcagttgaaacagaatagataagttttgaaaaaaatttgtttctagcctctcatctaatcttccaaaaatattaatgggatttaggtttctactgtccttactactttaaatttaaattagtttaaattgaaattatgttaataatccaataaacttaaaatctttgtaattttatgtaaatataaatggaagccaaaaatctattacttcctgcctctttcatatactttacaatgtaagttttatgtagtgcatgttatttcattaagacctaacatattaaataaatatactaaatggtgacagttttaattgttatttttcaatagtttggtttttaaaaacaattcactgaaacacatttctgcttatggaaaatcatctatgaaaacgataagtaaaattgttttgtaatatttttgcataagtatatacattgcaaaaaaactggaaatttagtgtctacatgttagatatgattatagaagttgatactgggtagagctaagtagatatggtcttggtaagtaattttgtgatttctaatataaggttagatataatgcctacctcacagacttggtgaaaataatttataaaggaaattttataaagcaatactgttttaggtgttaatcttttatttagaaacaaatattgattattgtttttatcagctccatatatatttgactgtgaagacatatgtactattcattcacaacatctattgagtacttgttgtggactggggattgtggcaggtagtggcttttgtgataaataagatgaggttcttaacactgttgaagctcatagttattgaaggagaggaagcattgaagcaaataattatggtacaaaattacaaatgttataaacaggtgtaatggtacaaaggaggggtggattctgctgggatctcaggaatctttctcagaggctgctccttaggcaagataaatgagtgttgacatgactaaatggtagactgtcataggtagattgaatattaagtaaacatctactccactattaaaagagtactaaatgtaggatgaatactcagttcatcaaatgtttattgaaaagtcacaatagacaagttcctttactagctacagaagaactagaaccctgaaaagatctggttcttgctcttcaggggctcacagtcctacaggagacagatgtgtgttcccagagggctgtgccccaaggcagaagttgagtaaaggtgctgtagaaactttgtgccatatgaccaggccatggtatcactgccaaatcccga

SEQ ID NO: 126922 - DNA, 1189 bp, Homo sapiens
ttagggaatagttatggattccagtttgattgcagcatgtgatacatgctggaaagtatgaatcactgcttcacaaggagctgtggttaaccagagtgacctggtacacccatgttgtaggaactttgagttcattatgtaagttgatccacacagcagcccatagggtaataataactgcttgtacgggttaggaaaataagactcagaacttgcttaaagtcactctgctattgagtagttgagccaggaatatgaccgagagccgttctgacctgtgttgttactcacagtattatatgattctaagggcagatctggagccatatttagaggaattgtcacatcagatcaaaacttcagccagtttatgcagactagagagagcatttttttcttttttcaaaatgagtaaaagaaagtctgtctttattttcccattagtaattgcattcttgtgtcctggaggacaggaaaagaatacatggcttcaaaatgccatctttggaatccttggtgaaaaagtgtaattaaaacccagatgtccctagatttagattatctatgtactcttcattcttctgtgcaatattatctgtctactgatttctaaattatatttagtcaatgttttttcctccttctttgttattgttgcttactgtaaggtatatctttgctttaaatccctactaatgtgtgacaattctaaagtctgaaggaacttttaatttgaaagtaattgcctagcatcaagagtaattttcaaaggagcaaaattattttaaacattttaaactgcaattttagtctttagaattagatggatttgtcatttgatagaatgtaatagtattgagtgaacacactgaaagctatcgcattgtatagtagttctgctgagttttaaaatatagttgtttttcccatccttccagctgatacttccttaactgatgacagatggtactttggtttgttgaagcccaattctatgattattttatctttgattgcctttttaaagacgtatggagatatcttcatcaaataattagctatattaccttgagaattattttactataaatacttggttcatttttgttttgttctcttctgtttgttttgagatggagtctcgctctgttgcccaggctggagcaccgtggcgtgatctcagctcact

SEQ ID NO: 126923 - DNA, 1096 bp, Homo sapiens
atctaaaagaattttccaaaagaattttccacaaggaaaagctctttggtttttcactatagtactataattttgttcaaattgttattgaataaaataagcaacaatgacaatattagttcttgcaggagtactaaatactattggcagttatgttaatgggttcttcctattgtttgtaatgcctttttgtcttttatctgtttgtggaattccttttattcctcaagttctaggtgaaatctccatgaactgtttctctgccagggcagagttgattgcttttcctcagtggtcccattattgctctaaattatctattatggatatagatatttattatgtctattatttattacagccatataacagtgtattataatggtatatgtgtctgtttcttttttttccagcagatagtgagttcttcacgggcagaaataataccttcctcaatttttaaatgtaagcttccaaaatagaacccagtatataccaggttctttagttgggaaagtagacaaacaaaatacaaacaaaatgttctgttgttcatttgtaataatccctactgttgggcaaactttgatggtgtaaataaagccaatatgtttgaaaattttatatagttccactagatgtaataaagagattgattaaagatccaacaagttaaattaaacagtattacactttcgactgtgctaataagacatttttgaaagattagattatgctttattctaagaaaagacaatatcatgaatcctgctttattaatacctaaatatgttatatcacctttggttagttttgtgtggcagaaaggatacagaaaagtaagaatagaaagaaattttaatatgctgtacttttccctgtaattttgtaaactcacatttcatatgtacaataaaaataactctatacctttattaaaacttcaatatcttcatttatattgagagtggtagcaacataaaattgaaacctgagagttgtgaaggatataaagtcatgttttaatagagaaactaaattgctccttcaaagagcctataaaactgaaaagcattcattataaatgtaataaaaa

SEQ ID NO: 126924 - DNA, 1041 bp, Homo sapiens
tcatattgtaatttacttttaacagaagcagatcccaaattgcattttaaaggtagatgcctctcatgagacatttgcatcagtgagcgatgtgggcttgtgaaagtattttcaaaactaatcacagcaggatttgtctcagtcgttgaaacattgttggacagaacaagataatttcacatccactagaggaatgatattattttagaataatattttaaaatgtagatactataaaaggtaaaagaatattttttgaatgtcagatttatttcctttctgagtgtacattgggatggttagactttaaaagtataagtgatttgtgagtccattcagcagttctatagtgtgagatcttttgtattatcaaagtaaccattttaaactattcctaagaaaattcttacaagggtaaccaatgtaatggtcttgagacatggaaattgtttccaagagaagttttaggatttagtgattttttttcaaatatttgagagctatctttttggaattacattgctttgctctttattatactgcataaataccccgaggatcttttttgtttttttgatttgttgtatcaaacctatgtcccttcctccagaaaatggacaaggtgaaggcaaagaagaattattttacctaatgtttgatggtgatagaagcagaacaagtagcatcatgaatctaattccttgggtttctttggtccttcagttttaattgaaaaaaaaaaaaaaaaagaaccagtataataatgtaatattaccctaggctactctttcccaaacattatttcttttttattgttttaaaaacctatgccttatattttctgactgccttatttaaagtaacaccttccccaataatctgtatctatcttgccttcattttcttcaaaacgcttgttgccatctgacatactatatatttttcttgatttttttttctgtttgtttccttcattagaataaaaactccatgagaacagggactggtatctgttttgttttttgctgtatcccagtgcca

SEQ ID NO: 126925 - DNA, 1025 bp, Homo sapiens
tattatgtattggcacttaatgcaagcaggtcacaaatgaactcgccccagctagtctgactcctgatatgaatcaaataaggcccccctcatcaacagcctcagcttgttcccatgggctcctctgtggaactcagtataggattagactcagctctagagcagcaactgggagagagcagaatgggagcaagatggcatggcctatagttcataatttaatcttttttttaagtgtgtaaatctcctatattttttgttattattaatttttatttaatgtttttttttactgatatggatagtttacaaatttaattcttgaattcaaaaattcaaagaggtaaagttggaaggagggagaaaaatatatatttggttagcaagagacctttaatctgtataaggtcctgtgacgttcaatggaactgattttcctgaggagttaggaaattggctctgtgacaatctccatagagaagttctttggacaactgtagcagtgataatttccttgaaagaaatacacaacaaaccaagtaaaaacactgtgaagggcttcacttattgatgtatgtgatgggctgaatatgtcccccagaattcatatgttgaaacttaatcaccaatgtgatagtattaagaggtggagcctttaggaagtgattaagtcataaggctagagctctcatgaatgggattagtgaccttataaaagaggtggaaaggagggtcttaggcctgttttgttttgtttttggctttccacctctgccatgtgaagacacagtgttgtcccttgtgtactttttgcccctcctgcaatgtgaggatacagcaagaaggccctcaccagacactgaatgctggcaccttggtcttggacttctcagcctccagaactgtaagaagtaaatttctgttccttataaattacccagtctgatattttgttatagcaggaggaatggactaagatagtgtatgaagtttgatatattgatgaaaaagaattcattctgatt

SEQ ID NO: 126926 - DNA, 2334 bp, Homo sapiens
cttgatctgctgacctcgtgatcgtgatccacccgcctcagcctcccaaagtgctgggattacaggcgtgagccaccgtgctcggctgtgagttcttactttctgaacattactttcagatttctgaagaaataaacaaattgtgctctctaagttgtcatcacagattcttataatgctatcagttttaaactataaacatggaggcagcacccatgggagtaagatattgaacgtttacagcatgtgtacataagttacctcaaaggataattagatgattataatgacactttctttgagatagctaattttaaaaatctattgctcccaagtctaattatttgagtaatgataacatattagcaatcatgaaacttcagtcacagccaaccccattgaagaaaaaaaagtaaatcatagcattttctataaagacccaaaggattgcaccagaccaatccttgcattttctgctgtgtattctatgcccagcctcccatccgtgtgtactctaaactacctacacatgtatcattcatgtgatttcactctatttgttttcatttgttttataactcttcctttggtaccagggagataattttctagttcttctccatcctttgtgaacctctgaaagaaggcttttataattagacttcatagctttaacaaacatttcataacctgccagtaaaaatgtcagttctctgggccagggcataattaaatgagtaagtatcagtgtggtaattcagccacaaaataaaataatttaaagggtctattaattaagggcttgctttgattttggaattctaatcaacagtaagctctgtatgttatgggtaaaaatcttcttgctttcaccgttcccttttcttggcctattacaaatagtaaataaaataattgtatcaatgaaattttcactttgttgttcttttttgaatgattatgcacctgagagaatgttgttaaaatagcaacatattggatatggtcaaaatgaacattttgctatgagcctttaaaaccaaacctgagtaatacaagcaatatataaacggtatagtagactctgtttgagtccattaggtcctgactgaagactgaaaaaacagtaaaagtggaatcctggaagctaataatagtttgtttggtagggggtcttttgaactgagagcagtaggaggaagacaaatgtgtgaaatgatgggcaatataatgatagggtacagcgaggatggattaactattggtagctcttgtaacaaagaaagaaaagctaattttgtagacaaacaaaaaggctggtagagtaaaattaatattttagaatagaaaacctctatctttgagctgggtgtggtggctcatgcctgtaatcccagcactttgggaggctgaggagggcagatcacgagatcaggagattgagactatcctggccaacatggtgaaaccttgtctctactaaaaatatgaaaattagctggacatggcggcgcgcacctgtagtcccagctactcaggaggctgaggcagtagaatcgcttgaacccggaaggctgaggttgcagtgagggattgtgccactgcactccagcctgatgacagagcaagattctgtctcaaaaaaaaaaaaaaaaaaaaaaaccaaaaataaaacgaaaaagaaagaaagaaagcaagcctctatctttgctaggaattaattggtggtttttacatttttaaagatgtatttgaagtctgggaatgaaagagtaagcagtttcttagaagtcagcataataatgactaacattaattgagctcttacattattctaggaattgcagtaagtgctttatggctataatctcaaatcttctcatgaccccatgaaataggttagtttctatgaggaaactgaggcacaaagattattagtggctgagctacttaaccaagacagcctatttccaaaagtcaagtgcttggctatcactctgtatcctttccaaggtatattctattgataatgatgctttaagtacatttctaaccagggcagtatcttaatgctgattttaaaatggagactctggaaaattttctattgtacaatatattccaaaaggagagacacttccaaggttaaatcattgaataaatttccttaaaaatcttaaaaatgttttttgtaaaacttattttttattcagaaagagttgaagcgtgataaatggcaatttctggtcttttttttatccacttatttgaaatgtatgctgggtgtgctcatctggagcctaagagtaacacctaaggaaaatcatctcccct

SEQ ID NO: 126927 - DNA, 1089 bp, Homo sapiens
agttttgtgtaagagccagcctcaggtttatattagaaagaatgaaagtagaatttgagcaaagaagtttctgaaagaggagaaaattaatgttttgccacagtttccttctaaagcttacccaatgattgacatacttttcttttttaagtgcctatttgtgggtgatctgatactttttgtatctaacctttcttttattattgaaagaaataagacaaaattcaggaaggagagaatgtatatcttttttgaaattagactaaatgggtgccttccatgttttgcctgttatgtgtagtaaatttgatcttgtaatataaaagtagctatattcaaataggctagaatatcttcatgattcttgtttgggaaaaataattgttacttatttgctagctgtattaactgtgcagaagctggaaaaacattggattttgggtcagattcagattcgagtgtaatactgttacttagcaactttttgattctgagtaagacacttcttcaggcagaagggtatgatcataagtatgcatgggaggctcaccaatgaatagaatggctcatgtagatgatctggaaagtacttacagtgcttaggaaagagtacttctatttttgtttttgtttttttcttgtacatatataatgtctctgtgtggttgcaaccattgacacttttaaccaatggtaaatataaggagtgatgggtactatggcaaactggtatctgaattcacagtttaaagtatgtagattgcggtgatatgtgggaatgagggcatagttttgcaagaactggtttttgatttttgtttttctttctaaggaggagacttaagtttggagtttttctgtgaagtttttcatttatacatgtaagcatttcatcagaaaacaattttgctgcgctggtatgtgtcaaacaaaacaagtctttgagccagatctggcctgtggctgtattttgaatgttctactttaatctctatctctctctcttttttttttttacatggttatggagctctggataatctacacagtatgtactagagtttgtttaaatgttgaacaagatgctga

SEQ ID NO: 126928 - DNA, 2730 bp, Homo sapiens
acaagttttagtggctcaacatagatgaattttgatcttgtatagatattctaagttgtggatgtatttgttatttcatattttaagcagaactctgggattttaagaaaagtatttattattttgtattagaagaggcaggcccttgattttcaagatttattatacttttgtaataactggctgtagtcaggggctcagatatcagaactgttcatggggaaagtaatttccactgatgtcatttctaaccaagtgagtgacattgatgtacgtagccctggcctataactggtcagcctgaaataattaatcagaaaaaacaactattttagtacctgactgaattaaagccttattggtaatgaactaggttaattggagttctcccatctcgagactttcacaactgtctttaggttaacgaaaatattttagatctagctgagtgtatagccttggatatttctgtgatttcttttaagatcatatggggaacgttttatttacgttgcctggggtttattggtgcatttctctttaacattgtaatgggaaaaaaaaaactgataaaacttttgaaaatatggtgaaagtttccacttgtgttttattaaatgtaggcgatacaacataatagcataggtacatgcattctttatttgcagctctttcaggaggaagacattaattttcataagaaatatgacatttataagaattgaaaagtttaaaaggaagtgcacagaaattggtaagacttgtaaaaccttggtttaccaggtctggtgatgtcttgcataagaaaacttcagaacagagcagatacttgggacacttgtttatattttgctatttgtttactaagaccataaatgctaagctaaacaattcatatatagggaaagagtgaataaagagagaagattttattattttccttaggattcaaattttctgtccatcatagaatcctttgatttttacttcttatgaaagcacaaaaaggcaatagcattttccgtagctcattattttgaaaagaaaagtgaagaacatgaaaatactgctcctgttgattctaacacccacctccagagagataccgaagactttcaattcatagtagagatctaatcttgccaaaaatactaaacttaatttttatattaaaaataagatttctagaatatatagggaagatgattgatagttatttcatgtcaggcagtttttcttccttgtattagaatttcattcatattgattattgtttagtatcataattttgaggtaaaggattacctgaaactattgtaatttgcttctaatcagaatataaaatatactagttttgttattgtttataaaagataaagtaaaggagattggataattctgtcacaattctctttctgactcaacggacgttattagctgtactcagcattgatatccctttattcctttgcttacagtatatcctagtttcttcatgtagctactctgctctgctgtaggctaaatgcttcaggagaagctgaccctaatccaagctccatgagtgggctttattagtctaaggtgaacaccatctttcttaccacttcttgtttcatgtgaaaagggtcaggtacccacttaagcggactgatattaggagtagtgctggtgcctccctggacaggtcttcctttattctcactgggagagtttcttgaattgattctccttctattctgctaggctcctggccaccattctaacaccaaaaggagagctagctttaagataaagaattactacagattgcagaacagagaaaaatattcctaaccaggaacattttaactccactgcatattgtgtgtgtgtgtgtgtgtgtgtgtgtgtgtgtgagagagagagagagagagagagagagagacggagggagagagagagagatcagaagatgaggaatgtctttgataagaatttacactggcaattttttttccagaaaattccaaagggaaaattaaaatgtgccatttagggttttatttcaagtatttatatgggcaaaatcacttgcatgcatttgataaaatgtctctttttcttttcccccacccttcaaaggtgttattttatccactgcaagacttcaaaatggttatgtgattgactgaatatagtcataaagccaagccttctgaagttgaagggcttattgccttaaatgttattcttttgattatatgggtagtctatttgcatttgttagtgcctcatatgatataattggatgtctcatcttttgccaaaaatgttagaatctgagaaaccatttatttgaaaattccactttaagggtacaaaattcaggtagacaggaggaatatggtatttctttttagttctattgcacagtgtggtgaatataattaataatagagtactgtacattttaaaattgctaagagaataaatttcagatgttctctccacaaaacaatggaaatatttgaggtgatggatgtgttaacaagcttgactttattattctacattgtattcataaatcataacatcactttgtacgccataaatttatgcagtcataaattgacaatttgtgataaaaatatattccaaaactaaaattcaaagcaagtttaagatgtggaatgtatcttgaactattccctctttttctaggaaagaaataaaatactgatatagtta

SEQ ID NO: 126929 - DNA, 3425 bp, Homo sapiens
gtttttttcttcaatgttgcttttgagatcattcatatttatatatgtaactctgatgtaggtatacaatgtgtagtattttttagtgagtatgccataattcatgtatctgttgtactattgatggctgtgtaggttcttttcaattcttgctatatgtaccgatatcaggacattgttatgtatacttccctatccacatggacaacagattttttagggcatataactagaagtggaattgccaggtctttggtatacatttctttaatttactaaatattgtcagcttattttcaaaagtagttttgctattttatacacttatacattccttactcactgacgttcttatataagaatgtttcattttcagctcacctcataaaacttggtattgttcgattgtaaattttaatatatccaaatatcatctccttgaagttttattgcacatctccctgattactactgaggctgaacatcttttcatatgcatattgactattttccctctgtgaaatgtttgtttctatcctactcatttttctttttggtcattaagctttaaaaaaaaaatactgttgatgtgtaggtgtccttttatattctggataataatcatctgtttgtcataagtcttgaaaatatctcgtctgtggcttatcttaattttgctcatgtgttttttttgtacaaaaattttaatttctatgtggcagagtttttttgttttgttaggcataggtatttttcttgtttaggaattttcttactcttgtgttataaagatatatttttctatattttacttttcacattaggtctaatcaatcaggaattgaggtaggattacagatcaggaattagaggcggcattatacctctaatatatctacacatcttgcttttcacagttaggtcttacctgtcagaaattgaggtggcattataatcaggaattagtggtggcattatacatcggtgggggaagacaagaaaaaagtaaatccccatttactttgtaattagtcttgggtagggatttacttttcccccatcatccccctgctgactgtgatgccatctctttgatatttcatgtccatgctggcatggatctgtttctctgctctttgttctgtcgttttagtctagctgcgtgtctttggcctaatgctatgctattctaataatgatagtttcagtatctggcaggagacgtttttctaccttgtactatcttttcatagttatcattgttattcttggctctttggccttatatatgaatttcaagattacactatcaacttctatgaaaaactctatggaatgacttcaaattgatctattaattgccacaaatttgctgtatttatatttttttcccacatgtgaacatggaattacttttcattacatagagctaaggttttataattttccccgtaatgtgattatacacattttcccctgtgtaccgtatgtttttattgttgctagtgtgtataggctcacgttatctctctctctcttgctctctctctctctgtttcagtattgaaatgcttgttacttgtctataggaagtctgtagtttttgtttgctagtcttaaaacaagctacttttgaaatcttctaataatttgctacagaatccattaaaattttctattttggcagtcataacgtacagatatgggtaatgctttctaatacatatttttaaaatttttcaagtagtcttgtgatattgactattatctctagagcagtatgagagaagcagcggaatagatatatatctttttgtttttatgttaatggtaatgtgactaaaattttagtttgtgatatatgctgtaagctcttaagagatactctacattactctgtatttgggtagagatgcttcctttactccttgtttgtgaaggtgtggtggttaattttatgtgtcaacttgactaggcaacaggatgctcagatatctggttaaacattattttaggttgtttctgtgaaggtgtttctcgaagagattagcgtttaaaatggtgaactcagtaagcaaatggccctttccaatgtgggtggacatcatccaatctattgagggcctgaatagaacaaaaagatggaggaaagctgagttcattctctgcctaaccgttgaactgtagcactcatctcttgccctcggttcccctggttctcaggccttcagactcatactggaatctataccattggctctctggttctcaggtcttcagactacatcactgtctttcctgaggctccagctttcagttggaaaattatgggactttacttccatgatcacttgagcctataccttacagtaaatatatgtgtgtgtatatctatcagtctctgtctgtcttctctctctctccctctgtatccatccatccatccatccatccatccatccatccatccatccatcatgtttctctggagaagcctgagtaatacagaaaactttttatctcaaatgaatatttaatttaacaattatttttcttgcatttaatataataaattttctgatattaaaccatcttttaaatctgcaattaaatctagcttttatgcctccaaatcttttaaagaaatttattttacatattcagaaacaccatctgatttgttttaaaatctgaacttgctttataggatttatttttttgtctggtaaccaaacaatgttttattcttcatcttttatatcgtataatacctataaaatattttactttataatacatgtaaaggaattataagtagaagctcagctctgactttgaaactgatttcatttttttcctttgtgagcctatgctgttttaatatggtgggaatagggtgtggtaagtggtttgttctttaacagtacctggaaaaatgtaatattaggtttcaaatggcaaacattgcaattacttttgcactaacctagtagataagtgacataattctatagtggagcttggagaaatagtgtgagcataaattcgtagtctgagaattaggttccaaatttattttgtgaaatttctttttccactagctacttattggcttctgataaaagaagttaaaataatattcccattgcttgaatcattctatcactactctaagatcactttcttgcttatggatacctcatttacttccattaatttattgaaaaagcttttcagattaaacacaatagaaacaggttaacaaaggtaaaaaaacatgattaatttcttgttttatagaccaaaaaaattagtggtactgtttaattattgcagttgaatttgattcaaccaaacagtgatttgagatcatagaatactgacagctaaggcaaaaagacagccatattaaattagatgtgatt

SEQ ID NO: 126930 - DNA, 1031 bp, Homo sapiens
ccatttcaccacacagaataataaaacacatttaatttgagatataatggaactaagatttttactccttcatcgaagacattcttaaataaaacagactttgcttgctttaatgacagtgcatggcagtgaagagtacaatgactcagtaaagtttggtgccaaggctttgatttatgctaagctgctagcagttctcccaccagtgctttcatatcatctgtgaaaatattaacatatcaaaaagggtaaataacattttaatatcattatgaaaataattttgccctcatgaactcctgaaaggttctcatggatctcaggagtccattgagttcactttaagagccactgctttaaagaaaacagcaacacacagtattctgcatcttgtcaccctctgtcaccaagtatctaccttagtctttgcacacaaattgcaatcatcatttagtttactacttgagtaattttggaagatggtatttaaaacacctttcttcaacttccttagatacttctacttttaacagggttcctctctaaaatgtcattagcaggtgtttatattttcatggaaattttcctgtgacagatagactcacacatgtacaaaccatcatttgctgaggccattaagttaattttccttaatctatttgtttcaaagaattttagtatattcattttaccagtatactctttagttctgaaagggtcagaataatgacattctcacttgtggttctgaaatgcatttcagttcacaaagcacttcctcatgcatcatctcttttggccatcacaccagtcctgtgagatttgcagggcagtgtcattatctccacgagtaaacccaggttgagagagggggaagtgggttgcctaaggtctaaggccacacagtgagtggcagaacagaattgagatgctctgttttctatattcagtttcctcttgtgtatagtgttctttcttttcttgtaacaatttaaaaggcattccatattttttccctagtctatgtagct

SEQ ID NO: 126931 - DNA, 1859 bp, Homo sapiens
ccttatagtcgaagcttaaaagaaaacagggagatatcctataatatattctacttccatctttccttattgatttctgggaacatgtattgattggaagaagaagtttgggaatctcttaaagtaatacttcgggtagcaaatgaaatatagaaaatggagaaggagataaaaaagtagtggtaatggaagaatgcagaatagtgtgagaaatgtgtgtgggtgtaaatggagcactgtatggctgtttgcaaggtgaaaccaggtggtggtgtgtggcaagtgcagcattctgtgctaccaatgccagagaatgatatctggaaccattgaaagccccttacgcagcttcaacccaccccttcttattcacctgagcaatttatttgttttcattctttctcttatccattgccttctttctttatcttgtttcctcctatttcatcagggatatgaatccaccaatcacttcccctttttactggcatttccagtcttgtcttctccactgattattatcttgaacaataaatttgctcatgtattttctatgtagctctctccattctgtcccttcgtattattgctatattacttccatttccttctagtcagtttaccaaaaagcatgttacaattattgtagactcaaagatactgtacctgataatgccctttttggggaaatgaatcaaagatcataatcaacactttgtttttgttgttattgttgccagagttaaaatttatttcttatttcacttcacaattagctataattatgttgctataaagagaaattttacattgtctcccccattactgtggtagttgaattgatcatcatttagcagaaaatcaaagagcgcaatgatcaagcagtagaatgacctgttgctagctctcagaggtttaattccccagaagcagacattgagatgaggatttgtttgcaagtaatttattaagaaagtgagaaacagccaggcatggtggctcacatctgtaatcctggtactttgggaggctgaggcaggaggatcgcttgagccagaagttcaagaccagcgtgggcaacatagtgagaccttgtctgtaaaataaaaaaataaaatagtaaaataaaatgtagctgggcatggtggcacatggctgtagtccaagctaccgaggaggctgagaaaggaggattggttgaatctgggaggtcgagactgcagtgagccgtgattgtgccatacttcagcctcggtaacagagcaagaccctgtctcagaaaacaaaacaaaacaaaaaaaggagtaatcaattagggagtgacagaatgggaaaaaaagggaatggggaagaagaggtatgattttaggcaaagtcttttcaaggatagctttagtctaaaccttcatgagagctctggagtatgaattatttgtctgttcaaacccaaattaaatgaggtagatgttcatacttccatccctaccagccactgcctaaggatgataaaggggtacaggaggggagatgcttatccccagttagggggatatataaagtgactatagtagcctgagggcataagaacacttaacaagtcttatcttttggaagcaaaatcacactgaaacaacatgcaagtcagaatatgtattgtaatgtgcacaagtcttcttaaggaaccatgtgatggaattggataatttactttgcactccatcactccacttaaccacccattcttttttttttttttttttggctctatctcaccattttgactggaaaagggatgagtattttatagcacttttgatggataattgtgacattcttctttgatattatattgatattat

SEQ ID NO: 126932 - DNA, 1050 bp, Homo sapiens
acacacacacacacgcattgctagtgtttattgaattacctctttgcaccatgtttaactgttacttcttggtcatttttgaaaggtataaattattttacctttgtttttacatatatccattaatttttttttataacattgtaaaatacctttcacctaagatggtggggaccctttgttaactccaagaagatggatagccataggatatgctatatttaaatgtagttcttctgcaaataactatagaatatttatgcatttttgacaaagtttcagaggcataaatgctgccattgcccaatagaggaaatttcatacaaaactcaccaaactttatgtatggtcagtttctcggaatggatacttctgcagactagttccccagtcttcttgcacttctaacacacacttgagagatgggacctgtgggtctgtactggtcttggccatctggtctcaaggaccatcaggaagctgtcttggttcttgtgcttagaactcagtgtttcctggcttttgggaggtatttccagatttgacacctttgattttttttaataaaagtttttctttttgagtctcatttttttttaatgagaacctattcatctcctaatacaaattgatagaaatagacttgactttatcaagttaagtacttgagccagacacatgttgtattccagcctgtgttccaagtgctcctgtccccaccttgacagcctttcaggtttgtggcttttatttatatgctattgtcttgtggttagtaccttttcttgaatatagaggagtagaattattttgtgtttcagaaatgtttgttttaaacatgaacataaacgtatttcaacagcagataatctcttaatgagggaattcttggttggcccatctgaagtcaatcctgacattatttctgatagatttctgtggcctatggctaggtttcaatggaatcggttctgaaatcactacatgctgtcgaaatcaaaacttgtcatattaggttctgtaacaaatacaactaatgagacaacagat

SEQ ID NO: 126933 - DNA, 1669 bp, Homo sapiens
agtttgtcaattaccactgattttatatgactatttcctcaaattctgatttccttttaaatgttagagagtattttgaaccttacattattacaaaaagcaatttgaggtctttatttcagggagtgaaatgtgacattttaaaaatgagatcacatttatttatatacaaaaagtatttaaccatcaattatataaggccatttttactaataaactattattttagagattgtatttattaatcatgctgtaaagggattactcattttaaaaagtggctaacttatgtgcatgcattgaatgtaatctacgttcattggataaagtgtacattcatctagcagacatttattgagcatctaagatgagttaggttcagtgttttcactgggaatatggaggaattctgacctgaagcagtttatagtctagtaggggtaggtggtagcctggcaaagcagaaattgcaatacagtgagatcgaagcaagatgcattgggagtacatcgtaccagtattaatgctgcctgaggaggaaggtaactcctttccagaggagctgactctgagaaggggattgcagacacagagaatgggtaaatgttcagaattgttggcttacagtgtgtatgaattagaatggtaggtggggaggtaaaggtagcagagataagctatagggttaatatttatcttgtaaacaaggagaaactgtagagtgaatgatctaatcacattttcattttaatactgtcattctgaaaacatcctatgcgatggaatggagaaggaagtgatgactcagagtgtgaagagtgaagagttcttagtatttgttattggttaattctcttttgatttcaggggtcaaaaatctaatgtaacttgggctaacaaaaaagaagttaacaaaagaatttattggttcagaaaattgaaaatttccatgtcagatctagctaacctcaggactggcctttgcagtccatctgtggtatctgtgttgtgttacagagttgggttcattgcaggttatgactcctgagttcacacatacctaaatgtttttcttaaaaaaaaaaaaaaaaccctccaaaatgaatcaatatagtgaactaattattaatgtctgtgtgatttgtgggctatttttattggtgtttgtgaattctttattctcctaattgaatattcttcattctatacatgagtctaagctgcttctgggagaatattataaattttttgggaaaaattctatatcctgacttttctttaaagttcataaaaacaataattgtgttgaagaatcatatgtaaattcatgtgacttttctacacttaaaattgtggagaaaatacagaaatactaaatatttattaatctagtacacatttattaaacatttcttttaaattatgagtgatactaagtctctatgtatgaaagtaattttgtttaatagggcttttatacttgagaactcctttcctgttttccagtttgaattgtcttaagattcagattgacttcctagatagtgcactgaaatttggcggtgatttttatagaaaaaaattattatacttgacagttgtatcatatgatattccctgagaaaatctcagaagagtgtttcagttatattcgaattgcctacactta

SEQ ID NO: 126934 - DNA, 3959 bp, Homo sapiens
tatttatcttgaaggctattttactttagagctcatgagctaaggtgactgaccttgcattattctctgaataaagcctctagatcttaaacagcagattggactaattgaaccctccgaatgatggtagaaattgtcctaaagtttttttttttaaagaaacagattatatacatttataaggtgtaatttctatgattataggtaaatattatagtcatagtaatgctttattttaaattatttttgcttaatttcttctattttgtagtttttaaatcttgcctaaatatatggttattaaaattaatattaaccattaatattaacaaggtaatatatagtttatcttagttatactatgttaaatattgccaaaaaataactttttgaaagaaacaaattataaaatcattcttatttaacttatttcagatgaaggtaaaatacatgtgaatatggcatgctagtttgtaatcttccagtaaatcaaaacaggacacaatacacaattttatgaattattcttataggacatcaaattgaattaattactcagtatctaaggcacaggatagcattgttttcttcttccttttactgaattatcttttctaattttaattagcttcaaagcaaggaattatgaatttagtatttattttgagccttctatgtgtgagacattatatctgggtgtggaaatatttattccatcaactaggatatttaagtttcttcttttgggtattatttgttcttttttgtccatttgaaaattattatatattccgtgttatggaaacgtcactgttgtaagttcttactttctattcccagagaatggccatttaattgtattagaatgtttcagcctagatggggttacaggaacatgatttgccttcctaccagaaacaaacaaaaaagaccagatacaccgtatgaaagggagtcttcagacattaaatatcagacagttcaggacagtgatcctttaagaatggcaacaaatgaggtaagccctttgattgtaccagctgattgccttgagaggtttttccagggcccagcacagggaggagaacccaggtgaatgttggtagtctagggttgacgagacagagttgggagtctggggaagtccaggtggctagagtttgcaggacagagtactgactggagagaagatgcacagagagaaaactatatagatatgcagaaggtcctcgtacagccctcagctgaggacccatcagtatgtggggaacctacaaaaagctggagaaataatcacctcaaaagaacacagggaatagttttcagaatttatacagggctgggaattattcatgttcccatatcagccagagtggaaaacctcataattcacgaagcatcagatagaataaccagaagaatattgcctagtagtggagcatattcacccctagattaaaggctgtgccagttttgcctaacaaagtttaaaagccaacttctataggatttgctgttcccaagtaacttaactgttttctcaaacaaagctcaaggatgttcctcaggacacaagaatatgtagcaccccaaaaggtgaaaatcatgtttggaagctagtaaaaatattacttttaatgcaaagacacaggaaaccatgacacaaaatgaggagaacatcaatcagttaaaaaaaaacacaaatgagagaaatagtagacaaagcattaaaatagttattgtcacatttaatttgttcaaaaaaggagaggaaagattgaagacattaagcacagaaatggaagatgtgaaaaagacttaaatctatattctagagatgaatgttacaggacctaagatgaaaaaaatttgctggatggatctgtgacagtttagtctacaaagaaagaaattaatgaggtgacatcataacaatagaaactacccaaaatgaaccacagagagaataatggctaatttaaaaaagagacaatcagtgaactgtaggacaatttcaagtgcctcagtattcatgttattcaagttgctgaagaggaggaaagtgggagagttttagactgaaatatttgaaaaaatggtgggaaagaaaattgataaaaactataaactcagaagaaactaaaaaaaccccaagcacaagaagatgatacagaggcatattataatcaaactaataccagtgataatgagaaaatcttaaaagaaggccaaaaaaaagagacgtatcaggtacagagtaacaaagatggttaagagtctttgctttggaaacagtgcaacacagaggcagtagaataacatttttaaactatagaaagagagaaattatcaatgtggaatttttttttttttttagacggagtttcgctcttgttacccaggctggaatgcaatggcatgatctcagctcaccgcgacctccacttcccaagttcaagcgattctcctgtctcagcctcccgagtagcggggattacaggtgcccaccaccacgctcggctaatttagtatttttagtagagactgggtttctccatgttggtcaggctggccttgaactcctgacctcaggtgatctgcctgcctcagcctcccaaagtgctggtattacaggcgtgagccactgtccaaggccatcaatgtggaattttatacctagtgaaaatatctttcaaaaataaagatgaaataaaaacttgtttagatgaagtaaagatgaaaaaattagtcactggcagacctgtactgaaagatatgctaaaaaaagttcttcagacagaagaaaaatgttatcagttagaaacctggactatataaaggaataaagaacactgaaaatggtaattttctccccttacagactcttttaaagttatttgactgtttaagtaaaaaataataaaaatatattgtggacttcgtgacatatatagaagtaaaattataatagtagtagtgcaaaggctgggagagggggaaatgtaagaatactgatgtaaatttcttatactatatatgatgtggtataatattacctgaagacagttcatgataaattaaaggtataaactgtgaaccaaccactaaaacaacagttaaaagaattatagctaataagtcaagaaagcagataaagtggaataatataaaatatgcagttaatccaagggaggcagaaaaagagagaaaagaggctgagggcagataaaagcagtagaaaacaagtagcaaaagggtagattcaaatccaatcatgattgtatatatccagggaaaaaagagattatctcataatgatagaagggttagttcattaagaaggcataaaacccagcatttatgtacctaataacagcatcaaaatacttgaagcaaaatctgaaagaacttcaaggagcaagacacaaatccagtttttgttggagatttaaatattccttcttagtaattgatggacagagtagacagaaatagatacagacatagaagacctgaacaaccctatgaatctggtgtaactggcatctgtatcatacaaagaatattatctgagtttaatgaaattaaattaggtatctataacagaaagacttgtagaaaatctccacatatttgtcaattaaatgactctcctctaaataacccataggttaagaaagaaataaaagaagaattaaggaaatactgaactgaactgaatgaaaatgaaaacacatcaagatttgtgggatgtagctaaaacaatacttaaagggaaatttatagcaccatttgtattataatgaccatccaactacattacttaaagttacttgttaatgggttgtctttttgtatattccaaacaatttctgcttgtggggagaaattttagctacagaataaacatgatatttactttgcgagatggtgctacaaaacaattgatgtgtaaaaat

SEQ ID NO: 126935 - DNA, 1036 bp, Homo sapiens
ttcattatagaacacctttaaaacacttttaaaacaagaccttttaaaaagaacaacaggaattacaaaataccacttaattacctttagcaagaacacttaggcttgctcattgggcagattaaatagtctattgaaacaaaatcagttgatttggctcatttttccccctacattttttccagtgattgctgctctcatctttttgccaaattgatcagagttggcagtaaaacacaggcagttgaaaatgtgggagaagattaagttttctggattgcataaaggatcatcagagataaagagattacaaagaattggtcttatcaggttgatattctgcatcatgtggttgtctgttttctatcataatcaactagacctaaattaagaacccttgcctttagagagtgttatttttgttttccaaattttggtaaatatgatagattgaaccaaggaggtgtttataattcgtgcacattttatctttgtcttgtcattaagtatgagagcattaaattcaaattttatcgaaagtttgtgaaaattaacaatggtttgttgttaattcgtttgaatagactttgttgaaattagggcctaggagatggaatgctggcttttgaggcttgatcataaagaatattatatgtgacatatgtgtaaggaaaataagagaaagaggtgatttcagggaaagtaaagtagtagttactcatagcgatagtttggataacaaattaactaatgttgaacaggatgtggatttgaactcattattcaaattgacagagacctggaattagttcagatttacatatgagaaagatggtctgttacaacaaaaacaatgtcctattcagagtggggcagagatattggaaaggttcctgtttctttgggaatggttttcactattggtgaaatagtgaaagtgaaagctactattattgcaattatggcaagaacattacatactttatcatttaattttcagtatcattctgaaaggcagttgttgttatgcctgtct

SEQ ID NO: 126936 - DNA, 1049 bp, Homo sapiens
tttcagatgctttaaatatatgtaatcttattgataatattcagaagcattttaaattaatagttttttgaaagtaagatttaaacgtaaattaagcacaattgaaacataatacaatatttaccattcgaacagtaactaagttactgttatcttaaaggttttccgagaaggatacggccatgacagtgtagcatttacatgtgttctgagtgttcatttattataactgtaccacctgtagttttagatgctctgtggtttgcattttaaaagcatttggtgtttatagcacctgtctttctaagacatggcctgactaggtctgatgtctagtgtgatgttaaaaaaatcacattaagtgtgacttaagtatgggggttagagtgggaatgaaaatgaaaatgtttaatttttctgacaccagactagtatgcttcagggagaaatttagcaaaggtaattgggcagactaccaatataaattaggtcaatagcctagacctacaagtgctagcctttataacatacttgaccgcaacaaaaatctgttaaaagaaaatgggactgtccctaacatgaagtaatgggactgtcgtagatacaacacatggtacactttttccttttaattaccatatgagaacaaaatcagtttttgcagctggttcttcttcgttttatttgccttgactacatctcacaccgaaggggtttgaaacatgacagacaacaggtgtgaatatgtatctaataattgactgcagtttctgttcttcctttaaaaattgactgtgttgtaaacatctctaacactaataaagacagcctattttttcttatgtgtaaaatgccttctaagccatggttagattgtatgtctgaatcaaacttaaataagtcaagttattaaattactctttttagaagaacagtttttaaaggaatgatgagtttctgtcagtttaagtgcagctggcaagcagccattcattatagcctagtgtgacattgatttttgactagaagaaatggaaacatagcagtag

SEQ ID NO: 126937 - DNA, 1872 bp, Homo sapiens
taattctacaagagttttagatagagaattagtatttattgagaactcttttagcataataaatattttataattcaatatataataaatacttcacattcagaatatgtatcttgggaatgattgaatggctggtgagcaaggcaacgtcatgccatacatttaaaaattcctgttgtttcttctcaaaacaactactctttagttggcataaaaataataagaattttgttttagtaacaatatttttcaccttcagacatgtggttcacaagaaaagtgcacaaaaagagatttgtgatatgacagaaaaaaatattttaagatctcctttttcttccctggtaaaatacaacttagtaaatgtaacaaattaagaaataccagtgagttagagaacaattggacaataattgtttctaaatagagtcattatgaaagaaaatagtatgtcggagtccaaaatcttaattagttgaggaatatttataaatttatagacaaattctctgttgtttgtgtttttagcctcccagaatttctcttttttaatcattatcatgatctagttgtgccataggctttggttgaattggaggagtatttagagtggtcatctgagatgtccagcattcagtgatgcacgaggccttcagaatgaagaaggattgtaataaagctcccagcaagctcgtttgtgtgctatgaatagctcactaggtgaaatacagccgatgcaaaaagtacgtgggtggttcaggtgaatgaattgtattttgtagctcattggatttttttccccactccaaaaactgctttcccactgttcctttaactgcgcccctggatcgtgaagtgttgtgatgtagttctcttttgtgctctggagttggagctatgaaaggcagattcatttattgtttagttgaatcaaaatgactgcaattccacaaacaaattggacttcagttaggagtgctttgtcataaataacgttggaagagattggattttctcctagctgatatacttctgctttacattaaaatcggcgtctaaaagggactgatttatgactgaactgactgatcactgagcaacacacacctgtccttgttctgctttgtttttgctatctctattttcctaaagcatattcaggaaaagtttatggtaagggaaactaatattctattttctgaattattgttttcattttaaccttcattaaaaaaatcacttctatgatgcaaaactcagtgaataattcttcataatctagaaagaaaacctatttcacatattggttaaaggcattttccatggttgggtcaggtgaatcatatttttcacgtataatgttaggacattttaaactttaacaacatgttttgctacaggctgcaaataccgtagcaatacctgcaaatatctcttttcattgactgtaaaaacttttttttcccactgtaatgtatttacttcattttgtttcaagttactcagttctataaatcatccagagacagagaaaatctggtaatttcttccttggtggaaaagtgtatatataaaatatatatacacactttatacttatataatatatatatacaatttatacttatgtataaaagttacagcacaatatacatttggctagacccttggtacttaactacaaatgccataacaagttgcattttgttttcttgagtcaaacaattctgtgtggcagttacattgtatcagtaagaatcatttcatgtgtagggttgtccttgccaagtaggttaggttggcattaattttgttaagcattttatttggtcttgtttttgtaagctctagagccagaatttgcatctgtct

SEQ ID NO: 126938 - DNA, 2857 bp, Homo sapiens
agatttgcatatattcaaagacttttaggatcattccagagtttttaggatcattccagagtgcttaggatcattcattttactttgaaatcagtaagaacaaaacaaaacaaaacaaaacaaaagacaagaaacagacaagcaactttacattttaagtcttttctctatcattcatagccaccaaagcagagtttttaaagcctttatcactcagaaatctcattcagcgagggtgttttggggaaaaaaatgcttagctcaaataagaggtaacttgatgcacaaattttatttcttagtgaattggttttaaatggccttgcactatgtggagttagataatttccataaatattatgtttggcacttcagtgctttgaaaaagcacatttatatagttgtcgttattgaacaatcagtatgtttcacctaagaattctgatatctggatttgtttaaatgttagatcatgccacgctggcctcacacctcttcctggccatggttttctggggctcttcagttactttcattacttgcctggctttttgtaggcgtttgactttggcctaaataattctctgactttagatcaagttctatgtggcagtctttgagagccttaacacatattgatacatattttgtgatttggtagcaaatcttgacctcaattagtttgcatgttctttctgcaacacacaccttatactctcctgattaaaacacttagaggaatttcctcctcagaccattggtgttacttttcatgagctcagccttgcctccctctcaagacttttattttctggcagtcttcacagccaaatagaatcatatgcagcctcctttcacctctgagccttgtatgtcatgttacctgaaattccttcccaccctggtttgtctggtttacagatcctctacctcttccctgacagccctccctaatgctcactcttctgaggcatgcacatccctcccaaatgtcagctccttgagtcctggcagctactgtcttttgctctgctgtacacttaacactgcacctgtgagtattcacccagtaaatagccattatggacattttttgtgttcatcattgatataattctctgataacactgaagttttagtagtttgtgtttggagaaatatttaattttaatggaggaataacagatgttctcccccttaaatactccaggtgagacctttatcatgttaaattttattggcttacaataagtcttttccatatttcatttctcaccatattttatatttatgataaagttggaaacacttgtagaaattagaagaagcgtaggcaatattggtaaaatctatgaacattttataactctaatgccatttttacttttaaacaaataatttgatatagatacaaacagagtcatagttcttataaattacattactcttataaatgacattgtcagttttggaaccatgtaacttttaaatgtaatgttgagtaaaactctaaggttttagaatatgcaatagaaaatgtcattttctaatgtttgggtcttgaaaatcaagttcatgcctctgaaacaatatcaaaagatatgtttgcataattatttgcatattatgccagtgttactaaccttaagtagattcttcacaagttctcaaaaatagaattttaatttaaatgctcaaggaccccgatttagtgttggcttcaaacctaatgcagtcttggagccacgtattattcatcagaggctggtattctttttctcctctgcttcccattccaaattattccttgtcacatttcctttttccaatcacattgtccagtagactttctcttctccaatcatatgacagctatttaaattatacttatgacaatatttagggtacttgtttatctgccataataatttgtatctgttgaatccattttccaggtctcgttttatactgcctaattcagaactttttccattggcatatttctaatagattactccaatacacacttaaacatttgtgtgggtgcttgcatgtgcatgctacgtacatacactttgagtttgtttccgcttgttggttgatgatgcctacatttcatacataccatcagctgaatactccatgcatcatttgaaatcactcaaaagggaaggtatcctgcatgtgaactttgaaaagaaggggacttttttttttttatgctcccaaatgacctattttgagaagtgatgatttggtaatattcagagaaatgctttctttttacttggttaaagcaaaatctgtttctttttttctgttcatgtcaattttcagtgacatgagaattttttttcaggagagagtttattaggtaaacctttagacaagtttaatattagggaataaaactcgtgaagatagaggtgacacaatgacattatgtttttttccccctcaacttttatttttagttctggggggtgtgcagtttgttacatagataaatgtgtgccatgatggtttgctgcacagataaacccatcacccaggtattaggcccagcatccattagctattcttctgatactctccctcccccatcctcatcaatgggccccagttcgtggtattcccctccctgtgttcatgtgttctcatcattcagctcccatttataaataagaacacgtggtgtttggttttctgttcctgtgttagtttgctaaggataactgcttccagctccatccatgtccctgcaaaggaaattatgtttttcctttttatggctgcatagtattccatgtaccacattttctttatccagtctgtcattgatgggcatttgggctga

SEQ ID NO: 126939 - DNA, 3379 bp, Homo sapiens
aaacctgcactttatgcacatgtaccctagaacttaaagtatagtaattaaaaaaaagaaaaagaaaaaggtgtttaaaagatgtataggccgtatattttgtaccagtgtaatcattcactgtgttgtttaagcaaataagctagtttaagcttataatgagtttttaatttatagagaaacgaatcagtagggcaaagaaaggtgcaaaatcttggaagaatttgccttgtataataatggaagactcacatgagtaaaatccctactgaactagcttttgttggactaaagaatgcaattatattaaaaattaatacttcagtctaatacaaatccaatgctgcctgaattattatgtgccaaattaggttgctataaacaataacaaaatgggtgattgtgtaaatgaaagcatggagttatttaaacttgcaattgcatgtttaatgagatgcattgaaagcggaaaatgtttaatttagtaacgggtgacctgaatcagtctgtcctacagaatgataggcttttggactaattttcagttaaaacacagtaattgaataacacccctattaatatgtaatatggactatttcatattattcatttttattaagatggctcttttagtatgacagctgtcagttggaattattatgagttctgtgtgaaacactaccaaccaagttaagcctttgttggatttttctcttttagaatctgagaaaacttgttgttatcttctggttagattatattaagatcataacctgataaatgtgaaagagaaaaacttgggctgtggcatttggctggaatataattgtgtaggtctactctacttttatttattgtaggtagtttaaggtgcttacttagaaaaatgatggactcatcatctttagaaagatctctggagttgattatctacccagatgttatttagtcaagtacctgaaactgcttcttgcctttgcgttttttgtcttttagagtcaatacaattcaggtattgtgaaaatgttttttctcagagggtgtgaattcacagtatatgataatttaatgtgtcagttcagggcagagagttaaattattgaagagccaccttgattccctttggggtactcaatcttatgattatcctgtggtacagaaaaacccttttactcgatttaaaagaacttttctctctaggcagcatggtcctctatgaacaatggacatatagtgaaaatctgtggtgagaatgagaagctgcaagcatcttttaacaatgaaactgcttatttgtaaatgtggagtacagtttactgtgttaatccttcttcaatgagatatttcactgacatattctattcatttggagttggtttccaaattgaattagaagaagaaaatgacatgtattatcttacacagtgaaccacagttatcagtgttatatgtagaaaataatgttagatttaaacattatttttcaaataaaaaattgttatagttcatatgtacatcatttgcagatctagaacttgaaatctgtttggtttaaaagcaaaacaaagtttaacctttatgtatgccattttgtaactgtgtaactttggtaaataaatgtttttgtatgaataaacctaattagcatagcactttaaaacaaggaaaaagaacatttttttaaaatgggcttgctagaatactatctaaatcaaacaactaatcttttgttttaaataaaaatacttcccaaagaaataatatacaatgtatagtataaatctctatgcttcattttaattttttgagagataattatgatttattgtttggaataaactgctcattaaatatctttgaaaagttttttaaaaagcatttgttgtttccagaaacattccttggtaattacagctttgaacaatagaatacagacaaaactactatgtgggagttattatctggttagaagcattgtatagatagataaccttttcttggaaagaattataaagcttttggtttggacaatagttattaaaggacactgtactctgagtgttccaagaaagcttgtgttaactaaagcatgagatttggaaagagtagacctcagttcaagtcctgactcatctatccctagctcttttatctttcagatcctggatggcccagtcacctttcctgaacttcattttcctcttctgtaaacttgtgacataatgtgtaacttacaggattttattagggtaaaatgatacatgcatatgaaagtttaaaattttaaactataataattatagtctaattcattctcttattatagtgtataattaacaaaaacttccacttgttactaggtggagcttctctgtaaaaaaaaatactataatgaatcattttaagtggagcatgtttttgtaaaatggatgatcatcaccctcctttctctcactacctctcccaccattcttttgtttcacatattttatactgtgaaattttcaaattgcagctgtcaatgttgtgcttgtgatgtatttgagaatgcattctatcctcatggaaaagaacacattcaatttgaacttcaagtttgttagttttctttaattatgatatttgcagtcattcttagaagagatatttgtctccaaggattggtgcacagtttgatttctgtgggaagatatgctttaaaatatgtatcggtgggggttgttaaaatagtgggattggggtggaggtggaattgctatttaactggcagtttcatcagtatagaaaaccttgatgtattcatgtagattatagattaaaaatttaaagtagttatatttggttataggatcgtggataattaaacatttttctgcattatgttaattacatttgagagttacatatatgtttgctatgcaaaagttaatgttgataaagagctgaagatttttcccagaaacaatatacagttgacctttgaacaacacaggttggaactgcacagttatatgtggctttgttttcaactagacatggatttgagggatacaaaacttgtgttacagagggctgactttttttatatgagggttctgcaggacgactctgggacttatgttgtgcagatttagttatatgtgggtggtcctggaaccaatctctcatgtatacagagggacaactatacatgctaaataagcacatatatgtgacttgatttttttctttttacttataaaatgttaatacattgggttcatcaattacccaataaactaggtatcagatattctgacagtctgccccagatttaaaacagcactttgagtacaatattaggtagcgaaatatcctatttcagagagttttcatccat

SEQ ID NO: 126940 - DNA, 1027 bp, Homo sapiens
gtgttaactagagaagggcatcttttttactgagattcatagtgcttggcttcctggaattttcattcctgattccaaatatccctcatttcaaacatcatgtttttttatcctcatgtatttacgctgtaatcaagaatagtaagaattgccattttaaaattatcatttatctactgatttaatttaagctggtctgtttttattaaattcacaaatgggaagcttgataagacaataaaaaattctctattgtcacgtatttatagtataattttatgtctgtaatttttaatacctgtttcgattgtatactcctttagagaaagtttcttcctcatatttcacatgaaaatgacttattcttacatattttctaaagtaccacaacccagtatgattaaattgttttgcaaaatagaattctgaagtgtataagaatattgtcatgaaaatataggtagagaccttcacattaccttataggtgccatcccaaaattttgaatctactttgttgttttagttaacatcatctctcttgattaggtctaaaaatgaattaccttgtaccatattctgctctgtagtgaactggccaaggggacaatgtaccttaatcccacttttgtagaattcaaattacagtttacatacagtcatgagccacataatgatgtttcagttaacaatgagctgcatgtatgatggtggtcccgtaagattaaaatggagctgaaatattcctattgcctagtgaagtcatagctgtcatagcattgtagcacaatgcactactcgtgtgtttgtggcgatgctggtgtaaacaaacctactgtgctgccagttgtataaaagtctagcccaaacaattttgtacattacgtaatccttgatcatgataacaaataactgttactggcttatgtatttactatgctatacttttaatcattttagagtgtagttcttctacttaaacaacaacaaaagttaatagtaaaacagccttaggcaggtccttcagt

SEQ ID NO: 126941 - DNA, 1060 bp, Homo sapiens
tccagcatttttctcttttatacttatccctatctgaaatactattatattatttatttatcttgtttatagattgtttgtgccattagaatataagttcctgtgggatgagatttttgtttactgttttattcttagtgccttgaatgatacccagccatagtaggttctactgtgtatttattgattgaattcttgtttttgcatccctactaccactaccttggctgaggacctcatcatttctcacttaaatttccactgtcatctcctaacagactactggtatattgtttccaacatgatctttttaaaagccaaatctggtcatatctctctctccagctttatattcttcagtctatccccataaccttcagggtaaaatcatatttcttagcatgacacccaagtcgttgcttacctttctgacctcaatgcagtccctttctcacttatacatatttgtctttcccccgaaggtcttaatgcattttgtttctgaatttttatgcctgaaatggcctatctgaatcatctgaataactagctccttgatgatttagcctaaaacgatttcctgatgtttcactttattttctttagtctggattaagaattctcctgtagaaaccagtacctctgtctgctatatcatttacatgttatgttatacttattctagaaagtatatgtcttattcactagacaccagccttcctgagttctgttcaagacattggtaatttagttcatagtagatcttcacaatgtgctgaatgaatgaagccctgaatcagagagtaaagggaatttagactggtaatagctttttaaaaaatatttctgacttggtcatacaagacaaagaagaataattccttaattagttttcaccaatttcatttgtactatacacaaagaacaacaactaagtcagtatttcagtgggctctggtcagggagggaaatcatgttgtggggaggtgttggtgaatatacggggaatattatgaggttcatttacctcagagagctaaactatgatgagagaactttc

SEQ ID NO: 126942 - DNA, 1052 bp, Homo sapiens
tgttttctttctctttctttctcatatttttagagctttcattatcctgcccctagtctaattttcaaaaaatcaaacctggatcatctcactctgctactctgaaatcttgagcaatttctaagcagacctttcttgggcctgtgcagactcagtgcttctgcccttctgggtctttgcacattgtgttttcttttaggaatgttcttctaccctttgaaaccctagccatgtttcacagtccatctcaaataatgtcccttccatgaaatttttttctgattcctttgtccttgctcaccccatccttcaatccttgatgataagaattggtctctaaagcatattttcattagtacagctcctgacaaattatcactgctccaaaatggtttgttaaatcaaattgatatttatcagattccattgagaatcagagatctcaacacaaagtagagattttgatttgggttcaatatactgctcatgaaagtgcagctgaggcttaggagaaaaagtgtttaatagaatacatttccaacagaaaaaggcttttagtaatatagcctattctatgttcagagacagttggagagaatgtactcacgtgaatttatgtgggcagctggctgtcagctgaaccatgtgggaaggaatctgccttaaactgttttctgctaaaataagcaacattttagaaatgttgtctatctctttagattagtactaaattatcccacagctctttgaagctcatcaagttgataattgttttcaatgatctgtaaacaagcttgcttgcttgctttaaacagttaactcttgcttatttgcaagatgcaggtaacaaagatgcaggtaaagatgaaggtaacaaaggattggaatttaatagggggaattcagtatatcagcgtcctttcccattggttcctgccctacagcatatcatgctgtacaactgtgggtaccaaaacttcacttctgggagatttagccctttatccaccctgagccacatttaccaatatgagaaaactgcttcttcaaca

SEQ ID NO: 126943 - DNA, 1084 bp, Homo sapiens
gcattgttttcctattgctgccaccacatagctgaagcctgttcctgggcaaaaccatgagctaggtgaagtttgtcttaagacaactcctgcctcccttttctatctctgctatccacaaaacatctaatactcttgagttccttccaccctgtgagacttcacacaatgttattgattggttgcatcctaatatcctactccttttagggatatcagctttttaaaagagaatgtcttggggggaataatatataacacatagagagataaatctctaatggtagaatttaaaacatcatggtggtgctgtgttgatgagtgagaaaattggggacagagacttttgtctaattctaaagtaaatgtatcagtgactgcttcctctgtttgttttgtgaagctggggttattatttataattagtgccaattaaaaaatgtcttgaattaccatacttaaatagatagcatacaggcatgaatgggccagaatttactacttcttctttgaaaaagatactctgtaatgatacagagaatgaaccgacactatttttatacaatgactcatgaactcatagacatgaaggaatgatcattgttccacatttcaatttgtggtctatcctggaataatattttaattaatccagcaaacacctttatggatgagaagtaatattacccctggagaatagtatatagaaaaaaagttaatataatctgaaagctcaaaaaagaaaaaaaatattacccctattaagtctattaaagattgggtcaaaagataattcaaggttaagaatgtcctccttagaagttgcccagtaaatcggtgagagaattgggagaagaaaatctgagcttctggcctcttagggcatggagtcactgtttcctttgaggccatgtttataatcacagtaagtgacctggggagactagcgctcctagcaatgaaacagatggcatgaagttcccatcaccctgcagctcatcagccataactgaccaactgggaaacaaatgttaaataataacaaattagggtatgtttaaataatgacattgaataaatctta

SEQ ID NO: 126944 - DNA, 1090 bp, Homo sapiens
caacaggaaggagaagtgccaagcaaaagggggaaaaaccccttataaaaccattagatctcatgagaactcactcactatcataagaacagcatgagggtaactgtccccgtgattaaattacctcccattgggtccctcccatggcatgtggtgattatgggaactacagttcaagatgagatttgggtggggacacagccaaaccatatcagtatgttaatggagtatataatagtcttagcgggagttatgtggtcctgagactgtactttacactaagattttgaaaaattgttcatgtaagataagtgctcattttagagatgccatgttagttggcataaacaaaatccaattgttatatattcctagaggaataaagaaaaaattctatgagtaagaaaataaaaacaaataaatacttgtgtttttattagatggaggtcttttcagttcaaacgtaccgttcataaattattgaaatataggcatcatgtagaaattactttgattaaactctttaccttggcaactactttccaaagggtaggatgctatttggtaagccttttaaagttggttttgacagctaatttgctcacataatagcataaagtttcttctcttctgcatcatatttttaaagaaatttttttctttatagtgaactctgataaatatataagataactgatggactacatctacataaaaaagaattcaagtcactaaatacaatactcatgacaaatagaatacatttagactcttcagtcctaggattgcattctgtcactatgttcaagaataatactgaacattattaaaaaatgaaaagcagatcagttgaaaaggtttctttaaggcactactgaagtttatcataatgggagacaggtaatgataactttcaagtaatggaatctgtgctacagtacattcacttgacacattttctttgaatgaaatagttttttatttttttaaataaaaggcaagccagctttctcttcccccatttaattagggcagctacattgtaggcactaggaaaagaaaatcggtgattttcaaatcagtggggagg

SEQ ID NO: 126945 - DNA, 1043 bp, Homo sapiens
attttcttcccatgaaagactttgaaaattatatgttgactgaagaaactgtaggcaagttattagtttccataaaatttaagaagtatatatagttcttaataaaaaatggagtttgttataaatcaaactgatgactttggtatttgcatcctctcagtattaagatcaaacctacttttatttatatccttttcattccttccctttatgccactatgctccagccaaacataattattaattccagaaatattccatgtaatatttgtggttttggctatgattttgcttgagccttgaatgttcctaaccgtaacctctgtatatccagaacttaagaccccttcagaccttgctccctcgggaagtgttccttcatcaggtggaatgaatgtcccctatctctgaatctcacaatattgcacgtgcacctccctgcatcctcaaggtagaagtttgtatgctttgttcatgatgaccccatacccatggcaggataactgttgttctatatccggccacttcctttattttagagtttattattatgtatgatgtctagttttccatatttttcctgttaggctatgagctcatggtaacctccttattatgtcaaataaggctacccatgatctgatccctgtctttctcgtgcagcccaaaatttccactgctttgggctttatacctcagtgttccagtaatgtttcggcattgctgaggtatgtatatattttttttttgagatggagtcttattctgatgcccaggctggaatgcattggcatgatctcggctcactgcaacctccgcctcctgggtacaagcgattcccctgcctcagcctcccaagtagctgggattacagatgcccgccaccatgcccagtgaatttttgtattttagtagagatggggtttcaccatgttggccaggctggtcttgaactcctgacctcaagtggtttgcccgcctccaccttccaaagtgctgagattacaggatgctgagctatttttaatttctggactttgatc

SEQ ID NO: 126946 - DNA, 1030 bp, Homo sapiens
tcagtgcaatccctataaaattgtatgttaaaacttaattgtgttaccttgtgaataactcatgcacacctcccacactgaataagttgtatctgatttgttagaagtgaattttgtattattacattttcagtataattactgtctttccttcaccagtcccccacaactgtttttggagtgtgaattacttgtaggaagtagcccaagtatagaaatgctagttgggggaacagtaattctggttcaaaaccattaggaattcaattcagaacataaactttctttttaacaagctaattctcctcggaaatatttgagtttgttggtagaaatgtttgtgtgagagtgctttgctgttatttgtagagaagcatttgggccaagtctcttatctcattagcgtccctccacctcttatgagtgggcaatgtggtctcattgacttacaggcactgacctgtattccttgtctctgtgagcagatcctctgggagcctccatgggattcctatgaatatgcacagtgcaattgcatttttctcaacatgaaagaattcaaatagtctggaaacttgccaactttaattctgacacatctcgagattagaatgtcaatgtaaatgaagaagcagagttgcgccttggtgctactgctttgggatcagagactggaagatgtcaagcagacagagctgtaaatgatcaagcgtgagtgctttacgtactgatggggaatgctggtatcttttcatgtctgcactctgttaattctctaaatcattatactattactctttctgttgggaataacaagaaaaactattctatctgtgttgcctgctcctgggacatgtgcctgtttgcttaaatacgggtctttgaatttaggattacaaaacagttgttcagaaaacaaccacagcagtatacttcagaaaacccttctctcttttgagatataactggattggtgattcatgtctgtttgttaattgcaataaagctgctattgtaatttagtatgctt

SEQ ID NO: 126947 - DNA, 2139 bp, Homo sapiens
cctttctttgttgttcttactcaatcagttcttatccaagcctttaaacacttattactaagtttttagtaagaggcgcctaatttgtctgtttctttagtctgtgcttttgggaagtcatcctgtacgttacttcctagaccaagtttctcggaagaccagttcatcatgacatttcctttttttgcttgccactaatgttttctaaaatgtttgatgtgtaccaaccactgttttaggtacagtggttctgtggtgaacaagctggacaaagtttctgcctccttgggccttctgttctgtgttgtgataggcagtaaacaagtatataaaggatattctcacactgtgataagggctttggtagtaataaatacaatcttgggataacttaagagaccaccttaggtaggtgaagagtgaagacatctgaggagatgttatgtgagctgagacctgaaggatgtgaatgagccatgcaggaactgggaaaaaaggacttcatgcagagggaacaacaaatgtgacgtcccgggaatagggaagagcttggcatgcttgtaaaacagaaaggaggctgtgacagctaaaacataatgatggatgagaataatgagacgatgtcgaagggaaagccagatcatttagggccttgctagagtatggcaaggagttttattttgtttcaagagtcctgtgaagtcattgatggtgttaagaggagtgagttgacttgtttttaaaagatagataaatcctggcttatttgtggagaatagtttgaataggcaagagtagaagtaggagactactaagaaggttgacactagtgggttagtcagcattaaagatggagaaaactggataggtcaagatagaggttggagatggagtcaatgcaatgaactgggcaatgcattaaaagcccgaaatgtttgttctctatatgctgcatcatggacaaaatcctttgtattttgaagtctctgtaacctggcctctttatatgtctgtttattttcctttacaccccaaggtccactttgttcttcaagcaaaagaggttataatatagtaattaaaagcacatgtttttgcacccgacttcctgagttcagatctttgctttgtcccttcctatgtgatatcaagtcagagaaatcttgccttagtttcatagatgacaaaactgtaaaattgagacaataatatttagaaaaagggttttcgtaattcacttaggatctcaagatggcatcctttggctagtagaaatagctttttagttgctgcctcagtcttcacatggtcttctctgtctttctgtttgtttctccttctcttcaacggacttgtctttggattagggcccatcttaattcacagtactcttatctcaagatcctaagttaattacaaaaaagctttttccaaataaggtcatatttacagtttctggaagttggcacttcggcatatcattttgggggttcactattcaacccattacagtgagctttttgaatcaggctaagaccacattagttccaactttgcttttattcttctgttttatacattttacccaattttgaaaatctggcgtaaaccttatcacttccataaaatagcctctgctgtataagatttgttattgggagataaaaagtaaaatcaaatacaataatgtttttcaatgtctgtgattatcaaaactgcacagaggacctgctctcaatagactacttaggttaattgatttttatggattatttgggtggttgaaattttttttttcatgtttcatgtcttaaggattgggaaaatatttcattctcatagaactgatgacttagaaaccattaaaatgaatatttctaattctgttaagaacaagatatcttaaaagttggattagaggtagagttttaaatctaatttctgggtacaagttgggtgtagatttcaaggaaatagttttgatcacagaaaactagattacttgtgtatgtggggaaggtagagcaagaacaatatatatgagctagaaaattataaaacatgttattaacaaaagatcatactttattaggttttcctttctcactttcagggcttaaagatgaaaaagtcttcagt

SEQ ID NO: 126948 - DNA, 1388 bp, Homo sapiens
gttgaggtgggaggattgcctgagcctgggaggttgaggcttcagtgagctgagattgtaccactgatctctagcctaggtgacagagagaccctgtcttaaaaagaaaaaaaaaatcaaaaaaagagttatttaaatttccaactattattgttgaatcatctgtttctcccttcatttctgtcagtttttatttcaaatatttaagtgcatcattattggctgcatatatgtttatcatttctataacttcctgattgattggctcttttatcattacaaaagttccctctttatttctgaactgggaatggggagtaagggagcagtcttggttcaaataccatactcttccctttcttaccgaatttccatttttgtaagaacagatatttcttcatttgctgtctgctctgaagatcatttgccttaaaaaatttgtttaaccagtttcacgggagaccagaacagtggagatcctcatactgtcatgccagaagttgatctgtcacgcttctttctataatttttttatgtgtgtgcttgttttccatcatagccaattagtcttataagctttatgaggctatgttttattaatgtttatttgtccactacctagcacaatgcttgaaatattgaaggtcagcaattcccaattattttctcttttggacacagctttgaatactgaaatttttcatggtacacttgaatgtattttaaaaaaagaaaataatactaaataacttagcaacaattatgctacatttattgctatagcttaacaacatttcatgatttctataaaaacaaccttagttgtcctaccattcctgtggtctctttccagtaccctgtcacctttagagaagagctgtttactgctctgactgatctgtctcttcactgtatgaaatcaaatttgtttgtttttggtgccacttgatgtcatttcctatccttgacttataacagagtacccccatttatataatgctggtgtacagaatgttggtacattttctgataaacgtggatgtaataatttaatgtcttcttagttttgacaaaaataactggttattttttgggtcagcttgggtgatggcacctctgtgaagtttactatgcctcccaagtgtctctgttgggtacttagtgtttggtcctgttggataaaataaaggttaaattatgaagtatataaagtatagacttcaaatgctatggaagtcttccatgtaacctaagctgtgaggtttgtgacagtttcttgacttgccacattttttagtctctgtatcctatgtatttaaggggttactaaattttattgcctttatcttctgcaagtttctaaatttcagtcctttctttctgtcttt

SEQ ID NO: 126949 - DNA, 1006 bp, Homo sapiens
gcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaatcatgtctctttttacaactttaatgatgtcttgttacccaaagtaaagcccaggccccttggagtagtgttcttgtttattaacaatctggccctaacctctttttccagctcgtcttcctcgactgccattctcctaccacataccctacatgctagccactcctaactgctcatcatttcagattttatcattcacttcaacacctccctgctttgggaagctgcttccatgtttttcattttctttctccctgtctttgccacataaattcatattcatctttcaagacctgcctaaatgttacttcctctgttctgtagttttcttctttcttgcattttcctaggtagaattagtgtcaactctatatgcacatttagctccttgctagctcccattcttgcatttaccacaatgttctgtaattgtttttcttctgattccccttttgatttcttctttgacccattggttacataggagtaggttaatttctacctatttatgatttttccacatttttcctgttattgatgtctaattttattctattgtgatcagagaacatatattatttttatccttttaattcattgaggtttttttatggcctagaatatgatctgtcctggagcagtgttccacatgtgcttgaaaataatgtatattcaggtgttgtggatggagtattctactgatgtctgttagattagttgtttatagtattgttcaagtctcctgtttccttgttgatcttctgtctagttagtggttctatgcaatgttgaaagtgagttattggccaggccatggtgtctcatgcctataatcccagcacttagggaggccgagggggtg

SEQ ID NO: 126950 - DNA, 1059 bp, Homo sapiens
tgagaatcttctaactgttggttttgatgccaagtgcatctctaactgtacttctgttaaacttttcgtgaactgtcctgactccatcttcttctcttattattttttctttatgtgtgccttctcaataattagtctttttagtgttatactgtatgtacttctgtaagctatcaaaaatccttttggaatcctgtaggtaatgaatgaaaaacaacataacaacctacaagtgtaagctttgattgaaccttcttccttggttttggattatagtgactggttttcatacataacccccctaccagatatgaggactttcagggttattgttgtctctcattctttatcatgcagaagtattaagcacattactttgtatttaatagtatccctgtgaatattttgcagtacataaatatgcatttattgaatctagatactgttgggtatacaaatatgaattaagtgtggtctctagcctcaggaaattgacttacagttggagagacacaagaaagactgtgttaagtgctatcatatgctgtggaagtcttgaggagggagaaatgaattctgattggtgagggtctagaggatttgaccaggggaatactgctttggggaagtctgttcttagcactgaaaattgaattgcatgagcatttatgtaattcttgtatgattctgaattgctttttttctcccttaagtttcaatgattcccctttaagctagtgttctgaaatttagagaatacgcccttaatgatatcatgatttcatagacttcagtccaaacttgaaaactttagtgttgcctcttcccttcattttctgatcattttaaaggcttttctctgttcaatcaggtctttcccaaggaaacattgctaattattttgtaaatgatgatttctgattatttttgtttttgttttcctcacagggtgtcctgcttagatgatcatacgattttgaggtcgtttgttaggctgttacattgtactaaaagccctctgtaattgcatcctgatggcctttcctgccttgtgttcct

SEQ ID NO: 126951 - DNA, 1836 bp, Homo sapiens
tttgttgccattgcttttggtgttttagtcatgaagtcttttcccattcctgtgtcctgaatggcattgcctagattttcttctagggtttttatggttttaggtcttaggtttaagtctttaatccatcttgagttaattttattaacaaataacctaaatccaccaaatacgaatttctttcatagaatatctcttccctttgaccacatctttattcctgcttatggctgcatatctacaattgaatgtgatctctgctgtctttgaaactctcatagcacattgtttaacatatatcttagtgcattggaaacaacagtaagaacgaaaaccagccaaaaaaaatctgtaataaattacaagagaatcgtcatgtgactcttagaaatgtaatgttggtaatttttgatgtttacctatgcaaggcatttcattattgagcttatggaaacccagattctctttgattggaatttggatagattatattttccagctttatgaagcaagattaaatgctgcaaactttatagactccaatatttctttctgttggtccaactatccatcatgcagaagggagtccgtggaagttctcctgtctgtgaaactgcttgagggctatttcaaagggctgtctttttggctttacatttctagttctctgtaattagacttatatacattttttattggataatcatcaattccctccaactctgggcccgaatcagaatgtatggcagtttttaatttcataacaactttgaacaaaactagcaagccgacgtagccattttcatactcaataccttgagaaaaatattgccaatttaaagtatattttgtttgtttattttttttttttggtgtggattcttgattttgtggaacaaaagactgtaagttacatctgtatccatgatattagtgccatcctttgccctccatccatggtgcctttacaaatcagttatggtgtttaatacaaaagcctttatggtggctttacgtagcagttatgatgcttaataccacagtcaaaatcagggtttgcagatgttttcctgattgcttagtaaatacttctgagcaggtaaagcaggaatatgtacgtttagagattcattttgtatcgtaatggcttggcacacttaagtgagcaggatatatgctccttcttatttttcttcccatgtagagaaaagtaaggttgtttcttatgctggtatcattaatttattaccacagacaggattgaggtgggctttaaagaacattgtttctgatatctaattattggctgtaagaatggtttcatagcaccttctctaaaatcaattgcagagatcctctgatattttatggttcatagtaacaaccccatggagcaagtcatctcacttctctagggagagcacattttgcagccagtttatcttgaaacattgcctaatttgaattattctaagggtgtcttatcaaatgttttcttttacagcatggtgattgggaatgcctgccttggaaagtgtgtatccctaaatcattctgactaggctctacatctctgggacctcagtcacccactgatgggtgtgttaaagaggatccatgaccattttctgagagaaatcatggccttcctttgcttaggagtggggtactctccacatgctgctgttttgttttcatgaagtaatgcaaacctggttgttaatctgctaattctctaagttcaatatgcccttaattgacaacagagaatatttatattcctgttttttctcggagaccacaatctcaaactctatgccactttgtccttatcaa

SEQ ID NO: 126952 - DNA, 1013 bp, Homo sapiens
atatccatttcttaagcagctggcctcatttggattttaagggagggagtggtttctaattaaagtcacatagtaaggtatgaaatgcacatgaagaacttctataggatctttatttgaacacacttccttctttcctcccacaaatatttacagaaatcctgctaggtgccaggcattattctaggtatagtgaatataaagcagacaaaaatctctactgttttggagcttgcattctagttgggaggtggatagaaaattagatatatatatatgtgtgtgtgtgtgtgtgtgtgtgtgtgtgtttgtatatatatatatagtgagagagagagagaaagagagacagagtattaaatagtgataagtgcaatcagaaaacatgaagcacaaaaaggggatttatacagggtcaaaagttcaatttgcaatagattcatcagaaaggcctcacatatctgtgtatcacagatatttctcagttgcctattttgggcttctgcttcttttctcccttgcttgacagaaataggaactggcagcttggcacacactacttctacaaggttgctgacctctgacataagtagggtctgtaggatttaaatcattcattttttttttttttaaaaagaagtcaatcatgcttaaataaacacagattatattttaaaattacatctgaaggcatttaaaacattccaacgaatatacaaatatgatcagaatttaccaagtatataggcagtctatttaccttcttctatatatttagaatatttctcctaatttttcttattcctcatattatgtgttgcacagtgagggatttttgtaaagggtgataggcaatggagtatgaaaggattcaacagccccactcccaggaaatccacttaatgcacatgatacctaatggtggatcaatagcatgatgtttgtatttgaagaaaaactcttataaaacaaaattaagaatgatgtggacttactgctgtgagcatgggaag

SEQ ID NO: 126953 - DNA, 1236 bp, Homo sapiens
tttgtttgacaagttttggttaatttctagagctatatactgctcattctggttttcctgagacagtttaggtttatgcccatgttcctggtgtaattattgagaaaaatctgtttaactcaaagtaaattatgccttataatacatctctcaaatcaatatacttttgttagccctgggctcttgttctgattttgccaccaactagccatatgactatgggtaaagaaaataacccaaactttaagtttcttcatctgtaaagtgaaatggtaagggtaaatgatctctgaatattcttgaatgcttttaagattaatgtttctttgatgtttagttgcttctaatatagcagtggtttagagcagtgactttcaaagaagtttattctgttttactatttatggtctttctctgttctattaatatcctattaaaataaatgctagtgatgacctactaacttgattgcatgatcagaatagggttgggttgaaatctatatcttgatttatgtattcctgagtatcattcttaatttgttacactgaacagttatttaccttctctaagcttcaatttccccattcacttgtggtaaagtgttctgaggattaaatgagataaggtgtataaggtgtttagcagagcacctggtgtatggaagaaattgcatgttagctctcctcttatttattcacgttgtgaatgtgacttctctctgctaagattacattacatagaatctaatacatggaaagttttttgaaccacattgttaaaaatattttaaaactacagataatattatatccttgtcaatcagcaattttgaagcatatccgtaagtgctttgtcaaacagtagttatatttttatagtagttttgtgaaggaggtacgtatttggtttgctagctgcgtagactccccaccaagaggtcaaatgtcaggaaagtcgttgaaaaaaatacattattaattttttgccctgttctacttaggattttcatcttgtttttcatttgaaataatatgtagcttctttatattgaaacctatatgccttttaaaaacattagaatcaaaaattgctctcacaaaaagtgaaaaggattaatattttgattatctttggagcagtaagctattcttttctaaaataaaatactaaatttatacctgatcagtcttttggtctaatgctcaatcaatacactggggaaagagccgaatt

SEQ ID NO: 126954 - DNA, 1006 bp, Homo sapiens
ttggacattgatttctcatctcatgacagaaatggcaaggttagcatttcagaacttctgttaacaatatcttcatcctttcattagtttaattcatgataataattcacacaagctttgaccattaaatccttttaggaagcagtgtttcccaaaggccaatattcgttatgaataattagtttcttcaattcattttagtgtatgaaattaacagtatatggaaattcattttctttctgatgcaataaactttccattaatgtatgagataatttttatgttttttttcttttcctatacaactgatggttagagtattcaatagggtattttattctgttcagagtaaagttcgtttgggaggtttgtggttttagtagttgttccctcaactctgttccttccatcacacctttttttcttttattgcacattaaatgatgaggtctcaccaaaaagcatttatgaaatccctgaagaaccctagtaaaggtggtgagattgatttttgtgtttcctttttaaaaattgtacagagaaatgtgtgaagcccatatctttgggaagcttaatattcaaaaactgtcaactcagttttgaaaaattgccttgtttttgccattattatttctgacatatggatcaggtgtagttttaaagaatgggagaatcaaccttaagttatttcttcacaaatatgaaaggagtcccacaaaataaaatataggatgccctaactttgcatagtcatgatcatagaaatcaaatcccaaagcacttatagaggtaagtaaaagcattgcagaaataaataatcaagattgattgcttccaaactgtgagtatatgtaaacaaacaaaaaatttgctttatgagactgaacttttaaatttattcagccagagattcattgttctgatgtctgtgtgattttctctttaaggaaagagtgagaacatattcatacgttataaattgctaatacttactagttgatacaat

SEQ ID NO: 126955 - DNA, 1044 bp, Homo sapiens
agtcagtaaccccttttctgctttaaaactggacacacacacacacacacacacacacacacacacacacacacacacacagagtccagtgataatcaatgtgatctcatatataaaaatgaaaggcctttaaatatttctgaaaatttgttgacatagataccaaataaataaagacagatttatgctagaattttttaaatagacataatttttagagaagttttagtttcacagagaaattgaacggaacatacagagattttctatgtacctactcctgttcccatacattcatagacttccccatttatcagtatcccccaccaaactggtacatttgttacagttgaattgacattgacacatcatcacccaaatttcacattttacattagcattcactgttgatgttgtacattctatggctttggacaagtttgtaataacatgtatccactgctagagtatatagggtagtttcactgctctaaaaatcttctgtgaatttataaatttttttgatgattaaaattgtatatatgtactttggaaaatttagaaatgtaaaatagaatgaagaagaggaaaagatagtcattgcacacattttgatataaattttatttaaacaaagatatcaaagtgatccttgcaaatttgggccatcttttttacatttcatgatatttagagatttattataaaaatttgtgatagtttctagaaggtatcagcagccatccattcccttgccctattctggcctccaccacttttcctcagaagctagtttacctaattatcaaccactttttgtgtaaagcaatgcagatagagaacaatagaatggagaactcatccaggttagtgacattctcacagggagtgtgttggttctaagaccaggttctaggatatggttcttagcttcacaggacctgaaagctgattcttcattattttaaagtttattagcctttccaggatagactcaccaaacaaattcataaatatatgttatctggtattactgatatataa

SEQ ID NO: 126956 - DNA, 2594 bp, Homo sapiens
attttaagctatagagtttcttgtctccctacgtttcccttatcttatgtgccaaattgaaaatgagaggttcttaatactttttgtgccatggaccccttttccaatctggcgaagttcgtggatccagtctcagaattaaaaaaaaaaaaattaagcatgtgaactcaaaagtcttagattttttttttttttgagatggagtctcgctctgttgcccaggcttgagtgcagtggtgatctcgactcactgcaacctccacctcccgggttcaagcgattctcctgcctcagccccgcgagtagctgggattacaggcacacaccaccatgcccagctagtttttgtatttttagtagagttgggatttccccatgttggccaggatggtcttgaactcctaacctcaggtgatccacccgccttggcctcccaaagtgctgggattacaggtgtgagccaccgtgcccggccagaatgttattaatgcacaaaataaatgcataggattgtaaaggaaataaactaaattgaaatagtgccatcaaaatattttaaaatctctaaaatagtaatacatgaatagtaatagtaatgggatgcggcattacttctaacaggtactataattttggagttagtgatgagtgtaacaatatttcaaaatatatattatttctgtcggtcacaagtacaacaaatactactgtgatttgttgtctgcattcttaataaagggaaatttaaacttttagctaattgttagtgaaaataagcatatgatctttttttcatccaaatacatgaatcatattccctatattgtatctattgaacttttcggtggggtttaaaacctctaacatagtggaaagacaagactgagtgaatctatgtgaaaaagtatcaattctttgaccagggagataccacatagtaaatgaatacttctgatatactaaatggttccttatggacctttgggagcaaaattattttgagcacacactctgttttcttccatttcgttaactggtttgagctcatttacttataatactcatccaaactggccatataacatttaaaatttttgtttatttccaaaaaattgatttcttgcaatcatcttcactaattgcctggcatagaattcttactagtgtgtttccacgtgtactgtttgttgtacatttgtcagctcactcaaataaaactgcaaataatgaaaacaattgtattttctccagtacatctgtgaaataatgtcttcttattttttcttccttctctcaaatcttgatcccaaattatgacaatttcacaaccatttgaaaaattattgtgtttattggattatatgcaggtgcggttctgtactttattctacaaatcagtggttaagttaatgatgcactagtttaaatttagcaaaatgaagcattacaagctcagctgaaaaatgattcttgttttaaccagtatcttcacacagctgtttaaataccatattgtacttttttccctttccttatttaaggtggcacatggtacttgtgtaatctttgcttattttaagctggcataaaagaatggttctcagcaaattgaaggcagtttgcaaaactggaggatattctcatgaatttaggccaagttaaattattattgaagaatacatctttttttcccccaaaatttctcctgagaattttttattataatgttatatttgaaagtttatgacaaaggtacttttttttctcatttgttccatgtaattttctttcttttgtatgatgataccattaaagtaagattggccagaaagagtcagatgtttttaaattgtagtagttcactgtctgtactatcaattttataatatttttctgcctagaaactttttgttctccatacatagaaataaaggccgactcaaagcatattacattaagatggcaagtttaaataattttttgtaactgcttgttttttcactcctgcactatccccactgcctacgtcttcaatctccagattcctacatcaccaataagacccaaagtttccttttcttttgtatttttctcaaatgcaccaaataaaactttacctttagattttatttgtttacccttatatatttatttagctttcatattttcatgaaaggtgtataatatttacagatattaatagtaagattttgtcacaatatatctgtgagatagggtactgccagtgtagacattatatttactttttagcctgggatttttttctctatgttggttgattgaagcaaataatcttataggccagaaatacaattgaatttggacagatacgcacaagcatagttgtaagttaagagactgagttgaactatatcactataattgttttagtttgtgaaaatctcaatctatatctctatttcttaaaatttgtagaattgcttaaagtgttcaattatattctgtatatgtattcaaatccccttaatatcaggcctgattttggttgaattttactgttttgtatttatggaacttatttttattattactggatttacacctaacaacaa

SEQ ID NO: 126957 - DNA, 1420 bp, Homo sapiens
tgcctccatacatgctgtttttctgatctgaaatattattttttcttgtattctttagaagccctagtttttccccaagtcacttccctgaagccgcctgtattaggctattctcacattgctatagagaaatacctgaaactgggcaatttataagatgagaggtttaattggctcagttcttcaggatgtacaggaagcatagcagcatctgcttctagggaggcctcagggagcttttactcatggtggaaggcaaagcgggaacaggcacttcacacagcaaaagcaggagctagacagagagtggagggcagaaagtgccacactctttcaaatgactagatcttgcgagaactcactatcacaaagacagcaccaagccattaaacatacacccctgggatccaaacacctcccaccaggccccacctccagtgctggggattgcagttcaacatgaaatttggattggacaaatatccaaattatacaccatctatgacccttcttggctgttgtagttggctctcctgtatacctgatacacatagtctagttattatttactgtattttgtctgtttcctctgattctatttcctgacgagagtaaaaactcctatagttgattttacatctgtaactctgggatttgtcacaatgtcaggaacatagacacagtaagtatttgttgattattaagaaagttaagattagattgagaatggcattttgagtgcttgtgtagtatttggttttctttacagttattattataccataaaacatatatttaatttattttataaatggttagaagataaaatgcatcacattctgtttttccattattgtttggttttgtgacagttagtgctgttatctcttatctatatatctgcccttccacactctactgcaaagatataaaacctgtgaaccacacatgccagattccattgctagcaagttttctattaggtacagccaaagcaaggcaatcttgaaagattgtaaggtaggagagaagaagcagctatttatttccttttattggatggtgtacttcagcatgcagaagaggatactgaaggtgacctctggtggctgtgagttccagaagcattagtgttggcatcttgaatagcagtagcagtactcctgctgctggacagtataggctctgttgagcaataacagagcattcccagtggcacctgtagaagtttttccaggagctcagcaattactgcaggcttgtgggctccagcctagtggggtagcaccctcactttggtttgaaaccctgtttttgttttgtgccttcaagtatttatttcttccttttttttctaaccccttcaacaactgtataatcagtttctggtattaaatttcctattctggaaatgtctata

SEQ ID NO: 126958 - DNA, 2441 bp, Homo sapiens
tgataatttttttactgaagcatataaatttatgagataatacattttgactatcggatgtccttgcatattactttattttcccttttctccctttactttttaaaaaatttgtttattctctctactccttcataaagaaatgtgtgtgttaaatttatggccctcgtagcttgagtgttcctaagcggcagccctcttcaaaatggaatcttgatgaataagaacctggattaatttattcatggctaaataatttttcttttctccctaactatgtattcatccctaaatcatacatttagatcataactaagaattttactttgttggctcttaacataatgaaatatattctggttttcaggcccttttttcgacttttgtttcctgcatgttctttctttgtctatgagtcttttacttggggtggctggcttgtgctttgaatacatctaacatcctccactctttatgcttcttatgcctttctttataccatccacccagttgtaattcctgtctactctcagatacagccatgtgccactgcataatgtcagtgatagactgtgtttttgatggtcttcccataagaggataataccatgtttttactgtaccttttttatgtttagatacacaaatatcattgtgctacaattgcctatggaattcagtgcagttacatgctgtacaggattgtagtctaggagccataagctaggggtagtcggccataccatctatgtttgtgtaagtataccctgtgatgttcgcacaattatgaaattgcctatatgcttttctcagaatgtgtttccatcattaagtgatgcataactgtactttcctgttgttcaggtgtggtttaagccttatctcttacatgaagtcttttcagacttccatagccagagtaagtttttttttacattcctatgtagttattatctgtaatactcacctttttattagttgaaaaatgaagccttttttttttttttaagaagccactaggaaatgtttccttgtgtgttgtttgcttaaatggacgtagtctcattcattactgaaagactacgtggcggtgaggaaggtattactatgattggtttacattaaatagagcttaagtctgaagctgtggtagaaaggatttggaagagcaaattgcattgtgtgcacagataattgtccatcctggaaaatatccacgtaaatttttaagaaatgcagaagcatcagaaatatttttagaaatccatgtcgtttctgtcttcactttatttatttgttttttttttcagtcatttcctgccattaagggactcataggctactgaaggattcagataaatactttttagtaaagtatcataagtaccatatgtataagcaagatcctgaggaaatactagtttcttcctattgtcttaccacctgtcagggctagtttcctgtgttatttggacttctctctgcaggactgcccaaatttttcatatcaataaaagaagcttaacgcaaaattactgattttgattaaagaggatatttttcctggttggttgtataagatggactgtgatagcgtcacaaatgtttgccttatgatatgttttaaaaagtcaacgatattctgggggagggccaccttaaaagaagtgagaattaaatcggaatttttctttgggtgagatatgcacgtatacttttaaaatattttcctcccgatttactttggttaacttctagttctcctaattaatatgtgtgaatttggcatattaaaagggtagattttctgtcaaacagtcatgacaaaatagcagacaaaaaatagaatatatttcacagcttaatttaagttacatttttactacccttgcaattatattccataggtctccactatttgtttagaaaaatctataggataattttatttctttaatcttgtagaaaacacagttattaaaatggacattgaaaacatattaatagttattaaagtgggcttaactgatagattgattagaagctggggaacttgcatagagaaggaggaggagaactagctttttcctagacaagtgggaattacttcagtttattgtattacttcagtagttattgcattacttcagttttattatcctatactagaacagctttctaaatgatcttattttcctcatcttattcactctagtcaatcctccattcctctggcaattatctttctaaaatttaaattaaaaaatttcaaatgcaacatcattcaatcaattgtatgagcaatatattaatagaatcatactttgctcaccttttgcctgtctaaccttttcttcggcatattcctgattatctcctcatttgctatatttcaaattatatacaattctactttccaggacatcttatgctttgtcagg

SEQ ID NO: 126959 - DNA, 1128 bp, Homo sapiens
ccttttgctgtttcctttagacatctgtatgtgtctgcaatctgttactaccagatttcaccaccagcccttgaactcttgaattgtttgtgtgctcaaccccttttctgttctttgtaaggaacctgagttctccattggcttccacatctgtattaaccaggcatctggggaaaggacgccatctgctttgaggagagaatcaatcaccctttcatttacactgatatttgggctccttaaaggccccgtggccctccttcactctttaactttttagattctgacctatattggaaaataaaactgctaaatcataagctagtgtagtttttacttccctaatccttcatggcttggataaatataacattataaggattgcattataagtaagtggttatattctgttaatatttatttaccataattggtgctcattaaagggcagattgaaaaaatgtagatttcaaaatataacagcctatttggtattttttcttaagtaaaggaaaatgagaccatgtagaatctataacaaattttattgaacctttcctggaattttcaaagtttcacttaactctaacaggttcaaggaaataatgaaatattaaattcacagactttgaaaagcttattattaatatgtttaaagaactttctttaagcatcttaaatttttcttaagcagttcaacaacaaaatcaacaccctcactaaccaagtgaaatcaaactgacagattgtttgtagcagccttataatggtctccttgggtttatgatctggggaatgaagacaaattgttgatttttaaatagaatgccatgtactctttgctaagaaaatttgcctttaatttttagacctttgagtattttattactagtttttttctgtctctgattcagtattattatatcttcaaaatactgaatatctagggagtctgattgataaacctcaatttccagagagtcaggtagtatttctttgcccatataatgttggatcttaatatataaatcttgcattcagccaaaccatattaagcttggcaaaatcctttgtttctacattatgtctgaataatgatatactgacaattagaatcttcatttattt

SEQ ID NO: 126960 - DNA, 2015 bp, Homo sapiens
aatatgaataagttgcttgtactttaaggatctaataatcagtgattgggggaggaagaacaaagtaaacagtactgtatggtatgataactataagcatagggtgctttcagagcacacagatgtgtcacctggagaaactggagaagtctaacaatgttttcttgaggattacacctgaatcaaactcaattgctttagtgttctggatgaggaatggtggtgcctagtactgagagaatatgagtaactgagtaatttcaaattgtttggcattgttgggtaccacagtgggagtggtaagagttcagtgtgagcagcaaccagtcagattatcaagggccttgtaaacagtgttaaagagtttggacttgatctgagggtagtgggttgttcctaaaatgttttagaaagattattcagattgtgttttagaatttatgggttgtaggccagagaaagggaaaccagttaggaaactgataaaatcacctaggtcagaaattatatgggctgaagcaaatgctgaggaagtgagagagaaatgaatagttgcatgagtgaacaagaatttggactgtaagaatgggaagaggcagagtggctcctcagcttctgatttgagtaagaaggtggatggatggtggtgaagccattgactgaggtgaatggagaaacacaagaaggtgtagtttgggatttcatagaattagcttctgtcttggtaggacagtgtgaccacatgttctgtgacctaacagtgtgcagcctgggtatgatctattgttgaagcctcacttgacttatggctggggatcaatgacttttcctctctttctgtgtatatatatcttcccacgatggaggctgatgtggggatgaagattttttttaaagtggttttaatgcacagaaatatacagtaatgaatagttaacaagggaagaaagagctccagttaatagtactaagttaaaaataaaagagaaaaatagaaataatttttatataaagtcattgttacgacctcccatggaatgtggcagccgaaatattaactattagttatcccctaggaggccttgggcattacctggaaatgggccctgaaggtgtattttcagccaatgttctggtcttcctttaatctgtttgtttcctgtttcatactatatgttatgctaacattctaaaaaaacttaggtttaaattgcttcttttctaaaatagaacttatcgctatagaatatagccttctgtattaaaacagattatagggttgttattgagggctgatctttgaaaccaaacatataaaattgatttaaagctaaaattttgatttgtaaaaattttgaatgatgaaaattttggtagttcactgattactattctcttatgactctgcttcttccactttctaccctaatctcttcccaccatctcaccagccaaaaggagttctacttagatctgctaaactatgaattttttttacggttttggaaataacattatattatatttggaacatattggagaaatctataatatgtagcacattagtgtagaaggatattctacttcctgtgcagagatgacttttagtgcttatgaggactttaactatggtctttaagctatatagaacatcaaggtcacagctttatattgctgaacagttctctggatgatgtgagggtgaaaaaagaatgctctcagcactttttttgagtgtgacaagattacaaatgattcctcacaaagtcttgaaagtgtaatcgtgccctcagacttgccctcctacagacatatttggtaacgcttacttagccttacattaagccacatggtgattttctgattaccaggatggtaggacagggatgttttcttattggtcattgtgatgtgtggacaacatttaaggtaatgatagcaaaatagttcacttatctatatagttggctaacttgtggctaaatggcaggctaatcttagaattattcagcaaa

SEQ ID NO: 126961 - DNA, 1022 bp, Homo sapiens
aattataaatagcaatgttgctcacaattcagttataggcaaaactacattataatttaaattaaaattccagaacattattactacagtaaaatttcatgaggggttcaacctctctaataaagaaatgcaaatgaatcaactgtgagatgccattttgatctactacactgatgatgccaaaagatagaatgtagtatggaaaaggggtcaagggaatagaagttatatactcgtggtcggaatgtaaagtttcaatatttttgaaaggtatttagatgatatattaaaatttacatcctttgattcaggaatttcacttcaaggatttttttgttaaggaaataatcagagacacaaataattacatgaagggctcgattacagaaggatttatactattaaaacactaaaaaaacctaaactccaaaaaataatggaaagattaaaaatattttggtaggtccacatgatgatcttaatatacattcatttaaaattatattttggaattcatttactaatatggtaaaatatctatagctatattaagtggaaaaaatggaattaaaacattatatttattttgcgcgctttcacatttgtacttatctgcatacaagaagattgaagcaaaatataccaaatactgttattatttataatttaaagatagctaatctttaaaaggttctcattttatatacctttttgaactttccaagattgctaccattaatcagtgttatattaaaagttaaacattattttaaaaagctctaagaattagctcaaagaatatacagctatgaaaacatatattattttgtaactaaaatcttatatttcttttttgtggattaacctattattgggttttatgctagtaaaataacattcactgaacattgcattctctatgagatggcatttgcaaatctcataaattcagagaacacaattatgtcagtgaattgaaattaatgaaatggcatcccacacaggcaccataatttgcatat

SEQ ID NO: 126962 - DNA, 2232 bp, Homo sapiens
gtcatattgtttaaattatttttcctgaattatatcagtttttgaaacatctttaatattcctttgtaacctgccactgggtggaaaagaaccccagctgtattgacagttttcaaaataacttttaagagcttataggagaatactctgagagagctgttttaatggtgctgttttcaaaaatcgtacaagttctctgagtaagattggatctttgtagtttcattagttctattatgactgagaggtcatgtggttttgtaaaaatattttttagtttaatgatgaaaagatggtgaaatgtgggtggttatgctgctttataatactttattctcatatgtattcttatatattatatatctactatacgtacctattttccaaacaggtgattcaggtatgtagttaaaaccctcatttccacactgaaatcaggagccttttgacacatagaaatctggagaattaagaatttcttgtattatgtacactatgttttcagcttgcatttctgaccttaagcaatttatggctctctttctttctacttctgcatttattttggccaaaccacaggatttgatgatgacttttaaattattaatataccataagattactttctagcctctaacttatttctgaaaatagttaaaaatatttttccttttcatgcacaaatagcacatttgtgagctgaattttcctatatttatttttatttattaatatattatgtatttgctcatgccaagtgctacaaaagaaatagttcagtcttttgaagtgtaagaagtacatggatgaatgaatggtgggttacagtacctcgcaggaacagctatgatagagacatgcagcaaagggagttgagtacatgttaatgaaattgtagaaattatttagttacagtgacactttttatatataatgatctatgtgagtgaacactcataaagcaggttaaatgaggcattctattttgataatattttctcttacatgaattttaagaattattatcttgcttaactgaaactttataccagttggacagcaacttctcatttttccctctcccaagcccctgaccaccaccattccctttttgcctttatgaattaaactattttagatacttcatataagtagaatgtatgcagtatttgcgcttctgtgactggcctatttcatgtagcacagtgttttccaggtttatctatgctggcaggattcccctttttccccatccatatgccaggattcccttctttttagaagctgaataatattctagagtatgtaaatgtactacgttttccttatcctttcatctattgatggacacttaggttgattccatatcttggctattgtgaatagtgctgcagtgaacatgggaatacaaatacttctttgagatcctgatttcagttattttgaaataccaaaaaccaaaatttattttggataatacctgaaaatgggattgctccaagaaatggtagttctttttataatttgggtggaacctccatactgcttccagagctgttgcatttcccaccaacagtgcataagggttccagtttttccagtgttccctgtacttgtttttcttttgttgttgtttgtttggtaacagccatcctagcaggtgtgaattgatatatccttgcggttttcattgcatatttctgatgattagtgatcttgaccatctttgcatattcctattggccatttttatgtcttctttggagaaatgtttatgagaagtaggaatcttaatgaggaatatgttagcagctgaagaagatttctgaatggaattgtttaagagacaactgagaattgaggcattgtacagctttcacttatggagggagaatgcatgcccataattttggaattattgtaactttaatatctgagatggaaagatatttcaattataatctttggtattgatcaaaaacttttttgtagttttgagaaaattttaaaaatttaatcaaattcattatttgctaagcatcttaatttttatttggcaatctcagtcttataaatgcataatttatatctcaattgaggtattatgatgaactaattgccttcaaaatacctaaaatatataaaattcgattaagtgtaattttctttatatctttatagacctgaaagtaatagcaagtaaagagagcagaaatttactcaggtttggtt

SEQ ID NO: 126963 - DNA, 2232 bp, Homo sapiens
tgagctttatgtacattttgtatactaacctcttgttggatatgaatcttatttttgataaatctattgccagtctaattcttttacttgtgtatgttgtttgaattcatttgcctggattccctgaggatttttcctttatcttgaatgtctactacttttactaaaatatgtctctgagttgattgttacaagttttttttttccccccaccccgtggctagtgggccctttcagtatataagttgtggttgtttgtgtttgaatactttcttggttagaatttcattattagtcatattttattttaaaaagtcttcttcagaaattccatttatatataaattgtatcttctttttcctgtcttccatttcagccactttctctttgaccctttttacttttttctctatttcattttattcatttagttgattttctactatttttccagtgtctcttattgcattttctttcaaatctgtttttccttgggcatcttgtaatttacgttccatttctgatgtgattttgtatttttcttctcttttctttctgtgttcaatcaattggtgttttattttttccttttaaaattttctggtcattcatttctctacttagtttttaattcttatttcaaggttgttttttaaatctacctaattgcagaatttatggatatttattagttttgagtgttatggttttcttctgttttgccactgttcttgccagtgtcttgccatttgtttgtgtgagagggtggaattttttatcaccttaattgtttgggtccttattttcaattttctttttatgctaggtttttgtttatctgtatgttgggatggcttaacatttctagttcaagagcaccctctcctgttattgtaagcaaagtattgtttctttactggatggcatggttttcaaatggcatatgccttccaatttttaaattttcttttgttttatgtaattcgaaatgttctcccctttttctctctctaatgtatagtttccaaagaaacctctcctgttgttttagctgtcttttctctccaaagtgacgcctttgcaaggtggcttgtcatgtcccatgtgcgttttcaagtctcctttctgttatcagtgttctgagctaactgttcacttttcagtatatatagggccaagggctgagtttctttctgtttctagcagtggttttaaatcatggttcaacctgcccttaactcctctctgctctcgtttgtgtagtttctcctgaactgctcttggtctccatgaaggctactggcaggagcacatgagagaggtaggtaggtcttgatgtttatatttatatttacaagtactttgaagtttggagtttccttgttttctagttatgttgagatagggtgtgtagttttaattcttctccttctcttttttttcctcttcctgtttctgtttcttttcaggatattttggtactttcaaatttatacctctgccacagcttcagctgcctagaatcctctctattaatgcattcttaatagcgctcaacatcctgcagcaacttaaatgtttcgtatcttggcttattatgaatttgaatactgaataacatgattgtacatgaaagcttttcaaaagatgtgacgatcttttaaattattgtaggctttatgagacacctagtctgagcaggttaggaaaaagtagattctgagatcttaccaaggtcttactaatgtaaaaatcaatggctttttttttctctgtgttattaatggttagggtcccaatgtttttttgtgagactaaataataaaataatgatctttttaagtgtggtgcatcattgactgctgtctttttatctgagaaaactatgtatgtttagtaagtccaagggcacgttgaagtttcatgtggaatagttacatgggaatttgctgcagcaattactctgctgtttaatgacaagcaattatccacatcacttctcaagctatacatctctctctcttgcccttcagcattatgaacatcccacccatgggcatgagcatttattctacacagtatccagctgttacctactctaagacgtaacacacctctagtttttataactaattctaagccttgctgtattggggcttgtaaaatataaacccttactttttataattgccatttactttatattcttcaaactttgtaatgcttttaga

SEQ ID NO: 126964 - DNA, 1281 bp, Homo sapiens
atatactacagtgtctggctaaatgatgctagataaggatcaacaatttttatttccttcatgtgtgctttttgtgctataagatcctaaactaactcccaagtaggtaaagcaatttatttttcataaacttgtactattaagtgtacttattatatatgattgtttgatttatggcatatccattaattatttttaccaatgtagtttattattgagaatacctagtccccatttatgcaataacaatttactgtaactagaatgacaggggtgggggtagatggttgaactttaatgttcttatctaaaatattgagattcatagcaaaaaaagggggggaggaacgtgctaaggagaaaaaaaatagcaatagcatttctttccttcacagtttgcttctattctttaatcacacataacttctacacatctttcctacaaacactctcctctgttaaactgatctcatctttgccctacagttatcatctctgccactgtgcatttgactgcagaactttctcttctctaccatagttgaggtcctgcctcctccatgaagtgctttcactgtgcttctgcccttgccttcttcctttgtctcactctgttctctgtctcacctacttgccacctttcacaagttgccctgaatcgtaatctatccttttatgtgtgttttaactctccaactggattatgtgcagaggcagtcctttttatttctttgtatctctggtaaacctcatagaggccttcacatgacagatttttagtgaatgtttgttgatgctgttgctggttttgcttctgctaatgttgatggaaaagaaggaaaatctaatcctgaatgtatggtacttagtttttctgtttgccttgggtaactaagacactctaggtttaactaatttgaggtcagacttggttcaccttgctgaatggttgattcatttatttgtcagcctacctgcccattcaactgtccatacatctgcccatgtatggtacttagtttctctgtttaccttgggtaactaagacactctaggtttaactaatttgaggtcagacttggctcatcttgctgaatggttgattcttttatttgtcagcctacctgcccattcaactgtccatccatctgcccattcattggtccatttcatccatccatccatccatccatccatccatccatccatccatccatccttccatccaaataacttaattaataccttcagttagatactgcaaaatatgtgctgggagcc

SEQ ID NO: 126965 - DNA, 2141 bp, Homo sapiens
ttcttcctttgaaaaatctgcctttttggttctagctctatcctctgtggtttcaaggatatgtttaaatatttcatatgttatcaaggctaattatttataaagatttatgcaggagcatttaccatgggaatggttttaatttagatcataatgaaatagttatttcaagccagtttcctttctgtatttatatatgtttaggtgtgttaagactggattgaaagtctcatttggtgtatatatacacgtacaaattcatatgtatgtaactatgtttttttaaacattgattgcagtttacatcatttattcatatattcattcattatgtttgctgagtattttctgtttccctccattagaatgcaagagacaggtgcctagaacagtggctcatagtaaatatttgttaaatgaataaaattgatttaatatcttgagaacttttctgtgtgatgtattggctaccagaattatcactgagaggttaggttgtattaaagattgattacacagctgattagtagacgaattattactagaatccaattattctcaatattgctctgctgaattcattgctgcagaatgtaatctttgaaaaattctaacatatacttaatatttttggtgaaaattaaaaattgaagtatatcatacaaacagaaatgtgcacacatcttgaaagtacagcttgatgaacttttccagagtattggtccatgtaattatcacactgatcaatatcgataaagaacatttcctccctcatgtgaccttcctgtctttacccagatgacttttgtctccataggttagatttgccagaagtgtgtattaatcaaaagcgtacttatagtaagtactcttttgtgcctgacttctttcactgaccattgtgcaggtgaggttcattcctgctatttataacagaagttcaatgtttttttgctatgtagtattcctttgtaagactgttctatgatttatgtttccatcctcttgttaatagacatttgggttgtttccagtttttggctattacaaatgcttgaactttcctgtacatttgtgaatttctctttggtataaatctaggagtggacttcctgggacctaggatatgtacatacatgttctgccctaggagatacagctaaagaattctccaaagtggttctattatgttctatatttgaaagtatggtggacattagagatgtgttttgaggaaatagggatcatattggctgaaaacatacacagtcttaattcttaaagaatctaaataggatataattactttgttttttaagaacaactagaataacatcttttatatttttctgtttatcccagcttttcctttgacataggaaaaagttgaatggatgtattatcaggctgtcatctctttgaagtacaaagaagtctgtaacagaacaaaaaatgtcaaatattcagggatcatattgaattactatagatatatttgttgcccaataataatgattctttttgcactgtgtatgctacaaaacttgaagtcaggaaaaaggaactttcggatttcagttcatttgatacccaataactttttttttctattttttccacatgtactagagtttcttgattatgtttaatatgttacagtgaattgtttctagagtattctgtatatagaatggtagtatcagtgatctacaaagaattgatatttctttgacaactataatttgcctgagaatcccaactagcactctggggggctatgtgcagttcttaaaccatgtgttttggaacatagcatccttatttgatatggcttttgaatgctattttagcctcagttcctttcagtatggtgtttggaaggtattttgatatattacagaaggctaactagtcaattttcaccaaaattcttttactatgcaagtataggtacagaataaaaagttgagttgaagtctttgaatgagatagaggactgaaaacattactagcttttgtatctttgtttcatgttcaattgtactgaatagtttttatctagttgagaggagtggtgtagtttgtttaattactcctccttacttccagttttttcagtcactatttctgcaattttgatt

SEQ ID NO: 126966 - DNA, 2757 bp, Homo sapiens
tgaattcataaatattgttccatctacacacctgtaatctagtcagcttcttgtcttggctcacctcagagctataagctctcagtctctagtgtggctttctgtttatctgtccatgtatacttccagagggatcttttaaaataccatagtgaaagtataaattttatcacttaaaaaactcagtgggcctgtaagtgtgaggtaagttcacactttttcctggatcatttggaaggctccatccaaactacttggagaaaaatgtagttggtatgttgattgcatagatagtttgaatatatgagtcagcttacatattgaataacagattctggatctaacagatgctcagtagtgtctcttacccccttctctcctctgctctgcttaggtctctcctgaaatagcccaggacaagggttagggcatagtggagtcaacatgggttcaattcctgactttgttactcccaatatagcctctagcaagtatttctatttctgtaatcctcagtatcttcatttataagttggtgattataatgtcttccatattaggctttactgaaataagacatacaaagcacttactacatatgatggttcttatcgttgacttagtgtatttgtctttgatcattgaaatatagcaatgacaacatatttagaagagagtggttaggtaattgaaataacccaatgttatgtcttgcagtaatggttgaaattgaataagctatagctatttaatctgaagacaagaaaactgaggcaagaggatatgcaatagctgcttccaagtatttgtggagatgtggaagatgaattcagtttattctcttggctctaaggagcatagccacatgggtgtatattaaagagtttaggtaggtttttcactcaatatgaagaattccataacagagctgccttaaaatgacctggacagtatagcagctattttggtggaggcctgatgttcaccagtcaggattgtcaaatgggacattagtactttgaatacagagctagacttgttagccactagccagaatcccactagataatctccattgcactagcctcctctgatgttctatgagtcaactcagtttttgcatatcatgttattttcaagcatattccacctggaccatttacagatcacagtttctgtggtaaccaattcctgtaatatgttgcagtcctcaaataatcaaataccatacattatttcttcttctgtatttgcatgctgtcttttatatttccccaaagtgttaaatctggcctttaggaatcaacatcctgtaaaccccaggagacagtccaatgtgtgcaacatagggcttattgcaaacagctgcttattgcagagtggtgggtagcaaattgtgcctcaggtgaccaagaggaaatgaacctgatcatgttgagctttctaatgaagcacaactaaaatagtttgatgtaaaaatctgtctacttggaatttttacttgacctcaaattagtaatattacacatttagtaatattagatttgcccaggagtgataaaggaatttattgaatcttaaaatgtggataatgttttatgtgatattatatgaaatttccagttttcattcttaataaatctgttcaataaaactctaaggaaaactgtatgtgagttactcagggtttatctttactactacctctgccctgtcagttttactactgttatacccgagttgagtccctgggtttctgggacttaaatgttgttttgcctcatattctcctccagagatttatcactgtggcctcttcctggtgcctttaggtgccacttcattttcagaactttgtcgacttgttctctcttattaaaattctccagtgttttatcttcttttcctccattctcctgtttgtccttcctaaggtaacagcgatctacttttaaaaactcagctatattgatacatgttaatacatgacttaatctcaggtaacttatgtatgaacggtagtgttcaaaacagaaggcatttatccatctctactgatgggtgttaggctgttgaaggtgaaatttagagaaaataagaaccttgtgttcacatcaaaatagtctgcatatattacacctatagacagcttccctgcctttttgcttccttcctaaatcatttttagtctttctactgtatgccagacatggctctatctattgggaatatgctgaagaacaaagaaggaaagatcagtgaatgggtaatagagaaaaacaggaatacagattgagagttcagtttagatatggtgtccaaggaaagtctatttcaagaggtattacattgaaactgaaggaagaaaaggaagcaggcatacacaaagtgaagggaagaatgtgctagccagaatgaacagcatgtataaaggttctgaggtggaaaaaacttggcatgttgcaagatctggaggaggccatgtggctggagctttactaggacaaagctggtggaggtatgtttggagaggtcagtagaaatcagatcattaataggatggtaggaagtcattgagagagattttaagtaaagtgacttctatttatagtttgacagctctatattaaaataaattggatggggcaagaatggaaataatgcatttagaggtctaagagaggggaagtggattactgtgagtatagaaaaaatggagataagtggtcagattcaaaatatccctttgcaggttca

SEQ ID NO: 126967 - DNA, 3372 bp, Homo sapiens
attagctgggcgtggtggcacgcgtctgtaatctcagctactcgagaggctgaggcaggagaatcgcttgaacccaggaggcggaggttgcggtgagcagagattgcgccactgcactccagcctgggtgacagagcaagactccgtctcaaaaataaataaataaataaataaaataaaaatgctcccctcattcattttgatttaatgggttggtatagaatgcaagatatttttcccagtgtacacgcaatagcgaattgagcaaaaaatgtattaagtaagctttttactttcacatcaaaatcaataccagcctgttgttgaaaattttaagattatgatttcttcatcaatttgcattgtactttcatctcttactgtgtaatagttggccatctaccctaataatactaaatgcaatgattgaaaatgcatagtctatttttcatctaattcatcatccccaacaattacagtattcacggttttggtctaagtggaaactttgtaaggaaattagggtaatgtggcctctaacacaattaaaaatagatacaaaagatgagaggtcaaagtcctcatggtgactatgaataaactattaaatgttatggattatttttggaagaggtgttagagtctcttttcctatagtataaaatactctatagaaaggaagtgaaaagttgatattctatggtgaggtcaagctgaaaccttctctgaatcaatacacgacttcagataaaagctgctattgtggctatgattatttatgaagaatgatcatataaaatgcagataattattatatgcctagacccccctatctgaggaaggaatattgtaacattacagtgtgttgaacacctactgtgtactgctttaggatctggggacactaagatggccctgttcaatgagttcatagcctaacaatttataataatatacactaatatttaaaaaataaagataagtccaactatatatatatatatatatgtatatatgcaagcttgatgatatgtaatatagtttattattttaatagttaacatcaggattccttttaagaagggaacatctgggccaggtgtggtggctcacgcctataatcccagcactttgggaggctgaggcaggtggatcacgaggtcaggatttcgagaccagcctggccaacatggtgaaaccccctctctactaaaaatacaaaaattagcctggcatggtggcgtgcacgtgtaatccaagctacttgggagggtgaggcaggagaatcccttgaaagcagaagatggaggttgcagtgagctgagatcgcaccactgcactccagtctaggcaataagagctaaactccgtctcaaaaaaaaaaaaaaggaccatctttgttttgataaataaagtaatgagctcacatgcagtagatgagagccatgatattgggtgtgggtcggggactcttattctacatcagagaagagacatttattttgactagaacagggagagggctcctgagagacaataggagaggaagtcaagctagaaggctggattgggcctcatgatttggccctactaagagaagccatgtattttctttggcctccccttcctttcctttctttcagtggctgttttatctagctcttgtctctctttaaagcagggacttcattctactccccttgctggtaccacctgactacccttcttcctctacaggcattcttagtgaatgaactgttgcatagttaaggctcctagggcttcatgaaagccaagaaatatttatttgccttattgaagtttagagggagaagctgacttttatcatttgaaatttaaagagaaaggcacctgatgtaaattaactgggttgcatttggttaaactttgctcaaaaatttaaaactattttttgctgtctcacttttttttccatagtgaggtatattgcatcccacttgcctgtaaaattcttgggggagtggaaacaatgtttcatgcattttggttaccatcccaatgcctaacatagcagctgctcaacataggtgctccttcatatttgttaaataatttattgttattaacattagccataattttatttaatttgttattttgccaatattttagtgaaaaatggaattgaagtagcaatcctatgttctgattctggtaattagagctctgggagactcctcgtaggtaatgtagtttgagctctgaaatcatttttttcctcatggcaaacaattaaaatttcaggaaaactatgtctggaaataaaacagcctctgatgtgttctgcatgcaagctgaagcttataaagtattaaccagtacacacagaactcagtctacttgggaaggaaataaatacttgaaaggatttttgatgaagaaaatatttctttgctagtctaaaatctttccaggaaagtccttaggagcttatgagatacacataagatggacagaagaagtcatattcattgctttcagataccagaacccttggatgtcagagtcagctaatatgtaaatggcacaggttcattttgtaccaggagagcatcgagggacctatgagatatattttaatgctatcttaacagtttctaaagactatcacacaagtctagttctataaatgatactaataataccattgggagtattttaaaaacgtttggaagcaatgatcttattcgtagggcagactcatgttaactgtttgctattaggacaattttgcaggttttctttatttgttattctcaaaaactgcatcatttggtttctaacatactgaaatggagaaggaagtgtattagagtatagttagatggaccgaaaactggctcagtctttttaagaaaacatgaacatctactgtgttttagggagtggatgagaatttagcattaaacaaaatgtgacctagttggagagacgtatttatgaagataaaatcttctcatataaagattttatataagcactttagaagtatttcatcttcataaatactttgatagaactttttttttattatactttaagttctagggtacatgtgcacaatgtgcaggtttgttacgtatgtatacatgtgccatgttggtgtgctgcacccatcaactcatcatttacattaggtctatctcctaatgctatccctcccccctccccccaccccacgacaggctccagtgtgtgatgttccccaccctgtgtccaagtgttctcattgttcagttcccacctatgagtgagaacatgcagtatttggttttctgtccttgcgatagtttgctcagagtgatggtttccagctgcatccatgtccct

SEQ ID NO: 126968 - DNA, 1034 bp, Homo sapiens
atgcagaaattactgaggaaaatcagaatgatgtaagcttatctagaaatgactagattatgttttctgatacttggtgctacagaagcatgagagagaggaggtaagttctattgcagaaaacagtatgaccaggcacagtggctcatgcctataatctcagtactttagaaggttgaggcacaatgattactcaaggccaggagttttagatcagcctggtcaacacagtgataccccatctctatcaaaaaaaaaaaaaaaaaaaaagttagttgtgcatggtggcatgtacctgcattacccagctacttgggaggctaagccaggggattgcttgaacccaggagttcagggctgcagtgggctataattgtgtctttgtcatctttgtactatgtttataaggttttcttaaaaaatacttctcccatatcctgtcaagcattaccattcctgtaggttttataatgcttctgatgtttgtgtccatgattccaaacatctggctaattgactgcatttataccttttacacatatgtcttggttttatgtatatatttgttgtgttaatgggaagcatactgatataaaatgcaactggaaaaagtagtacagaaaaaggaaatattctctgtcaagtgccattctgttgaaactgatgtttaagtagatgaacatctttttcactgagaagttgtaaccaaatcagattcagctgcatgttaatatatcaaacaggaaaaattaaagtactgtgtagcagctgtcttgaaatatgcaggttgaaaaaatttaaagtgatatgcattggatatatgatacaacatttatgaaattgagatggacaatatgtctgcactttcttatttcaaatacattgcttgaagtttaacagaatgatcatgtaattagataacaaagtacagtgagtgggtgccttttgtttttggaatcacattatagccacttatttaacaatttttatctgtagcactcatttgaaatttacatatgtcagaaaggaatagg

SEQ ID NO: 126969 - DNA, 1441 bp, Homo sapiens
ttttgttttcatgaaagtagagtttggacattcagatctacgttgcagaaaaatcaaatttttgtatcactgaccttgccagtaaaaacagcagaggcaacagcagccagcctctgtctcaccgtgttaaccttgccttccaaagtaatgccagtgtatcggcttggcaagagctaggtgatgtgccaacatctaactgtcaggaagtctaggaaataaactttagctttctagcttagcttttgttctagctatctaacttagcgtgcatgaaagaacacaactgaaatggagttgagtacactaatctgcacacctaggaaaaagatctaaaatgaaatataatagtatgtcgacaatgattatctctggctaaatcacagcaccttctccttcctttactatcttgatttctgtcccttgttaattttcatcagtctaaaagagactttctcccatttccagttgtctcccttggttgctataacagcataagatcaacaatgagaacggtcatattggtgatttctggcagccatgggaagactttacttttagtgcaaaaactatagaaatttcacccatgcataattcttttgggggtggggttgtctggtgaattggttaagggagcctttcagtgcaactatatgtgtgttgaaatatgtcaatcttgattattcttgctttgctgcctggtgtggatactttggggtttctgacttctaattgagcttaggcattatggtaaccaaagattattgtgttagggaagaagccaagataatcacaagataatgtgattttttttccttaggtaggtcagaatcagtcacttttgtcttgttatgcattgctgcttactgaagattctatataatacatgatggcaaaagatgctttcattaacgtttcggggttgcctaagtaacaagtggaataaatgatttatcctcagttcctggttatatcctggtcattgaggagctgagaatagagggtagtaagataatgcatctgaggctgtggggtaggtgaggaaacgtgaaagagtagtccagaaaggaagggaaatctaaacatactagatgtcagcaaatcaaatagttcattctagagtgtgaggcacccagagggtatagcaaaaacaagccaaatgattatgtactctgaatctaaaaagtgaatggttgacagcccagtacaaagattgggtttctactctgagatagggtatcaaaagagtccagaatgccctagggtgaaaaccttggcttgctgtggcttgcagaaatcagagtatgggagtgtgatgggtgtggtgtaggaggcattatagcagtaattccaaagctggctagtgcccttgggttactttcagtttccatgctcatgggaagattggcatgccccacatggttaaaagtaccagatagaaatg

SEQ ID NO: 126970 - DNA, 1057 bp, Homo sapiens
tatgttggagtttattaattgcttgctttaagaatactcagttatgctgcaactgctactatagaaagtataactctgaatagtgagttagctaaaatatactcccagataattgaattagtaagtgtatataattatatataaattactctctataatcctgcacaattaaatcttcaagaatgcttgcaaaatgcaacaattttagttttgatatgcataacgttgagtttgttgtaatggtagcagtgagaataatagggaacagatgcccacacagttaataagttatgaaactggtatttaaacccatgtgttcaatgccatgttatttctactacagcaataggaaggctgcctagcattttgtacatatagaaaattggctatatttaaatatagtttattgtttactattaataaaaggaatcctggcattgttacaggatttcactagtttatttatggttcattaaactcttaaaaatttaggaccctaaagagcttctgttctgtgggttagtttcatcaatatttagcatattggaaattaagattgagaaaatttaaaatatatattcatcatttaaaaataaaaatatttattatgtatcaacataaatacgacagttttatgaaaaataactatatatttcaaaacaaaaatatttagtgagaagagggcactattttacttttgctttgttctttgtttttttgaaacaaggtatcgctctgtcgcccaggctatagtgcagcagcataatcatagctcactgcagccttgacttcctgggctcaagtgattctcctgcctcagcatcccaagtatctgggactatagatatgtgccaccatgcttgactaatttttttattttttgtagagatgaggtcttgctatgttgcccaggctggtctcaaactcctgggttcaagcaatccttctacctcagcttccaaaagtgctgggattacaggcaagagccactgtgccccaggcctgttttagattttcataaatctcttcaatatctggccgaatacaaacaggtgga

SEQ ID NO: 126971 - DNA, 1038 bp, Homo sapiens
cttttatattttattttacagatttgtcgttgttgttactcttgttgccagtaaaggaaacagattgacttaaaagcaaaaaaggagtttgttagacatatctggtatctgggatgggaaaagctcacaggattgaagggagactaaagagttatgcttgaaacagataagaattaggcagatctggaaggtcttggtagcaagaactttcaggaacaacagcaacaaaaatgttaggctgtgttgctggcgtaaataaactctaaccacgtctttggtatgtgcattgattctgcttaatacactaagtcttgagagaatgtgtctgactgactgaacttgggttatatgttcacttccctataccattggactgagcagagagttttctggaagtagcctttaaaagacatctttggtttccataatggagaacatgtatttggatttatgcttccaccaggactgcatagtagagaaaattcccccaaaagaagtaggggtgatgtcaggaaaagggctggatgctgggctgccgtaaaatgacatatccacttaatacacctgataattctattgtgctggaaaactcttttttcctatatccaatataaccagcattttccatataagcatattcaatatttataaaatgtggattatctagtgtgtatagattgagaatattttaaaagtttttctatccttttgtctctggtggcatcttaattacttaataataccttttcctttttttaatgagtggtcaaaaggaaaaacgaagaggagaattcaaatctaagatagtctttattttatgtacagcgtttgttgctcagtgaatggaaataatagctatcatctattgcttatccactggttttaaagtactatatgggcattttacctctgttttcaatgtaagaactatttgagatcagaatctcaggttcaagtgcagtggagcatgttgtttacaagtatgaggtctagaatgagagtctctgggttcaaatttggactcacactagctgtgtg

SEQ ID NO: 126972 - DNA, 4889 bp, Homo sapiens
gcagtgagctgagttggcaccactgcactccatcctgggtgaaagagcaagactccatcttgaaaaaaaaaagtcgcttttaccaaactcaggaaatctgttcacaggtttgctaaggtacagttgcttagccaggattacatgttgttttctacctacatgagaactgtgtttgttgaaaatgcacatttccaggcttcactcagatattatgaacgagccagttgagtaccagaccttgacatcataatttaagcaagtggattggattaaaaaccacttttttttttggtggcagatattttactgtctcataagactactattattattactttagatggcttttcatctgtttcctggtagtttttgtcttttgacctgcctctactctttgtagcaacactcaacaagcctgttccttttaatgtttggcaaatacggcatcagtgtgtgagtacttttagtctatagtttacatcctgagagttctgctgagttaataatcagtgaagactctctttctgagcacctcctaaatagtgggagacaacactaaagtataagaccccccgctatgaaggagctaaaactgtggtaggaactgtaaatatttaccaaaaatattcaagtcttcttgatacatcgtgatatcatatttgatgcttaaatttcacattttcttgtctctgaaaacaaaagtctagacttagtgacaatagttttttccctgatttaatgtaactttccctcagcaatgtgatagctgtagctaacattgaatgcagcatccagtgtcttcacacaggcttagataacctcaacactttgttttctcacttgggttgccaagctaggagagaatactattaaagggtcagacttatgtggtcaggccctattagcttttgatttaaggccaaagccattttacttgtttgactctcagggtctgactgtcttttgggtttaactttgtaagagctatatggctttttcccctttatactgtgaaaaatgcaaggagccttatgatatgttgttcatcagagtacttgttagacataaggacaataataatgtgggagaaagaatggactttgaaaagctcactttgtggaattgttgagtcttgtcattttctttttcctaattttggtttttttcctcttgagaactagcttctcatcactaagttctattaggtttttcttagttgttcttctaggatgccagtctttccattcattaactttaagttaccagcctagtctaggactttactagctacagaatgatcagtactaggaaagataaaaggctcagtggtgattttattacatgaatattgacttgatttatgcaaatgcattgtcagcaggttaccaatttacattattcagtatgcatttatagacacctgacaatatcaagctttagcatgtgagcaatttttggagacctgctttgtgcttggatagttcagagcagctcccattatataatctgaagtgaccatgatgaaggcttggcttttttcaggaactgaatgaggtctttgctgcagagtaaaatgggaagggtcagagcaaacctaccattagaaattgatgtttggctttttttttcctccacgattaaaaaagtaggggaaaaaaacccacctcaacttcgatttgattcaaaatagtatttcctaaaacataagccattcttgtcaaatatgagttccttaacttaaaaatgcattcatttaaatccctgatgtattttctcgtgttcttcattcatgcttggggacagagtgagtgggatttatgagttactgtactcagcacaggagaaataaatttggtataaaatatgtagagtataatcttactatttttgtataatattagaatttatcctaatcttaccaacccatccttgaaggcattttccttcagttcataatcctcactaaccaatttttctccaatgggaacttataaacattagcaaagcttataactgaagttgtcaagaaaacagacaaattgaaatgtctgccccagagcagctttacaagcagcagctcctggatcatgaaaggaccaagaaagaggatcctaactgcatggcctcttttccacttcaccttacttagtagcagtgaaaagcaggtttctctcttttattcagtgttttttctcaatttcaatgtatttactgtgtgacatttgctgagtatatttgcaaacatctcatccagttttcaaaacaattctgcccagtagatgataccaacctttattcctcagatgccacactgtcttccagtatgttaacctttttgatcatctcgaattctttttccttttcatagaaaacttatttttttctttccttttatatattttcagttaaatttaagaaatactcatttaacaactaccctgtgggaggcatgtgatctctttctctctacagttttttttttttcaccacttaatgctactttaaagtgttttggggaaagtttcttaatcctcaataatgaaaacattggaagatattgtaggggcaagtctcttaatcctccgtaattaaaactttggataattttataggttccttcctccagtgggtaacagaacagattacatcaatgttttatgttcacttttaccctaattgttcatcttcaatgtgtagactttatgggtatttgcaagaacatgatcaatgatctacagcacttgaaatagaaaaatgaaactgatgaggaattatgactgctcatattattctgtccctgttttgttttgctagtgcaaaactagtgtttcttatcatccttgctcatacattatgttcatggccttttgggtagactaggagggaaagagatagattaaataccctttcttatctgccatcctgtaccatgctcatcatttcctttattttatgaaacagaatttgcttatgttaaaaaaaaaagaacagaactcatcagaagaagtgacaaagtcaagtgatcatttgaatgtttacaggcagtcagctccatctctcttctctgccttccttggtatctgcttccttgtaaggtggctcattttgtggttgtgtgatagtagccagtgggatctggtgggtggcaggtggagggtgaaggaatatttatcatgtgcccactgacagaaggaaggagaacaagagatacgtattcttttctttcatgtggctccagtattttatagaagtattcagcttaaaggaagtattattccaaagttttctttgttgtgttttgtatttttttcaaattttttattttaatttttgtggatatatagtaagtgtatatatttatgggatacatgagatgttttgatacgggtatgcaatgtataataatcacatcatataaaatggggtatccatttcctcaagcatttgtcctttgtattttatattttgtttggtcattgcttgcaatttttatgcatgatgttggcacagaacctcagactggcagttgtgtaatcctggctgtttctccttgacaaaattggaatactgaaactttggaaaatgtttgtcaaggtgattgttctcttacccaaaattgtggccatttgtcaatatattctgagtttcacagtttgaagaataccagttatgaaacttaagactcactactttgaagtgcgtgtttgatgctgaccagctcagctttaaaaacagtgttttcacaatattttatttgtatgtttgttttgttttgcttcaaagaatagttgcctaagctgagcctatttaaattacataaacatatgactacacccacctcttcacaccttttagaattttaaatttttagtatatgctatatatatttgccagtgtttactttacttttgtgcctttaatgcaatgccttaacattgtgggagtgacttttaagttcagtctctgtacatacagtctctatggtgatactgtatcgttacatggtgaacagtccacagaaagtacttgcatgtctttcttagaaactttctggtactcctatgctatagtcctcttttgatggatgccttaggcatatgctaacaagattttgttttttaaaaatcttgtgaccccattatccaaaggcagtcaaaagcacacagccattaagggggctgaacaagaggactttatagtccatactggaaagtcaccacaaccccagtaagatcttcttttctaagaaagggatgcaattaatagaaagatgcaaaagtatgcagacattttgagagaaggcaggctgcagaatctaggatactgtagcagccatgaagaagacatcaccacgagagaatgggaaaagtcgtacagagaaattagtagattagtgaagaagagtccaagcatggaagattgtaagacttgccacgactctcctcaagttgctatgtattttgagggcagctatattctgttcttccttacctcatcatgtatcctttctgtagcccctccatcacctggcatactctgactgtgtttctgctttggagatgcctaagaatggatgtcttgcacttgactattgaataataaatcagttttcaaacagtgatgatatataactcaaataaaaatcttatataataaaatagcctaaaatgaggctgaaaaacaccaggtatggaagtggaatgtctgaaaaagaagtgagataataggtttttgtgttaatattttctcaccatgtgcagattttatttatctttaaataaaacttacctggttgtatcatagttcttaagaaactatggaataatttaaatgagaaaaaaaatatggctatatactaaactggtttaggggaatctcgttaacatgct

SEQ ID NO: 126973 - DNA, 2750 bp, Homo sapiens
caaactcaactgtgactatttattgtgaaaatattcaatagctggacaagctaaattggtccaggaaaacctaattgggtatttccatcttgcatacctctgctgcttataattaaggaaccctagggaatagctgttagtaaaaatattgttacatatctgctgctttttcaatagctgcatgttaattcaagaagttaaatttcaagggactaaaattttaaagaaaaaaaatctgaaccctagcactagtcctttcatgtccatttaggtgaatagttttgcttctattgcattctgagtgttgttatcagtctgtgtgtggaggatcacacgattagcttgctcatattttgacaaacgatcattatctggctgaagcatgttgtaggagtcaatgaatatataatctatttcagattccttaaagatattaaatatctaactttgaatatagagggtatttcttaataaatgtttaaaaactctcatggcggggccttcatatgacaactaataaatataccattggatggtgttaacaaaaagacgtaatactgtgaagtgccttcaaattttttagatattataataaaatattattttttcctgacaaataaattagcagtgatttaatcattttaagttaattaatgttgcagaatatgcacagaagagttttcgatggagctattttactattttctagtaacttacttttgatttttatttagatagttcataatactgaattggctatggagaacagttgccacttgcaatgtatacatggattttatttttacctaaacttacgtggatgtatgaaatctgttattaatgttagaaaataaagttgttcatgaatgttatttcgtctaaaaattgcagactcgaactgacttgctagttttcttaatcttaaaatgagttcttatttacttgatgagcaaatagtaggcagttacatgttagacaattttgttatttagagtttgataatatgtggcattttatacttctggaattttcggatcttgaaacttaagccttcagatatgtatcattattaataatatattattatttgagaaaatggtgtttctatttgactttcagcctggttcctttccactatattcacttgataagggaattatgattattctttggctcagtgaaatatcaatagtgcttttctgaggtgcagcaatctaatgtgagattgttttaaggtgccatattatgaaatttcatttcaccatgtaaacatcttgacatattttgcagtttttaaaatggcttttgatgaaatgtctgtaacaactattatcttgcataatacatatataatttatgtactctcattgggtacgttccttgactggaatataaattttcatttacatatcagtttaagtttgaattatgttgtaggagagaggaagtgatactgtacatgatgtttcttatctttaataggactttttttttttttttttttaccataagggttacttgaagttttcaatgatattttattggcaattctggtcttctcttacagtgtacaaatgtcacgtattgtgttcttcagttgataaacagattgtattctactactggattagcctttcagtaaatgtgtttcaaaatggtctcattagccttttaataaatattataattaaatatgcataaatatgggaaggtctactgtgtaacaacatggttattatatgtttcaaattatcttgtattcttatggaattgtatacctgtttctcatgcagaataactacacccttaagagagtatactaacctgtttttatgtttgtaaagactgcaagtcagctaggtggcttgaattaatctgaattcaccttcatgatagagctgaagaaattgatactgcaacttatcatgtaacaagaagatctcaagtttaataagtctttgagctgattcagacaatggatttgttgctaacagcttttttgttaatactgatgtgagaatgcaattggatattataaacactcttcagttcaactgtttagtcattaaaataattttgatataacagatattgattaagaaagggattttagagatagaaagacttgacttcagttctctgatttgccagttacaactacagcggtgcccttgggtgattataacaatacctgcttcatagaattgctttgaaaaataatttagataataagatttagtaagtactaataaatgtgaagtattattataaaagtcatgaacatttttgtcttaaatatatttaaatttgctggaagttttatcaatttttatatttgtgacaattataaaatgttgactaactggattataagtatgctaagctataaactttttgggtggtcctttgagtgccaatacaatccacatatcagaaaacattatacagttgacatttaataaaattgaattgaattttcatggcttcaactggtataagatgattatcatgcaattttgcttacatcctgacatataattgttttataatttttctatattacctgccaaactacattgtaaacaaaaattgattagagattatatttcagttttttttatattatctaaagttgtgttaaaaaacacgatcttcagctaccaagtctattccataaatatttcttggattttaacatgattttttttaatggattctccgtattccccttgattttaaaagaaaaatga

SEQ ID NO: 126974 - DNA, 2688 bp, Homo sapiens
gctgtgtggactctaaaagtgatttggctgagcaggtagcatttggtatgggttatatcataaaacaaatttctattaaaaatggggttatttagtattttagttttttttttttttttttttttttaaagacagagtcttgctctgtctccaggctggagtgcagtggtgtgatgttggctcactgcaacctctgcctcctggtttcaggtgattcccctgcctcaacctcctgagtagttggaactgcaggcacgcgccaccatgcctggctaattttttgtattttagtagagatgaggtttcatcatgttggccagggtgatcttgatctcctgacctcgttgtctgcccaccttggcctcccaaagtgttggaattataggtgtgagccactgcgcctggccgtattttagtttttgtaaaaaaaattattattctagatgtgaatgacagaactttagtgcttagcttaagattctgttatgcaaggcaataacactggcatacatgctagccatttttgatgttaaagatagtttatgaataagaaaccatctatattgttaaggcaggtttttctttggtttcttttggatttattttttggcagcttgataagcaatagctaaaacgagttcttgttgaaccttgtttattggtttgcaataatgagaacagttattgagtccaataattttgtgcttttattttcaagtaacaaagtgttcttattttgtgatgataccacagaaagctggtttaaaagctagttttaaaggatctgtagcttgagaggttgtaatttagaatggagacatggtggtcagaggaaatgagccaaagttaaaagccttttctgtgccattgcatctgtaaccatcctcaaagtactctgcactttatgtcacaaaaaagcctcaaatcctgtgggtaaatgttatctgcaggaacctcatcatttttgaaaacagtacttttatccttagagtgtttgaacaagaaatacaaataatagtattttcttttctttttacaggacaacagatagatagaagtattcttctgctatttttgaataagtgctatgtgatataagaagcaaaatcaaatttaaaattaatggatggtgagatagaaacttatggtattatcttgtttaaatctcttttgcctcttttgtgaaacagtcattctcttctttttgtggggttattttatgcctaattttcttttacaaggtagaatataattgcttgtcagctaatagtttatggcacagatatttttgccaaacacattaaaggtagatcttggttatacataaccttcaaggaacacagggagcacacatgatatggacagagaagttgatgggcagtgattatgatcgcacagggaaggggagtgaaggcttgtgttattctttttctttaaatgtatttacagtttatcatgagtcttttatgagttttcatgtccttgtctgctgtaactttacttgcttcttatccattccctctctctgtctgcctttgtctctcacatacattcattcacacacacccaaatacacataccttcacacttgaatttgagtagctggcatgcttagaaatattctcaaatgggggttacatagggccaatgtatataaattgatgtacctttatgtatatatgtatttgtatagtcacacactctattttcaaatagaaaaccagtcatacaaagtatttgccttatcttaaacattcagtttatgtttgttaagtgaatgaatgtatgagtctaaaaagagcaatgatattaaggattggggaaaactgggcataggaaggattactcatggggaagttatttattcagcaaagattgacttgtctagattattatatcaggttatttatcaatcatgtggagcaggctgggagtggtggtttatgcctattatcccactgctttgggaggctgtggtgggaggtttgtctgaggccaggagttcaagaccagcctggacaacagagcgagaccctgtttcttaaaaaaaaaaaattagctgggagtggtggcatgtggttgtagtcctagctactcgggaggcttaagcccaggagttggaggctgcacagtccagcctgggtgacagagtaagaccctgcctctattaaaaaaaaaaattcatgtggagcaattggtaggttgagtttattccttcaccccgccttactgaaccaaatcttatttctgattagtagagggtaagtggataattaattgagatgtacacatatttcattggaaaagataaattatgccttagatgaagacagtgacctgggtatgggatcagatatttgtaatttttttccttttccatcagcttttcttatggcagctcattttctgtcttatgacagccaagtaaccagtagagtaaaatgacgtttatatggtagaaaccacaatgaaccactcaggacatctgcctttaaaaacagcaataaaaagatcaaacattctctagttacaactttaacattttaccatttggagtgatactgctagtcctgtcaatgaaaaggaccacttggcatctttttggagtatccgaatgtgtggttgtggactcacttcggcctagggtagcgctatgggtcttgtacaggattttctgaaccacttttc

SEQ ID NO: 126975 - DNA, 1098 bp, Homo sapiens
ggtaaggtgttttatgttagttgaatatattttagtagtgaagtaaggagtgatattacaggttgattattgaggtctcttgaatttatcctataattagaattttattcttcatagttacgtgttaatgtgtctgcatttgtgcttttttgttttaaaatgtgatactaaaaatacacagaaattgaaatttagccccactgcagttccataatttcttcttgctttgttctgttgctaagtcggaaattcacatttgctagattattacctattgccatggaaatcgtttgttgtatttctatttcactacaggaacaagcagcaggagctaatggaccataagagggaaatttgttgtttaaacaatgattatcttttatatttggctaacatgaaaaggggaaagtacactttttctgtcacaccgcatgagaaggtaaatggatgagatttagagacagaatttacctgaaaaaaatttatacctgtcttttgaggaaataaagttacctactcacaagacaaaattataaaatgtgcctatatcaagctatgttttgtcaagtcacaaaagaggtcctgtggcaggttgggttccctagaagcagacattgagatggagtttggggtgtgagatgtattttagggatcatccctggggaaaggaagaagaaagatacaggattgagcaggggaggaagccaaactgtgaggcaggcctgacagaaccctagacaagccagtggggccctcagacagtgtggccttcagagttgtctcaagttacccctgccctgtctgaggatgtcgaataccccaagggagggcggttctctgcagctgtggcgatgttgaagtctactgacctggcggctgtctactgactgcactgcccatatatgggccatgagtgagtgcttctttgaagggggatctgggtgatgcatactgttgtctacataggtcttattttgtgactatcagggaaattttgcaattttatccttatatttataattccccaatgtacatcatctttctaagccaagtattctgtgagaattaacattttacagattttagacacgttcaaga

SEQ ID NO: 126976 - DNA, 1023 bp, Homo sapiens
gacaaaaagcaaaaagcaacaaaataaacctttcctcaccagaatatatttgggaagagattatcagtataatccttttttttttcttttttggcatgactgcaaaatcatgtcacttctgttgatcattatggaaacaagaaaagttgtaaaattataaaataatactaatactcttgaggcattttgttttagagtaggatgcagtcattgatctaatgtcatacgcatttccaaagataagtctatggggtaagcaagagattgagagctcctttttaacctcacacctaagcatttcacatcaccgatatcttctgaataagccatgcagtatatctacacacaaatttaacatggggaaggtacagtaaaatgcactgttgttcagactacagatatagatggctgatccatagaaaagccttaaggagcacaaggtgagaacattttaaatggacagtggggtaggctggagaaggtcaaggaagtctggaagggtcagactggtggggataggggaatattaccaagcaagagatgtagcagcagggtgtgtaaaattggtttctggggatacaggtcatgtcatcatagaattttgagattgaaaaatcttaagagatctttgtgctaagaaattactgatttctgaattgttcaccacagtctaaaatgttaagtgacttattcactgttgcaatcgttagtcactggcaggcctgaaaggaattaaaagtcttgtagtcttgtactcattcatttatttaacaaatatttacagactgcttactatgagctaggtgatagtgataaaatatctgagacatagttcttctgaaattcttttggtttagttgggggactgactagtaagtcagaaatataaggtgataagggctgtgatcagatacgttgagaggtcttggaaaacacacaggagaggtatcacattcagatggagagtgggactaaggactcagaaaagacttctggggcaaatctttttcaatagctagagga

SEQ ID NO: 126977 - DNA, 2342 bp, Homo sapiens
gctggaaatgcctcaggaaacttacaatcatggtggaaggcaaagtggatgtcttatgtggtggcaggagagagagagagagagtgaggggggaggacctattaaacaattttaaaccatgagatctcgtgagtactcactatcacgagaatagcatggggaaaccgccctgtgatacagtcacctcccaccaggtcccttcctcaacatgtggggattacaatttgagatgagatttgggtggggacacagagccaaaccatatcacggtcgtggtagcttgcacctgtagtcccagctgcctgggaggctgaggtgggaggatcacctgagcctggcggggtggggggggggggtcaaggctgcagtgagccgagattgcaccacagcactccagactgggtgacagagtgaaaccctgtctcagagaaagaaaagaaagaatagatgtaaatagacataaatatatataatgtgttcgtggactatgaaggcaatgtgtctggaacagaaaatttccattgtgaaggtattaggaaatagttttaatatacagatatgcagattcttgaatgccaccttgaggatttttaatttgattttatagtaaattgaagctttttttgttttgttttgagacagaatctcactctgtcacccaggctggattgcagtggtgcgatcttggctcactgtaacctctgcctcctggtaattcaagtaattctcctgccttagcctctcgagtagctgggacttctggtgcatgctactgcgcctggctaattttcgtatttttattagagacggggtttcactgtgttgcctgggctggtcttgaactcttgacttcaggtgatctgcctgcctcagcctcccaaagtgctgggattgcatgcgtgagccaccgtgcccatctgtaaatgaaagcttttaaggtttttgagcaagtaaagtgataaaagcagcatcttaattctggaaaaggatgattccatttcattatatgaggtaatctatagagatgaataaggaaacttgatattgctgggaatacaagttgggcgtttcatagaaagttagtttcagaacagaaggcttttgcttggttttaatttgaatatataggacatgtacattgtgaatgaatggaggattgctttttcctaacttaatattattattattattattattattattattattattattattattatttttgagatggggtcttgctatgtggtccagcctggagtgcagtggcaattcacaagcacagtcgtagctcactacagccttgaactcctgggctcaagcagtcctcttgcctcaacctcctgagtagatgggactagagatgcatgccaccctacctggcttctattatttttttaaaaccttgaatttataacatgataaacagtctctcagagaatatttttatggattgtattcaccagtcttgcatttaccactgtgtttggaatgttggcagtgctaaataaataatggtttaataatgagcctatagtcttcctaattctattccttaatagcctctcaagttattccttccatctgatgttgaacgtagctatgcagtccgtggtttaccagttgaattgctcagtatgaccatgacttgcttaacatttttctcaatcagacttcgtgaatatttaaagaacctcttgaacagaagtagtagtctactaccagtcagagcccataattccagagtgctacaggatgtgtaatctgtagtgtttctttggaaaggacatgactggttaatttttctcttattcaaagaagtacattgaaatttggaaaggtattagaactgcagttttaatcctacttatctatatattattttaatgctaaaattcttttgctactacaggatttgtttttctttaaagaaccatattctgccttgtgttattgttagttaagcacaggtctgtcttaatcagaatacactccttggaggcagaaaattgactttaattgcctttgctcccccataacacttagaataggttggcaatcagaaaatgtttgagttaaaatactgtctttagtatttacaggtaagtattcactagcaaattggaattgtattttatttacagattaaccttaactcatgttataacttattggattgcattttagatcaagaggctgagtttttggggtatttcaacaagataaacaatctcaccacatgctctcaaattcttaaaaatagaagcaaatctgttctgtccaaagtaaacttactcccaacatttatggaaatattaaaaacaactaaactagagcaagga

SEQ ID NO: 126978 - DNA, 1285 bp, Homo sapiens
tgttcgtggtgcctgtatacttgggagcagtaaaagcagagaaagagagttcagagataacagataaatcctttaaatttgagtatttccatttcttgagacctttgaaatttttataaaagtacaccattgcacattgtctagtaagtaactaaaaatgagctgtgtaagcacatgtgaaactcactaaaccatagtcggtaaaaggagttacagacttgtaatgtcttagctcagaaagataactgattgtatgttaccagaagtcttggttaaatttgtactgtatttaatttgtagaactgtagttctagcaatctacacctggtgtaatttttatttttctgacgttgctataagtaacagatgcaaggtgaagtaggaattaaggaactactttagacacattttttgggttgcattttggagttcagacaccagaagtgattctgaaatttttgtattgcctactgacagacattatgtaccaagaactcacattactgtaggtcactgaattaatttaagaaataccaattgacatcattcctttagggaattgtgggctactgcttgatattattgtctttgacaaatgtgaaaatttagaataaactttatttttagggtgttgggaccttaagaatgaagtgattcctttccaaatttaaattttttcaaatggataaaaagtatagtttatagactttctttctacctgttttcactgaaatagttaagtggttgagttttccgtgaactgttgtatgtagttacttatttctaaatggaaaaagagttccagaaagcatttaaaagtcttgagagttgtgctcagaggtcgcttgtgatttgtgggaagaaggtagtcaaaattggtattccttatgtgtctattacatttgaatgcatgtatattctgttatgtataatgtgttctagatgaaatccttaggaagtaaaattttttcattgtaattacagtgacagctgggaaaaccctttttgcttgaagactctcagtaatgcccctgaacactcctaatatttcagcttcttgtggtgaccatttttaattgtagcacactcaacctgaattctttgtatgctagttatctactcagatgaatttacatcctttttactccaaaatatataaaaaatggattgactagcatgaatttctgtggccatttgttttctagccaagtagataaagtactgtgagctagggctgtgttaaatgtgatgcatatgccaggccttcataaaggataaaactccc

SEQ ID NO: 126979 - DNA, 2274 bp, Homo sapiens
gttatttcttacccctacctccaggcaaccagtaatctattttgtatttctattgattttccccttctggatatttcatttaaaaagaatcacacaataaatggtcttttgtgttggcttctttccctgagtgtaatgtttctgaggttcatccatgttacagtatgtatctgtattttgttcttttttttgctgaatattattttttgtttagatgcacctcattttgttaatccacacaccatttgctagacttttatgttgtgttgcttttaggtattatgaataataccatgaatatgcttttataattctttccgtagatatatgttttcatgtctcttaggcagatttctaggtatggtattgctgagttgtgtgatatatttatgtttaacttttgaagagactgccaaacctgttttccggagctgctgtgtgtaccatgttacattcccatgagcagtgtatgagggttctattttccccacaacctcaccaacatttgttattttttatcttttttgattttagctatcctagtgtgtgtaaagtagtatcttattttggatttaatttgcatttccctaaaacacatatttatgtgtcttactcaaggttacaccccaactctggggatactgggaatttcattatgtatatgtcggctcaaagaccctgtctcttttcctcatgtgggataattttcaaaaactatacccactgcagaggttcctgtggcttaaacctctgttagaaccacactgcaattcagcttctttctctgcctgtcctgcttccttcactccctttcagatgttgttcctaagggcactccccaaaatgcatgcaaatcccagaatcttagagcctgttttctagggaatccacctattaacagggatatagaattgataggagtcactaatttagagagagtgattaaggaagacctctaacttgaggtaatctttgatcagagacctgaataaaatgaggaattaaaccacctagataagttgggggaaacttttccagacagaagagcaaatgcaaagatctaaggcaggaccatgcttgacagtaaaagaccatgtggggagtgaccagagtcagtaagagggaggaaaggtagaatataacaagaggccacaccttgcatggcttttgaagtgttttcagtaatggaattccatgatcactctagatgctctgtaaaaattgagtgtaagggaccaagaacagaaatagggacccagtaaggaggctactacaatagtccaggtgaaaatggttgtgacttgagttagggtggtagcattggagtggctgagaagtggccagattctggatatattttaaagatgtacttttttgatggctgggatatggagtatgagagaaatagaggaatcaaggaggattctgaagtttttggcctaagcaattggatgaatggaaattgtgtattgagatacaagaggcaaaggagtggcaggggtggtagaaagcaaattttaccttttagacatgttaaatttgtatgcctataagacatccaaatataatgtagagaagttgtcattcatatctgagtcaggactgaagatagaatttgggtaattttcaggatatacattatatttaaagctatgcaccttagtgagatcacctagacagagattggcaatttttcttctgtaaaggatcagaagcactatctagtccttgttgcagctattcaatttttaccttgtattgtgaaaggagctgtagacaataattaagaaaatgggtgtggctgcgttccaataaaactttatttataaaaattaataggtggtaagctacatttggtctgcaggtagagtttactgacctgtgacctagacagtgaatagagaaagacaaaagtcctatacccctcctagggtagtccaacacttagaggttaggaataatgggagtcaggaaaatgagaaggagcagccagtgacctaggagggaaactcagagaatgtgattaggttatcatttatgtttctcctcacttcaactatgtttttaagtgcataaataattcatgtaaaaatccaaacagataatactctaatcttttataatcttacacatattgtttctctgatattatactttgatattctttagaatttatgtgtattacaatataaaatgttcataactttttagagatttgagtgtgaagttctaataataatttttagtgcatttttttcaaatatgctattttta

SEQ ID NO: 126980 - DNA, 1495 bp, Homo sapiens
ttatccatggggacttttaatatgcttggttatacagatctgcaaatttttagctgtgggctgataaccatattgaatcataaatttattactgatgcattgctttctaggtggacgttaaattttaagagaattaagggtaggaattggctttctattatgaaatggtttcttcaactttaaatggatgtcttaaatgtaaatattactagtttgtgtaatcaatacacaaaaacattatttggaacaaaaattaattacaaagtttcttaagaataatagaggaaatgcaaaatatttctaaataaaaacaatttaactgacagaagcttgtcagcacttagcaacatttattttcaattacaaatggtactttttatcaccatttttattctagctttgtatcaatatatcatctagacagaaagtgctgatgtaggtttttcagtgctagtctgcaaaggaattgaaggtgaatgtggttttagttacatatcttccttcctctacatctgtgctttgtgttttattagactgcttaaaatacattgttgtcaaatatctaaatgtcaggcttgctgatcatttatatgccttcatatttaaaaaaaatattaactacatacaatgtggttatcagctgtcttttctaggggtatctgtaaatttgagagtgttttattggtagatacatgagaagttagtatctccaagtatttcattcatattggcttactgccatgtgaaatttattactgaactttcatatgaaaaagataaaacacactgtcatctcatcttgtcccattgtacatttcagttacaggaacaaaatgatatgcttgcagttctgtgatatgatgcactagaaaaatctttattatagagattgtgtgacttagagtttgtgtgtgtgtttatgcgtgactgttgcagaataaagttgtatttatgtgtacccatagtgatatttctgtgtctgtatgaacatagtgattcagtagattagatcatgagcattctttatatttgtctacagtaattaagtctctcactgaatatgcaccaagtactggccaagctgtcttataataaatattatacttattacttgtttcaatggctatacagataatcagaagtgttgcaagttggtcacttattggaaaatcttaaatacgctacttacagggaacttaccatgtatgtacacatatggtattatcttctacttttttggtttgttttagataagtgctgttgcttagcatttaaggtagaatgttttatttttataagttaattaatatatatttagttctatgaccttgagcatgctatttaattttcccatgcctgagttatctcatctctgaaataggaataaaatagttcctgcttcgtaggattgtgttgaagattaaatgagttaatacaaatgaagcactcagaacaattcttgaacctaagcaaattttcagtgagtagtagttat

SEQ ID NO: 126981 - DNA, 1795 bp, Homo sapiens
taatttatttgatgtaatttcaggctgagaatatcttcgcaacacaatattgaaaaaatagtttattgaaggatggcttaatgaaatataaagagtatgaaataaactgtaaatcaaagaaaacttagggactatttgcataagtggcatttagctattgggcatttttatatttgtatgtgtacaaatataattttcatagtacaaaaaggtggttttacaaatgtttgttttaggagcaatctcttcaatataattagataacagaaatttttgtgtattttttattttcttaaattaattggtattgtcaggctagcatttgatttgatcaatatattgtttactcaaagaaaagccttagtggtttaaataaccatgactgtaaatgtattaagaacttcactggcagtagcactgcaaagctcaaaggcactcagtgtaacctaattactaggaatgacatttgtattagtgctagtgaggtgtgagctttttgtaccgaaggctgaaaagatatcagattaggtccagagtgagcagaagggacgtatttcaaatttacccttttaaatcctagaattcagtgacaatgatgtgactgggttattgatattgcagtacatctaggatgaagaaaggaatacatagagattactaattagtgaatatatattttaatcaagacataattttctagcatcagggtcagatcaaggttttattggggacctgaaaggaggcagaccatttggaggcagccctcctaaaaaaaatacaaaattacagatgcaaatttatatacaagtcaatatgtatttagaatgagaaaagaaatcacaactgattacaatttcgtaaaagatggtcagtgacattatcataataatatttggaaaaatagctgctgatcacacttttaaactaccttttccacatctataggatacataatgtttgagcccctctcagatgacaatgactttataatataattttttatagatttagaaagataaattggactttcctgtactatggttaggaagattttgtttttattattgataattgagctgtataaactgtgcagcttcactcacagacatagtatttatagaacagctgcagatttgggctttgcaaacgcagtgtctgaaaagttctatttcattgtgagtcccatcaaaaagaaaaaagaaatgtctgctacatttataattgtatatgcactatcaactctattcctaataagagaaaacttgactaggcattgattacaaatggaattatctgcttattctatttcatgtctccttattggaagaattttccacagagtagcttctggctgtataaatttcagtctctgcttctctcccatttgccacaaatctttagttctcgttgccatgggacacattcgtgacagaggttacacattgaggggtcttcatagacctctgactacgaaccttcatatcaggaccccatgtgagttagcacagttgggaaagggatgtattcctagaagccattcctatactggaacagatggtaaactaattacacatagaaatgaccaagaaccacttacatatatcccactaaaaacaatgtgctaccaattctgaatgtatcacccaaactgaatatatcaccctttgcatgatccccaggttgctcactgtgacgccctccacccgacaacaggagattggtggagaagaagaggaagtggagaaagatatttcattggcaaagtatcttacttttacaaattttactaaaatat

SEQ ID NO: 126982 - DNA, 5605 bp, Homo sapiens
aggggcctttttttgtgttgatgcctataggcatgcttacccccttccccaggccccacatgtgtgtacctatatcaacatgcatttccctacatgcagttcccagagattcatgaagctgctcttgaagctcatgggcaacacctagattaatatacaagtgttacttaatgaaagaagaaaaaaggattgcatgttcttttatttgatagaaagcaccatattcatccattcatatgtcctgagcacctattcatccaactacttatgtatctgtccatccacccacctcccatccacctagccatctagccttcattcgcgttttatctgatactttctatttgtcaaaactctgtgtattttatttttacacttttaaaattgaatactatactgctttgtaagtacttatggagctttgtaagtacttatggaaaatgaaagaatgattcacggcaactatggagatgttctagtagagagtatgtacatatttgtttgtggttgtataataatatagtttgaagcattaataggtttggaaaggtggtatagatagtcatttcagctttgcttatcttagactgattttatatttcagaaagtctttttgtgacctttttgtactgctctagttttaaaataaactgcattgtcagtaaagcagagttagatttctttcgtgaaagtaaaattgatagacacttgaacatttctttagaaagttactgtatcaaagaaaattttaaaaggtttttaaaagattttacccattttactgaaaaaagtttctcttcttttgaattgattcttaatttatttcacatatgaagcatcttgtaaaggttttatttagggcagtaaggaaccattttagtatttttaatcattcaatttttatatagaatttttttccagtccttattactttaaaaaattacaattgaaaccccctatttctcttgacatttttggtattcatttttctactgctttagtctttatcatctatatgtgaaacagaaaatatattttttagacaaagaagacagagtgacttatttggaaaataagattctaattactctatcattttctgtaagggtgaaatacaatataagggaacaataaagaaaatcactctcctagaatattgcaaattctaaaaaaaggaacataaagattcaaatgcactcaatctgctgacaggactgagccaatgaggtgtacagcatgagtgtgttgctacacagactacacttgtaccaggagcgtatcatgaaagatgaaaaattgaaagtgggtactaatagcactcagattttaaaatgaatatcattagtattccagcaaaattatattcatagctatatcttaagtccaatgtgtttcatgggaagaaaatgtcagtgatatgaacttacctaatagaactgagcctgaggctctgtatttgctcttaatgacattaaagatgtaactattttaaaattttttgatatgtggggctagatttataatttaatactgtcgtaaatattaagagtgcttaattttttggcataatggaaacatagcatggagattaatatctgatccatagtcaagatccttttccaaggttgttcccagattcacactgttctggcactctgaatagaaacagtcttctgtttaaggtttattgagttggatcacttaattgcatctcaaagttatagcttcgaattctcacttctttctatttcaatatggtaatgtagttttctgttaaatagtgacagtcattattatttgtactaacaaatgaaatcaggttttctatttattttttgttctagaagtctcttttctcttggatctctgaatgttcttcattttcttttataatgcactgtccagtcctaagaagtgccctaatattaatcctgcctttcttaactgattttttcagtcattagaacaaagcatttcatttggcttagggatcatttgatagtacctacagaaaataatttgaaacaaattacaaagtatcttgagtctgaacttctggcccaactcagtcgctgggaatttttttagaggattatttgaggtgaaggtccactgatatttctatcctcagccactaacagataaatgataaaagaattctaaggtcttcgctagcgaactccgtaaagagtaccagtcttgggtgatcagtgaagtaaggagtttggatctgaaagggagcaaatgaaaaattatcatgacattaaagtgatcagtaatgcaatgagactatgagttaggactttgtaactatactcataaaataagatgaattctggctcacctcagttcctggctcaaatttaaaagcatggttgtacaattgcctgaataggtatatgggtaaatattttttattgttaattactactatttattaaacaccaaacactgactttcattatttaaaaaaatctcatataaccttcacgttaagcatgtgagatagacagtgatatccacatcttgcagatcataaagaaataatattgcagtaaactcacatatgccagaattttggttaggttgcttagaaaggcaaactactcatcaaaggaaatgtgaccagccacatgccttaaaaaggacaacataacatatttaaagtctctaaatagattgtagacaatttacacagtactttgatatttgtcctttgtcagttttttgggggcagagttgctgtgtgaaagatttgcatttttatttgcatcctggtctagggaaacctttctaatccctgagtatgcactcttgggatttcaagactttagagaattgtttcccaaagtgagttccagggaaaacatgttattgcaaaaaacctctcagtggtaataccatcaaatgtgaacgaacatacctttaattattataaatgaaatacatgttgctgtgatttagtggtgaataagcaaaacctaaattatactggtgattgaaaagattgcagaatcttctaaaatcagtatgtaagatacaaaaaggagggattaatgtacatatatttattttaaattattttgacatatttgagaagcaactaccagaaatatataatttaccttttttagctgtaaaacaaagtttatgtattataaggttacctacatgatagtccataccctgggatgaactttctgctccctgtacccaatctggcaaaattttactcacccttcatggtcccgaaaatgccctccctgtcgtgtttttatagcagttaatgtatatcacgttgtattacaattcagttctctttttctgtagcatttagaagagacatctgcttcttagaggtctttgacatgtatttgtggaataaatgaaggagtagatgaataaattatatgtttgattaatttagcaagatttttatcgagtcttaattatttggaccagtttttctgactactaagaaatgatctaagaatgatccagcaggtgggtaactaagattatggttcaaaatgtttgggaacacttgctgattcctctttctttactgagtgaatttgaaaattaaaaggattttggagaaatgactttttaaatttgaaaatgtattttattatggaaattttcaaacatacagagaagtcaaaagacaattacagtgaacaccagtatactcaccactcatatcttatcacttttctgttatcttatctatctatattttaatccctctattcatccatcagtccatcttatttatttataatgcatttcaaagtaaactataggcacttccccctaaatactttcaacatgcgtattgttaactagagttcaagaatagtttacagtttttttttcttttgaggtaaaatttaaatacaatagtgtatataaatcttaagtgaacatttgctagttttaacatatgcctatgttgtgtaaccctaatctctatcaagatacagaacattaacatcatcccagaaagtcctctcatggtccttctcagtcaccttctgctcccacacctcacagggaaccacatttctcacttttccccctttactatagattagttttgccaaaacatgttgtgtttaaggaatcgaagtatgtaagtgtttatgtgaaaaacagaaaggggaagcaatccctaaataaacatttacatctattacatttacatttcagttgaaactaacaaatgaaatgacagctggaaaactacagagggcaattgatgaaggaaacttaaaatgacttcatgtaatgactaatgacctggatttagaggaatgtcagaagtacacatggctagcattccattatgccatataattgctataatggcagcagactgtgtaaacctgaaagtcacttgtcaaagaattttgcctggtagtcaacaaatgtgatacaattctgtgacccaaataaccacatattttacaaaagttgcaaagtcaaaatatggtgattgtttcaaatgttttggttttgtggtagaattgcttaatatttggcttttagaatgatttattataaaatgttgaaaatatagttttaattaatgtacaatgaagagaaatattttggaatgtatgaaattactctgttaagagtcttcatatttaagatatagttttaagtagcatggctatacatcatgcatagatgattatacagatgtaatgaatcccagctgttattcaggtaccttgtgatatatgtgtcacctaatatatttaaatgctgagcttttgtcagtagagaaaaaagtcacgagtaatatctaaaaattagcatggcttagtctgggacactggccctcgcagtctgttaattacttgtagtctctagcctctctcttttattcataccacagccaaacactgagtattaacggatgggttttaagaatctaccgaaaccacccatctatcttccttctctccctcattctcttcttccttctctccttccttcctggctacttaaacagatatttgttgtgcacttgcgttgtaacagtgttaaacggtggagatactgtgatgagtagaaagtaccttaccgtaaatcaggttctacagatgctgtttgcattcgtaaacattaacctctaacgaatcagaattcacttaaaaaatcatacatcctagaatttgtgaatggattttgtgaagaacagggcatgttggtatacgtgataagattgattattcaaagttgatcagatgtctatactgttcatttaattacgttatctctacagctgaaacaactacacttgctttaccattgaccatctgcaataattatcatgctcagtgtagccattagtatagttaactatctttttacttaaaaaagtttcactgtcaattttgttgatgttttcaaaaaaccagttcctggattcattgatttttttgaaggattttttgtgtctttcacttctgcactgatcttagttatttcttgccttctgctggcttttgaatttgtttgcttttgcttctctagttcttttaattgtgatgttagagtgtcgattttagatctttcctgctttctcttgtgg

SEQ ID NO: 126983 - DNA, 2281 bp, Homo sapiens
aaaataaagtgtgtacttttttttccataatgcaattgcacatctaatagattacagttcagtgtaaatgtaacttttatatacactgtgaaaccaaaaaattcgtgtgactcactttattgaggtgatctggaactgaacctatggtatctccactggtgtgtgtacctctgaggtctttccttgatgtaatgtgtgagtaccagtttcccctgcctagatcttcaggactagaattgcagctttgagaaggtatgagagcactggaggggaagcttgagactgggccactagaattgtggagtagagattggaagggaggattggaaagagccatttctgagaagcagagatgaagggattagccgtggagtagatgagtgaaatagctaagcaaggatgtaaacttcagggagaagcatttccagaggatagctggatgctggggtataagacagaatgatttgtagtagtatgtccctggtgtagtcaaggaagggctgattctaactgctggaccccggcttgatttcacattgtgtccacattcttttgttgccaagtaatgttgtcatttgcatgcaaagttcctctgaggcaagaagtgtttcctagtcatttttatcctattagtgtccagcacatagtagacaaaactttgttgaattttagttcatatttgtgaagacctgtatatttaaattcaagatacttgacaaatggagattggaagttgtaatttcttttttaagagattgtgttaggggtgtagaatgagagggctgtgtttagtaactgatagtcttactggtcaacatctatcttctgggaagaagcgtgactaatcctacacattcctttcacattggctttctctgctttcttttgcctatcagctttgtccagattgtaaacaataacctagaagagaaaggttttatatttcattatcatttcttctaacaacacagctttgtgtgaataagacaatatcaagtagattgtttaccttgaattaaatttcccaggaaacagttctagcatttaactttgattaaaagtgaatttttgttctctagaggattgtcagaagttgttataaaaagagctatgtttggaaacagtgggtgtgggactcctgaatataatagtaatttaaactcagaggtttttcataaaaatcttctttttttaataaaaaagagatgacagtttataaaaaaatgtagttctataattttagatgtttaagaacataaaaatggattacattaatgatatatagatttacagtattctttgagactgtcagcatgttattttaaaaataattgatatgtgtctaatagtaaacaatttagtatttttggtgaaaaatactttaaaaatttactgctattataattcattcatattggcctttaataggtaactccgttgagttggtttctgcctcagaaatattttgctgttatagatttcatggaatagcaaagagcaaataatttgtacatgcttgtgtaacataatgttaaagaatatttaggaattgaaaatgttgaggaacagcttttcctggcatgcatgcctagagagggtttgcatcaccactagggaggacacagaactgttaagatctctggcgttttattacatgtctgataattatttgttcacagccagacctaccatattcagttctgcaggttgtgcactgcataactgtaatgatattcacatgtgtaaaacctacacatttgtatgtagtgactctgggttttgaacaagataaaaaaatttcttaaggagtttacattccagtgggccagacagataatcaataaataagataggaatatatcagataaaaatagataccatacattgtaaggtgaaagcggccagatggctggtttagaagaaatagtaaaatgaaaagaactggtaatttaaaaaataaaatcttttataaatggtataattaaaattattttacatatatttctagacgttatcgtttttgcgttttgttgctaaagatagtctgacacagttatttgttttcactttgggtttttaaaaactgtgatagcagtgggatgcattaatttattttttttgagatgtagtttcgctcttgttgcccagtctgtggggcaatgggcgtgatctcggctcagtgcaacctctgtctcccgggttcaagcgattctcttgcctcagcctcctgagtagctgggattacaggcatgtggcatgttgcctggttaattttgtattt

SEQ ID NO: 126984 - DNA, 1803 bp, Homo sapiens
agaggcatggggcagaacagtggaatatatgatacagatatccaaaaaatgaaatctaattgataaaaaagcattatgtcttagtttaattggcagcctttttgcttctagggatatataaatagtaaacttatatcatataatgatggtgctttggattcattcatatttggattcaaaatattgatgctgcagtattttattttgagtaatttgaatgggatgacttatgacttaatggaaattttaagaaagcctgtttatggaaggtggatcaaaagtcatacttttagtgatagattctgtcaagggatacttttaaagaaaggttaaaatcatgtcttttattcaaatgtaaaaagaatgggtatcaaagactttattaagctcattaattaatgaggggatcagtaagatgttacaaataattcaaaggagaattttaagagcacacatatatgggcaatcaaggatgctgaaatgaatgtgaaacagacgcaaaactggttaatagccacaggccaattatccatttcatttcactggacacaatttatttgcatttttatggaaaagaattgtttgtattattctgtgtcttacaactgcatggttgtaaagtagcagaaagacaatgtgaggctcatattctgactgactcagataatctggaagggtatactagataggacatccactaatattttgcatatttcagtgtttcacaattttcctgacaaatcttaaagtttagaagttttcctgatagactttgtatcaaattttaatttcatgggaaggatttcattcagaccatgctagaaagatgattacctgatgttttcttatggtttctcccttaatcattcatcattccatctagctgtgttagagtgttaatggttttgaatttctcatttatatctttgggtcagtaaattgaatttaatccagattatatttttgggtaaagagaaacttaaaaaaaagctttaaaactaagggatctacaaacacttattgattatatactttataaaagcccatctaattaaaataaattatctcaataattcttaataatgaaactataaaaattataagaagaatcttaggaatattttttagtaattttttttgaaatgatacacaggaaatattaatgaaattagctatatttgagtgggtctttgtatttaattccttttatacttcctttagtgagttgagaatgaatagtttcccattttttaatggggttaatcgcttaaatatggagaaatggaaaattaaatgtatttgatggagagcagaatcaaagctatgatcacaaaatatatactttttcaaaattaaaataaaaaattttaactttatttttacccatgaattttgactgagaataagttgtcacttgatgagccacgtgtggtggcctgcacctgtggtcccagctattctggaggcagagatggaggattacttgagaccttcaagttgaggcttcagttagttgcgatcgcatcactgcactccagcctagctgacaaagcaagaccccatctctaataaaaaacaaaaaccaaaaaccctcaaaaagtccaaagttttttatatggtttcaattcactgttagaaagttgtctcacaatgctttgatgatgtattaaatatatgaatgcatgaagttcttactgagcatgcagatacagttatttaagtgttatgtgtatcagctgggtgaggtatatttttgagacgtaaccctttacatttgaaagtctggtatttaatttggctaaa

SEQ ID NO: 126985 - DNA, 2522 bp, Homo sapiens
ttatatttactcatagaatattgtgaactcatcagtttgtattagaaacatttgctacattttttagtggctattttcaataacattttagcatcctgtggtgacataaagcagataacatagttcattctgggtgtaaggactagcaaatggtgaagattttagattgttaggattacataggataattatatgtccccaagtattgagtttatatacaaggagattaggaggatgtagagaaactagaagttttgaattctaatagtgtatccagtcattcaaggagacatatcctgaaggaaactggaaatacagaatcagagactggttaaaaataaaggctaaaaatgttctttggggattcatcagtatggaaatgttagttgatcttgtggaagcagatgagctgtgaaggagtgaatcaagatgaaggagaatataggcagagaatcaaagggggatgctggtgggatagaagaggaaaaggatcttgaagagagtgacagaaagaacagagggataggagaatcaggaaaattttctgtttggggaaattgtggagtaaagaactttttgaagggaagtagagcagaggcagaggagaaagataggaggaacaattttattggtaatttagggtagttttcctggtaacttagggtggtacaatggtaagttattcatttgttaaaacagaaagcatattatgtttatttttgacagaatgatagcattccataagtttttttttttcttgagatggtgtcttgttctgatgcccaagctggagtgcagtggcatgatcttggctcactgcaacctctgcctcccaagttcaagtgattctcctgcctcagcctcctgagtagctggggagtacaggcgcacgccatcacgcccagctaaattgtattttttggtggagatggggtttcaccatgttgcccaggctagtcacaaactcctgacctccagtgacccacctgcctcagcctcccagagtgctgggattacaggcgtgaaccaccgtgccctggtgcattctataaaaattgatcaaagtcttttgactctttaaaaaccacttttaattaaagactcgatagagtaagcagaaattatttacatttttaatagaaatttagtcatacaatgaaaatgcactcgaacatttgttgatacaaagacaagatttatactaagaagtagtcaaaaataccaattttatttattgatttattggaaaaataatgtatatcttggagactggagcaggctaagtgacttgaaagctgcaagagagaaaaaaaggtagcacatttaagctttaaatcttttagacaaaaatatctagatagtatggttctgtttagaaactcaaagatttatatgctatatcttgaagcaactaaaggacatggtgaacatttttcatatgtcacaaagtgttttatatttttgctttaagggacaaattagcaatatttggagacttcacaataactttgtggggagagctagggcatttgtaatgagaaaaatatagttttgccatgtatgaaaaagtaagttataggtcagtaaaatgtttcagtatcttgtatacctagaaggactgctgtgacaattgtgcctgtatagatctcatttatccttaaaaccttctagttttaaattggtacagacagtgtccttagtcaagtagtatggttggaatatatttaaatttttgtttatatattctgtttttggcccactgcagaatctaacagacaggtttttatagttttcttttttttttcaaggccagtattaagtaaaatgtagcaggtgatctgattttgtataattgataaatatttagaatgttaggtttttagttaggaaaagaccttattgatcatctgcatttcacctgcttttgcagataaaggacttgagacacaggaaaattaaatattctagttccactagaagtgagctatctgactgtcaatatgtgtatttccaataatctctgctgcaccttatcttacaatatctgtgctaaaatgtaaatgtaaccaggtagagaattaccattgactcactgttgatgtggtttcagtaattcagcaaaccagaatcctgagtcaagtatcatgtagtaggtaagagaagagagagggaaggaaatctaggcatgggatgttcagtctgttactgtaagaattgctctggtcttggagacaaagggcctgggattcagttttgacaatgccacttattaactgtgattttagagcaaaaccctaaattctccaaccttcagtttctttatatatgaaatgggaataaacattgttgcggtacttacttctaggttaactgtgagaatcaaggccactgtgagagtcagtttctagtttaccaacatttatttgctgttactatgtgctaggcaatattgtagccttcaacaatacaaagacaatggaaacttttataacatattacaaaaggctaaaaactaagaagta

SEQ ID NO: 126986 - DNA, 1737 bp, Homo sapiens
ataatgatttactagtgtcatagtcttacagttttgtgggtgtattttttccttttgcctggggttcaatatagtccatatttttatattgaccattaattaatattatggtaggaaaaatgcagtaatcttgaattgtgataaaaacatagaacatcatgttgggctttagataatcatgcaacctgactgtaatctttttttttggcaattgtgggaacaaattataaggacaaataatatcaaagaaggattttgataggattttccttgtggaaaaatttgcaaataactgctgtcattcctatcttctcctagttaacttttcttctttaaccacttaaaaaaaaagacaaggaaaacatttattaaaaaatctcccacgaatacctttgcttatgaagtataaacaaaacaataataaaatagcctgactcttttgttctttctttctaactttctgaaaggttaatttgttggcattaagttagcttctcatttctaatttgtcttcctctattttcttttagttcttggaatttgcactaaaactcttaaacatcaatgtgttcagctgtatttgtgaaagaaatattccttatctaatagcatttagataataacagttaaaatttcttaaaaaactcaattcgagtgcccaagtagttgtgtgcttattctgtttagtttgtttattgcatttcaaatgagtttaagtgtgagttacaatttgtgactgaggctctggctaccctctctccctgtactcctttgaccctcatgctaaggtgacatctcagcccacacagctgaatttcaaaataaagcatattgcctggtttttagttgtcttctggggcctctagaggtgcagtaatacaaagagctactccatgaagcatttttctttcattgaaatctaagataactttattcaaattctctgattttccaagtcagcttcatttcaaagcagaaagccaagaatgctttccagactttagcaatttcctttattgctccatattctttcttaggaatgacagtgcacacttgtaatcctcctaccataggatccccctgcactgaagagggagttcccggtgaatttctgatcagtaaaaaggatatgttttaagggaaaagctatattttactataagaaattatcgatgatatataatagtaacagaaacttttgcctgtcatttaggttgctgtgacagagggaaaggacatgataaatggcacttgaaacttttgactagaagtatcacataccacttttgcttgtatttcattgctcaaagcagtgacatgtttactcttaaagggggagtaagtaaatatagtataatgatataataaagatataaaggaatgtttgtttatcatttgtaagtactttcatagatctgattggttgattgattagtttatttaaataaaatttattgaatgcttactgtttatcattgttgtattactagtgcctatcatatgcacaagggacaagattcctgcactcatggagctaacgttgtgataatattgttttggaaataagcttgtcagtatttatcaagaaccttaacaattcttttatcttttttccccattaatttcacttctggactgctacactaaggagatattattaaatatgaaaatatgtataatgataagataacagttttctttgtaatattgaaaaatcagaaacagatgtctagtagg

SEQ ID NO: 126987 - DNA, 2813 bp, Homo sapiens
tacctaggaatccaacttacaagggacatgaaggacctgttcaaggagaactacaaaccactgctcaatgaaataaaagaggatacaaacgaatggaagaacattccatgctcatgggtaggaagaatcaatatcatgaaaatggccatactgcccaaggtaatttatagattcagtgccatccccatcaagctaccaatgactttcttcacagaattggaaaaaactactttaaagttcatatggaaccaaaaaagagcccgcatcgccaagtcaatcctaaatcaaaagaacaaagctggaggcatcacgctacctgacttcaaactatactacaaggctacagtaaccaaaacagcatggtactggtaccaaaacagagatatagatcagtggaacagaacagagccctcagaaatggccctcttctcttttccctttgtccactgctcttaacttcttgcctacctgatttctttttgaagcatcatacctgtaattttagctctccattggatatatgtgtatgatgatattcctcagacttctcaaacccaacctagcccataccaaactttttttcttcttctggttactattttgattattgccatcatatttagtcacaagtcaaagttagagtcacttccatctttaacttctaggtttttcttatcatctgtatccagttagacacagagtctttttgggtctacctgaaaaatatctattgaatatttttcttttctccatttactaagtccaggtgccacatagatctctccttctttgactatgatatgttttctctagtacattttccacattgctagcagatttatttccaacatgatttggataatatcactttcctgcttagaacttctgctgattccattttcttcttatattgcatatgagtcctagactgctgttctatctttaactctagacattctcttttatagttctctctcctctaaaagtcaagacttaaaaatatttcaaatgatgaaattttaggcttcttgatggctactgggagaaactagccatccaatatggatagtatggcccctacagccttgctataataataataaatgggcaaatacaatgtatttatgtgatacccataattaggttaataagcatatttctttttttttgtaagtaaatccctgtgtggatattttagttgttgggaagcaagggttaataacatccaggtaacaatgagggatgtatgttttatttacacatatgctttctatacttggaaactaatatagcagattatcttggttaagctgtacagctcagctgacttttataagaaaacaatagatcccctgaggtaatactaatgtaagtaaaaagtaattatggccattagtatatctagttgggatgagaaagaatgactttaattgttacctatttactaatatttttacaattggttgtttcctggcctctttattctcctagcgtatttgagatgagatgagatgttagttctctaaagtgcaacatatttttcttcttagccaaatcctgttattaacctcatttgccttagctgacaacaggtttcccttaggcagtgtaagcatcgatgctctgaggaagaggataaatattaattggagtgtactacttcttggagacctttaagaagtgctaaatagtctgagaaagtgatttttgcttctacttcgggagtgtttgtttaaatacttaattacttaatttgaaagaatactagaggtcataaacagtaatgaatatattgtcaactagaatatttttgcatatactcagaatgttttgtccttttctcaaaactaaagcaaggtaataaacaatgatcatagttaaaagggtaattaaccttaccgtctctgtaatcccgaggaagtctagacatgaactcaggagttggcatattgttttcaatatacataccagccatctttgaacatttattctgtaaaatgacttgtattatgcttaagtgagtatgagcagtgtgactcacataagtaggagaaaagaagccaaaaactgcaacaaaatattccctttaaaatgaataccatctttacagaactgaatatatttctggactgtatatagaattggaaattttagaactaaaagtttttaagagcttactatgtgtcaggaattgttctaaatactttacatatattacctcatttaatctttccaatagcactgtgaggtaagaactgtaattttacagtgaggaaactgaggcacatagagattgggtgacttgcccaaggtcacccagtaggtgctggggtgaggatttacaccagggccttctcgcctcaggggctgtgcttttgaccacttgggtcttctgctgatcagtgatttaatctgctatttggtcaatctggttttttacttatgaactttcctgctactactcttagctcatacttagtacagttgtcccttcatatccatggggaattggttccaggacctctcaattgtaccaaaatccaaagatgctcaagtccctgatgtgaatggtgtagtatttgcatataacctatggacatcattttgtatactttaaattatctccagattacttaggacacctaatacaatgtaaatgctatgtaaatagttgttacactgtattttttagggaataataagagggaaaaaatgtctgtacatgtttagtacagacagttttttcccaaatatgtttgatctgcttttggctgaatccatggatgtggaacccacagatatggatggcctac

SEQ ID NO: 126988 - DNA, 4205 bp, Homo sapiens
tatattgcaaggatttgtgtatttggattgctagaaagttaccgtatagtattatgacagtacagtaggaaacatttcagtgtgaagaatagtatgtctcacataaattttaccatagaattaagtaagaatcattaaaatattccgggtttattaaaaattcattattctactagatgatctttaaagagcaataagaacttgaagaaataataggaaagctttggtaacaatgacactgtgttaattgagttgcaagaaggtaaagaatgtattaacagaatggatccaaatttggcaaaaaaggtttgtaataaatcaaggggggaaatcagttaataaagaaagaggccaattatcagtgaggggaggggagtgtatttaatgattctaaatgaaaggttaaactgcttgggtgaatttcagtttaacaaaaaggaagaaaagcaatatggataattaggcagtaataagagcatactgaaaaaaaaaagcggaaaactgccttaggtgctaggggaatattggctaatgaacttaacctcctgcagttatctttgaatattcacttttgctttataaatgggagaagtgatgtttttagttattttcaaggaggtatgattccttagcacactttatcatattgtggactttaaaaaaagtaatttcaacttttattttagattctggggcacatgtgcactttgttacttgggtatattgtgtgatgctgaggtttagggtatgattgatcccgtcatccaggtagtgagtataatagccaatagttagtttatcaacctttttccccctttttccctccccactcaagtagtccccagtgtctattattgccatctttatgttcatgagtgaccaatgtttagctcccacttttaagtgagtacttgcaatatttggttctctgttcctgcattaatttattcttaggataatggcctccatctgcgttcatgttgttgcaaaggacatggtttcatcctttcttatggctgtgtagtactccatggtgtatttgtaccacactttctttattcagtccactgttgatgggcacctaggttgattccatgtcttagccattgtgcatagtgctgtgatgaacatatgagtgtgtgcatctttttggtagaatgatttattttccttttgatatatgcccagtaatgggtttggtgggtcaaatgatagttctgttttaagttctttaagaaatctccaaacttctttccatagtggctgaacaaatgctgttaaatgctgcttattgcaaatattctctagaatattgatattgaatctaccacagatgtttatgcaatgtcatgactatcaactgtcagttattcttaacatgaagtaggttgacataaacaccaacaatgtcattcagtctgccagtattgaaggagcagtgattctctgtagctccatgctggattacgccttgctaagaacagtcaacagtgggacacttagcatctgctatatagtaagccaaaaagggacatatacaaccaaggaaaacttgaaaacttttaaggatgtggtaaagctcaggtcttagtgacatctggctctgtacttttgtatttttttgtattttgtattttgggggaggctgccacataggagtccagatggaataactttggaatagatgaatacactaactccagttatgtgaagaggggccacaaacagccaggcaaagaaaagaagacatgcagatcgccatggaaagctcctctttggaagcatagtcaccctgtgcatagctaactctattagctagattttcaccatccttttatctatgtgataacattgaaataacagcaaatattcaagaagtggagctgatattctttatttttattatttttaataatgtcattttggaatgacaataatagttttatttgttaaaataaatatagggtatacgtacaaaattaagcatgttgcttaatcaaataatcttcattcatttttatcagcactattttgcattttttttcttttttctttcttttttttcttttagtagagacttggtttcgccatgttggccaggctggtcttgaaatcctggcctcaagtgatccacccacctcagcctcccaaagtgctgggattacaggcatgagccactgcactcagcatagcactatttttggagcagtatttctacaaaggaaataactaccatgactacaacagttattagcttattaagatgtctcataaaattaagttttaaagtttcaagtgatgtttacttttcaatttcacatggaaagttagcatgaaaagactaattttttaaataattgtgtcttttcttaatgaaaagcataaatacatttatagttgttggagtatattgaagaaattacagctaaatattttggttggttacaattattggtgattctggaactgtggtttacctacaacataatggttgagtgtctttgaagattttattgggcaaagcaggattttaaatcttgccagaatttgaaatacagtatatcatcatatactatagctatattttgaatataacttttaattttgtatgaatattacattaatgagcaacatgatgccttagtaagttaccactatcaaatggcagataataatggttgagagtagtttctctgaacttttccagatatgttttcttagaacttttttttaaagagatgtgtacttgaaaggaggatattctctttaaaattcatgtggaattggttgaaataaattcagagtatatatatacatgcccaaagtaaaacacaacaaaactgaatcgtgagttgacatacgttaacaatattagttaaattacaagttgactggtgaacaaaggatactcttatggagattatgattttaagatttttttacaagtcattttattgaatgtggtacagaataagatcgtatataacagttaaattttcactgacatttcaagaggtggaataatagaggaaatacccacggactaggttctagtctgggttttgtttccagtagctaggtgacctgagtaagccacttaattagttaggactttattttcttaaagtcatgatgttgtcctgggtgtccccttcattaactttcacactaatatgatatatatataggctggctgtgatggaacctttctgaatcctgttcttccagtttagtatttattctagaggataacattttgaatgttcagggacgttcaaaagaaatataacgtgagccatatatgtgattttaaattgtctactaacactttgaaacaagtgagaaaagaaacaagtgtaattttaattttaatattttctaacccaatagatctaaaatatttccacatgtaattaatattaaaatattaatgagatattttacatttttcgaaataaggtcttaaaaatctggtgttggtttcatttggcacatctcagtttggactagttgcatttcaagtgttcagtaaccacatgtggcttttggctactgtattggaccttgctgctaaagttatggaatctttatatctatacccatgaatcaaatttagagactttagagtcagctttaattaccttttgttttctcctctcttctatacaataatgacagagacttgcattccctagaatctgtcaagatttgcgggtaaatcagtacattttgctcttatttccaagcatctggaaagagtactgatgtttatttccaaacatctggaaagagatatttctgggaagaaatatctgtgagtcctcttcaattccttaagtcacttactgccttagtttagtaaaatcagacttctatctctaatattctacaaaaactctttggaaaaattctcaaatcttctcattgctaaatccaatggccacgatacaaatgtttcttcatctcttagcagaaatggacagtatgaattcttcctccttgaagttttctggccctttgttgtatattacatccttttttcttggttctgttttagctttgtatgctttgctggttccttttttggccctcttctctttatttatttatttatttattttattattattatactttaagttttagggtacatgagcacaatgtgcaggttagttacatatgtatacatgtgccatgctggtgtg

SEQ ID NO: 126989 - DNA, 1016 bp, Homo sapiens
gttgatctttaaggtctctttcatttaaaaaatgcatgaaaatagctttagggatcaaaatggaattgttaggaagttcaacataagaattaatccctcaggatatcagaaaactatgttgcatagttttaaagttggagtcaaaactgacttgaaattttttaaagaagagctatattggcacatgaaatagaaattctggaacagataggagacttggaacaccaggtctttattggtgaaagacatcaaatgaatatatacttataaagattatgtctgtagttgcaattattgaaaattgcaaacataaatgttggcaggtagacgttttacagaaggatgagatcaaaatcctttcctatttatttaaaattactcaaaataagatagtggtagaaatctttgtttctttgttccttgtaatttattctgggagtagagtttttaatattctaatggttaattttgttctggttatctccatatctcttgtcaacttaagatgtgtttcccactggtaaacacagtgtccgctggttcttgctaaataaagataccatagtctatattctgcttcatattttaggtcttggaaaagtggaagaaatctctaaactaaacttaaacataaccttatttgatccaaggtcagtagatacctttcatttttcttttccttttagaaaaaaaaaaggcactgttttggtgagtagaggtggcaaggctgggaaatgtgtcggtagctgataagaaagggaaaggccttaaaacgacacccaccaaattttatcagtgccttggagctcaggaaagtatttctttccaagaagagaacaggaatgccttttaaaaaaattgtttatttccattaaggagaaacctcaagggcccatgaaaggttattcctttgcataatctagtgacaggtttactcatactcagaggttacattaatacttactgatggcacaagtataagtttcactttattaaaaattgtatggatgttggaa

SEQ ID NO: 126990 - DNA, 1062 bp, Homo sapiens
agacggcatttgcaaaggacctcccaaatacacgttaaatattatatgtaaggagtcagatttagctatcgaggagaagcattttgaatgtaagtttacataataattacaacaaaattaattaggatattagagtagtgaacagtttaggtttcaagcaggaaatagaacacaaggcaaatcaaccgtcatataagggtgtcaacttatcttaaatacttttggaattaataagatatagaggcatacataaagataggccacagatcagtcagtggctgatttctatttctggctgtaaatggactagtttatttcaaactaaggcctacactgtgaataatgaaaaaaactggattagaaaaatatatatatctaaaggcattggagcactaccaagagctaaagatctaagaatgaaaggaaacacactgaagtgagccctgtatttggtgtcatttttcaccttgggttctgtcaatttgcaagcaacacaggccaagctgagaaaccaagcagcaatagctaagatggtgacaggatgagcagaacttttggcagtttcacagtgcctgcaagctaaaattcaggaaggaggaagaaggaccctggtaaaacactctaagcttttcattggaattcttgtggggctatatcctaggagttaggaagaactataaataggccactacttacaaaaatcaaaatgtattctttgataaacccaatcttgattttaaggtggtctgcctttacttcaactgtctgtcattgctggaagcaagagacatcatgcagagtttctataatttttttatacgcaacacttggcatttaataaaaaattataccatgcatattagaagccaggaccaagaaaaacaatataaaacaagaaaggatagaaacagtctcacagtaatctagatattggaatgattagacatggactattaaataactgtaattggccaggtgtggtgagtcatgtctgtaatcctagcactttgggaggccgaggtgggaggatcacttgagctcaggagtttgagaccagcctgg

SEQ ID NO: 126991 - DNA, 1028 bp, Homo sapiens
acgaaagatgctttgtgtcttgagtgcttgtaaatcttgaaaggttccttgaccaaccaaggaaattaattggaacctgctaaaaatggaatttcatgttttggccacagtaataataatactgaataatgacccataattgtattaaaagccagttatcaattgagctgggaaaatataattgtgtatacttatctgttctatctgtactcattcccaatttttaaaatctatggccaaacatttttctgagtttgtagttaatgtagtacatttaggaaccaaatgtagaaagaccatgacttttatgaaagattctttagggaggatgaagtacctaggtttccagtttttttttttttttttttttttttgacagtaaaatgctggggagggaaatcctgtgttgcagtttatttttggtactttcaattatccatagtaatttgcagtcattactaagtatatgtacaagtgacatttttaaaataaataaaatgagatagtataggtattattattcttattatttgatatagattaaactgatttttaaatgctgttcatagccatacaaaaagttgatatccttggccgggaacagtggctcacgcctgtaatctcagcactttgggaggctgaggcaggtggatcacgaggtcaggagatggagaccatcctggctacggtgaaaccccatctctactaaaaatacaaaaaattagctgggcgtggtggtgggcgcctgtagtcccagctactcgggaggctgaggcaggagaatggcgtgaacctgggaggcggagcttgcagtgagccgagattgcgccactgcactccagcctgggcaacaaagtgagactccatctcaaaaaaaaaaaaaaaagttggtatccttaagacagtccttaacagcaatttattttttaaagtaggataaactgccttcacaatgcttatacacttaattatgtaataagacattttcttagttcagagacaaattacatcttagaaatgtttaataa

SEQ ID NO: 126992 - DNA, 1071 bp, Homo sapiens
taaaggagaaactctgtctgactaggcagtagggccagctggggaggtggataccacaggggcagagaagaaagagatggtaggatttctctttcaggcatgggtttttttttagtttcttggaaccacatacttgggtcatgactacaagggttcagggattctagaaataagtctaccgagtcaaatttatagctgctaggaagcaaagaaggagagctgtgtgagtgggagaaatggccacagtttatagagagctagaaaggaaggacgatggggggcttcctttctcttcctttcctcttaatctggatcacagatttcactgtattgagccagtgttcagttctatagtagaaggttggtgtgagggaattctcattgaatgagcatgcctgtaagtaagcattgtgctaagtgctttgagtatgctgtttttatttaattctcacaatatctggagatagtaatttttaacataatgaaacagatttacagcaagtgcatggcaagtaaaaagcaaggccagaatttgaatccacattcatttgactctaagcctgtactgtctaatatagcaagcacctatagttactgaacacttgaaatgtggtgattgctgcttgttaaaatcataataatttggatatattcatgcaaataaatatattactaaaatgctacctgtttctttttcctctttttcttccagttttagtttatgagattgggtcttgctatgctgcccatgctgggcatgaactcctgggcctaagtgatcctcctgcctcagcctcctgagtggctgggactacaggcataagcagtgcatctggctgattcttcctttttaaatatgcctagtagaaaatgtaaaattacacatgtgacatacattttatttctatttgataacactacgtctaaatcttttcccattgtacactgctgtatccctggagtatgtctgaagtgaactaagataaaatcccaaagtctgagatggaaaacactaaggtagttcctatgaagcaaaggtagacttctaaagataggtaataaacacctggt

SEQ ID NO: 126993 - DNA, 3868 bp, Homo sapiens
ttttgaagtacaccgtggtgacattgtatcattggtgtaagtaactcagaagcatactatatttgtatataaaattatttatacttatgctgatttaactggtaatccactgttaatatcatattgccaattattaaattgaatacatgttaaatacaatgcatttttaaaaaatcaattttgcagtgtaacaatgctataaaaagaattttttgcatttaaaatatgttagttgactaacatatttggatttggtgaaatgtatttaatgaaatgttgattagaaattattaaaaatacatgcatttggtactactttggaatattttgaaattttgcatcttggtaagcaacttttttgttaccccaatgttttcttggtttgtatagattaaaaagtattcctagaaggtgataattatgacatgaaaatcattgacatttatgtacatcaggagtttaactgaaaaaggaagtttgaaagactagcactggatgcttctgtttgggtccaaaaggtggcactgtttcactgttataatatgatgactggtcaggatcaaaaatttcattccagtcttaatgtagaaaaggaatgtcaaagtgtgtataactgacacaatgatataatacatagtcctaggacaggcctaaatggtttggagatttttgtttgtttgctttaaaagtaaatttacactaggaagactgtagccaaacttgtctaatttcttctggtttcaaatacttataaaaatgttgtagtatgattccctgttatgccagttaggggtagcaattaaggtagcagtgttactgccatttgatttggagacagtaaaaacctgctactgggtaaatacttttcccatttgtatttctgattcttgaattggaaggatttttttcttgttggatggtaatttataattggtaaaagcaagacatcatctgcttatttgtacttacctttggctagtgctttgtggaaatagatattctataaatgtgtttctttcagactattctaccagtattcatttgaaaacatattaaccaaatctcgttagtgactaatgaaataaattcaagtggagttttgtatggcagacatccaaggagggggattaaatgcttctcaggttttgagtgcttttaaaaatattaacctgctctttgaagtgtacttttattttgtcattccgagtactatttttgcaacctcctaaacaaccttttccatgctgggttagcctgtcatatgcttattattcttttgcctttggtttgacaaggttatatcctcacttagttggtgatggaaaggatacccacccaagtgaaagaggtcacactatacgcagacaattgtgcagtattttttttttcccgtgagaaacatgctgactatctctaaccaagtggacttaaatagataattgaaaaataaaacagggctgcttgatattcagggttgcatgggtccataaaagtatcctaccatatcatggagtatattaaaaagagcacactactattttatataaatattcatagtgattgatatttattatatacattaacttcaaaaatattctattcaaattgggattgatatataaattatagctattccagttgaactgtgttttttttttttttttttttttttttttgaaacagagtctcgctctgttgcgcaggctggagtgcagtggcgggatctcggctcactgcaagccccgcctcctgggttcaggccattctcctgcttcagcctcctgagtagttgggactacaggggcccaccaccacgcccagctaattttttgtatttttagtagagacgggtttcaccgtgttagccacgatggtcttgatctcctgacctcataatctatccacctcggcctcccaaagtgctgggattacaggcgtgagccactgcgcccggcctgaactgtgtttttaatgactcagttatgtgctatatctttgtcatgtacaaataacacaaactttcatgtgcttgttcttaggaggagccatttacataaaagagtgcttagttactagtattatatatttaacaacagatgatcgtgaagcaatattgttgctttgagaaagaaacaaaaaatctgatgctaaattcttctttagcattatttaaagtatttttttaggtcagggccaggtggctcaggcctgtaatcctggcactttgggagggcaaggtgtgtggatcccttaagcccaggagtttgagaccagcctgggcaacacggtgaaaccctgtctctacaaaaaatacaaaaattagccgggtttggtgatgcgtgcctgtagttcttagctacctgggaggctgaggtaggaagatcgattgagcctgggaggtcgagactgcagtaatctgtgattgtgccactgcactccagcctgggtgacagtgagaccctgcctaataaaaagtatctttttagtcttatgatgaaacatgctttctagaccatatccatgtattttcatacaatttagaaactgcttcattttagaagattgatgttggtttgattgcagttcataatatacatttaatttatatcaaatattgaatatttgcttttcttatacaatgcatcagtttgtttttaacatagatgataatttttgttactacattggaacatcctatttatttaagaaatgtgtgacacatacagaagtgtatattaaaatgttcgatttaaagctgatgataaaatacacttcgtaattttgtttagaaattgatattaacagtatacttcattgataaataagtaatctttgaaaacaaaccagtataacctttttatattaaaaaaatcttgagacaatgtattcagaatgtgtggtaatacaccatttctactataatattatgtgtgcttttctggaaaatttgcagtttccaaattcttacttaaatcagtagggcttattcaactttataaccagagcactgatgaaaacaataacaatgtcaataaaaatactaacacagtttaaaagacatgaagtttctaataattaaactgcagtaaaagtagtgttttacttaaaacataaaaggtgaagatagcttggtggtaggtggtataaggaagggttgaggctgtctgtggatgcaagggcagaaagacattatcattacaagtcataaatagagaaaagcttgtaagctttgtacaaaatgtactgataccagagttgtatgctctcctcattgttttgtgttactttgttttatttatttagttatttataaacaaagatcagggttaactttgcagtagcacttctcagagaaaggctgaatgtataatactgattccttcctggtttgctgccattagtatacgtagccttcagttgcctgtactaataaggcaaaacattaatcatctgggaaaaaaattacataggaaccaatgtaacttctgcattacactgaaatcttttctccacttaccaattgtctatgttaattcatgttacagaaacacatatatagcaaagcagactgtcctttctattgcaaggggttttgttcagagttggttgaccagtgttgtttcctaaagcatgggagatctggcagagggaggtgggtgcatattatttttttgcatatctttcttatttttcactgtctctttctttctgtaaaaagttggtcacagtggagttattgtttaagtatgttattcagtagctacatttatttaataacattattggttgcacaaaatatgatttgctgtcatcaagtcctcactatagtatatgtaggtggcatcatactctcttagtgatttacaaa

SEQ ID NO: 126994 - DNA, 1080 bp, Homo sapiens
tagtacttaggtcagagcaaagcatacaaactaaatatatgttcattataaaaaacaatttgtgagatacaactgagccagaggaaaacaaggtgtggggaggggtaagcagtagggagggagaaaatggaaatcatttcatcaaccagagctaagaactgttagatttttaaatgcatatgtttttatatatatctgtatgtgtgtatatgttttaaaaataagaatgtaaaacataacgggtgtaaaattctttaggtattttataggtattcataactaattatgcatattaaatttttttggattaatttatagaggcagaacaattaaggccccacataaaagcatcctaactttacttgctttaaaaaagtgaggaaacaatcaacaaagaatttagaaatgaggggtagaattttctgcctgaatactttcagtttactatgtaaaatgagaaatgtgcagggcaatatttaaatgtttaatttttcttaaatcttgtggaaaggatactgtacctgatattgtttccctttattttgttattgttgccatcatcattagtgtcctatttgttgactgctactctgtttcatgactgtaatgttttgtagactgtctcatttaattcttgtagcaactccatgagatcagtgttcctgcagtcagtccccattttatagatgaggaaatgagacaggttaaataatctgtttaaagtaatatggttaataagaaatggagacaagatttgaacatagttttctgtgtttagggcaaggactattcaaaacacttctccaagtttgatttttaactttagtggtccatggtagaagcagagaaatagatgagtgtgagaatgcaagttgttgagagagacagacagagaatatttacctttcctcttccttgttgttgtttccaagctctcaactaattgtatggtgtctgcccaccttgggtgagggtgggtctttcttactcagtccagagcagatgtttggctttttttgttctttgttagtgtttttccttttgctactggaaatcactgtgactactagcaggaatatc

SEQ ID NO: 126995 - DNA, 1034 bp, Homo sapiens
tagcaatgaataggaaagccttattcagttttatgaggaagttaaagattccgcatgtatcttgctggggtttttccgtgtagctggcttattttatatatagcagtctgtcttcaggttaatatgcagatatgtttatataaattttatatttcattgactatatgtgatctatttctgatatggttaattagaactataaattagaatagctatctcaaaacatgttttattagctaggaaacacaatgcacgtatttaatggtagtattttataattagtgcattgaaacagaaactttgcagatttgaaccttgcaatctagttgtagcgacctgaattaaagagatgcttaaatactgaagagcttgtttaaagaacacaaactttaaaaatattagtaataagaggatataaaaatcagatgctttccccttcaaaaacaattcattgcttagtgcttacattaatataaaagcactgcatattgattggcaaaaaacttagaaaacatagaaaaatgtggaaaataaataattgataccacctttcagaattatttattttaaatatattattatataatactaatagtgaaaaattattgaatgatcactatgttcaagtcattacagtattgactttatatatattagtttatttaatatcacccacaactgtatgatgaagatactatgttagcccacttaacagatgaagaaatacaatcagagagatgggataacttactgaagattgcatagatttaaacccagcttctgactttgaagtttgcatttctaaaccattataagttactctctttcttttctgcacaatttccttctttactttattcttttaaggtttttcccttttttcttccgtcctgtctttcctgaaattggatcatagcagtttgttttttctatgtcgcatttttcacttattctccagacatatccaaatatatatttttccacaatgtaatttttacaatcattttttaatatccataaagtttaaccattgc

SEQ ID NO: 126996 - DNA, 1005 bp, Homo sapiens
aatggttacaggaatgagtgtgtaatatattaagagacaagattgcccttcggtaactcttacttttcatgtactgtttttatgtctttgtttttcacctttcttgagactaatttcatagttgttttctttgtatttttaggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcaggtgaaaatgatataacttcgttctttaaagcacatacttcattgtttttcaagcactagaaatgagagtgctaattattattcctattctgggaactgaaaggttataaaaaggcattgaaatgaaattttactttactgaatttgttcttaaggtcttctaatacagtcgtattataatcagaggagaggttaataaaagtaactatcagttctctgggtctgtagtttaaatttttctgagaattttaaatggagattcttaagaaattatactaaatgacactgttttctgtgaatatggctctattagaatatccttttaatgccaaattattagtgtagttgcaagatgggtttgagtcacaatcagttgctctcttgttatataggtatatgatttcagtttgtagaaatgtctagaccattgatcccagatattgtattgtgttctttaagcatgttgctaattgaaaagattaagtgcagtttacagtggaagaactttggagtggagatttccaaaagttttatgcaaatagtcttctggaataacttagagaaaattatgttgtcctaaagttgatgtctagaacctagcttttttagtaagtttaagcagttaggcagaatttgcattttgttataggatttggtttcctgtattatcaatatgtattaagttcatgcgttgtggtaaatagttgtataaaacaaataactaaaa

SEQ ID NO: 126997 - DNA, 1055 bp, Homo sapiens
tttacatagtggattgaattaattgtgtattcagaacacttttccaaataagtagtatctgaatgctgcagtagcagttatgaaatcaataactcatcgtgccctgtgttttattgggagtgttgaatatttattgggagttatgaataactggaggcagtgtagcatagtgcttaaatacctagtttacagggtcaaataatctggattcagctctgctacttactgtttctttgaccttgggaagattccttaagcactctgagcatcggtttatatcttttaaaatggggataaaaataaggttaatgtagagattaaatgaggtaattaaaataacaattttcagtattactgtgtttaacatagtgatataaaattttaatcaacacaaagtgtatattctctactagactgaggtttttattttattagtttcacaataaaaatatttagcttttttcttttcccaattaatgcttcattcagagtttgtatattttttgtcataatttatggaggagtaatattgactgatttttgtgaatggctaatcactctattaaaaatgaaacaaaaccttactataccattagccaaatatttttatattttatgtttgataatctaatatttgtactgaggttaatatccaaaatatacgaaaatgttgatatgattttggctgaggaaaactaaccttttaagtatttcttggaggattctgttacctacgtctcacttttatttttaaaactcacctttcatcagggattttattatggctggttttgcttaacatgtatgaagaggtgaaattttcacttttctttttaattacttggataacagttggttagggacaggtctttttaggtgatatgcctcgtcttttttgcagaagaaagctacattaggttctgagaaactttatttttcaaaactggtagatattaatttaaattgcatcaaatctctatatggctcatatatttttatctagctcatatattccttaaaacctatcaaaattgttactgaattttctttctaag

SEQ ID NO: 126998 - DNA, 1016 bp, Homo sapiens
catgaagataaagaataatatttagtcttatccaaattgaatcagaccggcttcaaggattgtcagtacgtgagagattggtgttcagaactgctgcaccagaggcaaatatgaagtgtgtcgaaagaatgattttgtacctgagtgacttaggatttacacgctccatgtcctttgtgtgatgagctagttctagctaatgtgcaaaagacaaattagcctctacaaacacataggggcaggttgcgatccagtgcatctgtggtgctaacgatagttgctgatagaaattgagaaacgggaaaacaacccgcctccccccgcaaaatggagaaaattgaaagaagtgtgattcccttgcattgccagaatttctgacgtagaaattcgcgggtaagtgcaagtgatttgctcgttttgttctcattctgtaatgcagctgttattatgaagtacctgtgacagcattcactctggaagtcatagcctgtcacctcgatgtgatagaaaggaaagcaacatggcttttccgcacttttacatttgcccttactcacacagagctcccacacgttgctatggaattatcatctgtatttttcaacttaaattttgttgggtagtaagaaaataagtcttaagagattaattcttaaacattaaaaagaacccaagagctaaaaatgtttgaatagctataaaatagtcttagcaagctggtatatactgtctctcagcagacctgtgtacatttttactggccatatgcagttcgaagccatgtctttatatgtagggtttgaaggaagagaacatagatcgaacatttgtgttatacctcctgggttacattagggggcacactgctaccatgttactagccttgcagtgtgctgccttaactgataagagtttagtggggttttgggttttttttttaccccagccagccatcaaactgtgggtctaaccctacagcgaagactgagctgacctgccatattttgaatttcagg

SEQ ID NO: 126999 - DNA, 1082 bp, Homo sapiens
tgaagcaggagaatcgcttgaactagggaggcggaggttgcagtgagccaagatgaggccactgcgctccagcctggtgacagagtgagactccatctcaaaaaaaaaaaaaaaaaagattaaggagtaaggcttggtgctctgaaagcactcatgttctgacttttgggtagaagtaagtggatattgtcagatggttccattgatctcattcatttgtccacagtgttgggagaatggcattatcttgtgccggaagattgcagagcagtatgagagttattatgactacagaaacctgagcaagatgcgggtaaggtgcctggatgcatcctgatcaggccatagcctccctttgtgattagctttccagtgtggttctatgaaattaactttgtggtcttgcagaaaccctttttaagataaatcctctgaagcatacttagctatttatatagagaaatagcaaattgatttgtgtaatgcttttatttaatataaaaaagtgagcacttgatctgttttaaataccacatatgaaatatacaatctaatccaggattaacacttttagtttattgtggaaaatctccaccctgtttgaagagtttccacttacacataagtttctgtaacaatataccattcttagtcccataatctgcaaatctgtaggaatggctgacctatttctaaataatttagggccaaattctgtaggtgtcacctctctttagcttcagcaatgtgtttttatttgctggacttagatcaacgtttcagtacctaagagctcaaggagttgagtattctgtttctctgaaccaaatgttttatatctgctttgctcttaggttcaaacaagtcctccttgccctccaagtccttactcttgagcaacatgaacgtttgtgtcatcttgtaatacacaagatcctgctgagtgcttcagttcttcagggtttctaaaataggatcatcagtttttatacattaaaaaaaagagtacaatattgccttttaattttgaggtagccatttaagagataataccataaacctgtaacagctcataaaatccc

SEQ ID NO: 127000 - DNA, 1013 bp, Homo sapiens
agccaaggcttgatcctctctcttcatgccatgatgcactccctgcagttggtctctctgtgggcaaagcagtcaaagaaaagaactgatagaaggcactattgccactgccactgccactgcccccactgccacccctacagtgtgcagctttgtttctgagactgagtgaggccagaaatgtctacagcgcttcaccccacaggggatcttctacccagtactccgactaaagggacttttcttggagctttttctgtctgttcccatttgcagttccaggaaacagggaagtctaagccaggagatgtggaaggcaaaaaactaaaacagaattaactgtggtatggtcattctttgagtattcgtttttttcctcagtccatctgctcttacttttcagagtcctccaatagttgtgttatatagtctctccaggctgtttagttgtaatcagtgggagagatagggtggaatgcatgtactccatcttaagcagaaccctttaattagatttgggaacctcaaatcttggtcctttgccacattgttcttccaaggaactcctgaatcatggctcctccccaactttaaaagagtaagggaatcctttatgaaatggtacttctgttcccagaatttactcattcctctagctgaggttccactgtctcaattagtagcatcactatttactcagtcagaagaccctgatgtatctttgacttttctagcctccctcaaataatcattcatgaagttctattaattctgttgcctagaaatctttcaaaaccatttccttttcactgttcccacctttactgcctcagttagaccatcatttctcacctgtctgcctctgaactgtcagcagagttattctttggaacaggagtcaacaaactacaacctacaggctagctaccttattttgtaagggaagttttataacagctcacccgtgcccacttatttgtgtattgtgtattgctgcttttgcgccacagtgg

SEQ ID NO: 127001 - DNA, 1051 bp, Homo sapiens
accacttcaagtttgtattagtctgttttcacactgctgataaagacatacctgagactgggtaatttataaagaaaaagaggtttaattgacttacagttccacgtggctggggaggcctcacaatcatggtgaaaggcaaaagacacatcttacatggcggcagacaagagagagtttgtgtagggaaactctcccttataaaagcatcagatcttgtgacacttattcactattatgagagcagcatgggaaagaccctcccccatgattcaattacctcccaccttgtccctcccatgacatatgggagttgtggcagctacaattgaagatgagatttgggtggggacacagccaaaccatatcaaagttaaatgtgggaattttacaactatataggtctcattatcctccccactgtatgttgtagttgccacatgtattacatctacatacattgaaagtcgcatcagatggtgtcataatttttgcctttcaatagtcagacctattttaatgaatttaagaggataaaaatactttatttactcagatgtttaccatttctattattctttcttcattcatgaagttcccaggttccttctgttataatatttttgttgagcctgaagatcttgttttagtatttcttttaaagcagatccagtggtgaagaatcttctaagttttccttcatctaagaatgtctttatttcacctttatccctgaaggatatgtttactggatacagtattgtaggtgaacagttcttttgtgtctgtactttaaaaatataattccactgtgttctgaccttcatggtgtctagcaagaaatatgcagtcatttaaattactcaagtacaaggccagacgtggtggctcatgcctgtaatcccagcacttagggaggccaaggcaggtggatcgcttgagcccaggagttacagaccagcgtggaaaatgtggcaaaacccccgtctccaccaaaaattcaaaaaattagcccgtcatggtggcacatgtctgtagtcccagctactcg

SEQ ID NO: 127002 - DNA, 1485 bp, Homo sapiens
aataggttagatagatttcagcatgcctgattaaaaattatcttgaagcttttaagaaaattacattaaaaggaaaagccaagaagggtatagagatttcctgtggtagtggtgggtgataaaatatattctttgtactggattctgaacagtatcatttttttctgatatggtaattaaatgagaggttttcataattattcaccaagacctcattcattctagtgtacacagcttcagtcttttatggcagcttggagtttagcaagaattctgattaaaatctcatgcagtataataaattgcttttgaaaactgctctcatttcagttactagtccttggtttgaacaaagaaccaaaatgagaaagcactcagtgaaatgaatctcttgagatttgtgattaattatttataacaaattcacaagattaataaatactgacatagttctttagtgcctcttatctactttaataaaggcttgataatatgcaatttcagttgctcatgtataaatatgactttgaaatagaagatgtacctcgacatgagaatcaaaccaataattaaaatattaagcctctataatcaggactattttaaggtacctgattcattcaatagagatttttatacttttgttgatttttaggatattactagaaatgctactataaataatttcctttcatgcttttacgatcagcatattgggaataaatcaaatcaaaagtgatacttaagtgtcattactacctgagcacaagaaagaaggcgtaaatattactttatttcaggaaacaataaattgcttttttggcaacagaaatcacaatgaattagtataatcacaatgggtcactgcacacattatgaattaggaacacatgccgttatatggtacaaattctcatttgttacgtgtaattcatgtctaaaacctcttaaaatttgttctgaagctgaaaagctgtaagtagttcactgcttcctaaattgtagtgcttgccaaaatggaccccttggagtaagactttaaatttgtctagtaccttccttgctaagaactcaactcatctttccctaagcccaaacattatcttcattaatgcatactacatctttgtgaaacttatttcataaagatgtattcattttgataacactgaaattctagattatagacaccaacatgcaatatccagaatagagtatcacaactaaattctgcttcccctggctccacctgattcgctcattccgctttatctattgggcactccccagggctggggatccagcagtgactgtgctgtggaagcatacagtaggtctacctacagtcttgggggctctaaaggggctttccagaagaagtaacattcatctcaggtatttcttagtctttcgctctgccttctcctatgcagttctaaataattcaataagactccacattatttcaaagatttttagtgatca

SEQ ID NO: 127003 - DNA, 1013 bp, Homo sapiens
ctatttaaaaattgtacttaggaaagaaaaacccactttccttcccccttgtctttatctcttgattgaaatttggtttaaaggaataataattgggcttagtcttttgacaaagtcaaatattcctcccagtccctaatcgttttaactctctctggccatagagaagtttttcattttctgtctcttctgcctcagatagacatagataaagggatatttttccattcctgatattcaagttccaaaggatttacatcctggaaaatataaatgttttgactacagttttcaggaaatatgtcctttctctctcttgctgcttattgctgacttagactattgctatggatctaccatctgtacgtgggtaaggcaagttctcaacttcagcaaagatttagtgcaacctcaaactgttttgagaaagaaaatagatataaaacacatcaaagatttaaattaatgtatgtggatatgttagtttcctgatgtccttatatatagtgatgtttaaaaaaaagaaaaaagaaacaggacttgccagttttttagctcctaaaaaagaattcaaacgtttaaactgggctgcaagcatttgtgtttgaatcaacaaatagatagatgtctttggcagcagtaaacgctacccagccaggagtgtgaagtcatgtaactctatctagattagtcccttagaattccaaagggttgcctgctattaaccgtagctgataatgtcactttcacaaaatttaccatggctttttccttggcacaaagaaatacgttttaacttgcctagaaatcctacttgtgaaggggaggaaagagaataatagttgggtatgtttcaggtggaagccaagctaattgacaaactggatagcctgatgtcagaaggcaaaggtgacgaaacataccgcgagctcttcaacagtatgtgagtaatatgtttatctcaagttgattccattctgggggatttggtgtcagtactgagcctctctgca

SEQ ID NO: 127004 - DNA, 1053 bp, Homo sapiens
atgaaggttggattctctaagcatctatctgtaggccacggtcgccctgtgttttctccagatggcaagctttgatggtggtgagagctgcaggaatataggattcgattttgattatatatgctcaatatggcttctgctgcagtatacatttatagacttggaggtgttaaaatgatgtgttaaaaactttgtgaagtaacaaatagtataacatagcatattatattttacataagtacagaagcagcttttccattttgaagattgagagtgttgaaatagctctctttagaatttaacatatttagtttgatatctgtgagtagaatcaaatatctattcatttggttgtccgcatgctacagatttaggtgggagtttttgctcattcatctggccttataaccaaagagcaaacattctgggtacctaggaagggctgtgaggtaatccaaggagccagatgggaagaggtccaggctatggacatcatcatcacgcagcatcaacatttggtcattctgcctgactcatgtgcagaggaatattttggattgaattaaaatttcagtggtagaaattcaaactgaaagtaacattgacattttattccttacatatacaatttctgcttaagcttgcctaaaattgtaacaaccatgtggctttttgatattaaatactgcctctctctgccccatcgttacttcagttttaaagactttatggtcacacaaatggatagcagtctgagagtatagattctacctttgcgtaaacacacactgttcagaattttcatttacagtgttaaccaaataggaagatgattttgttagagatgagctctgtgtaatacatttaaacagaaggttactcccatagcaaacccaagaaatgtgccatcaccctttgctaaatgtggtgacttcattccattgccacccatgtgagtgctggtaggagtctggcgctgcctctccactggcaatggctggtggctgcaagtccaacctcattcatggacaggactccaggaactagagagac

SEQ ID NO: 127005 - DNA, 1019 bp, Homo sapiens
tcattatatggatgctacataatttaatcatttctgatttttgccattagaatgggtcttgcagtaaacatcttgatacacctctttctgtggacttgtacccatattgctgtagaataaattcctagacgtgtaattgttgggtcataggatgtacacattttacattttaattgatacttgatcaattatatattgagattttcaaatgaatattcatgttgttttttattcctaatgttgctttttcctttctttttaacagttcaaagaaaggtaaagtttgtcttagcatttcccagtggttctataaatcaaaatgaattttaaaagtatgtggctctcaagtatctactaagactaaaggtctttcaactccattcatgcctgaagagcctggatgcctccagggttactgctgaagtagcttctggcttcctgagcagtgtgccacttcttcccctgtgtccttaggttcttacttgtgtgtgagaggcatgagtcacagtatcagaacacaagtatgtgggagcaaagacctgagggctggtactctgtattgtttttttccttctctagaacataatattattttaaaatgaacaaaagtaaacactaggtagtgatcaagatttttttcctccttctgttgtcagtaatgttttattatacacccacctcatactggaggctacagttttgtccatatccttggcatttcatatatatacagcagtgagactcctgtgctttgttgattataacttttcatagaactgtggggatcttgctataagcacaagattatacatgagctggaagttaagtacagcacgattataactgcattgtctcctatatactgtcccactagctttcaaaaattatatctgatcaagccccaatccagctttaaaactctgagtacttcccattccttgcaggacgaagtccaatctccttatcatgttgtttctatcctcaatttaccttccaaccacattatcctccaccccctt

SEQ ID NO: 127006 - DNA, 1037 bp, Homo sapiens
aggcatagttaagagaaaggtaaaaaagtatgaaccttagttatcaactgatgaattcaagtatacttactgatattgtaattataaccaaaaacctcaggtgtattttctctatacaatcaaatagtctgagcagaaggaagatgagtcactgagtacagacttctagaaccagggatacctgggttcacatcccagtctcacaattctcaagctgtggaacctggggtaaatttctgaaccttaagagataattatcttttctttaaagtgaaattgattgtgtctacccaacaaggcccaaacaaggaatgaactcaatagcatagtcaaagtatggtaatttacacatagtgccattccataaatcatagtgttgtcatatgtcttttttattttattgaggtataattgacataaaataaatgacacctgtttgaaatgtacaattttagttttgacatatgtgtattcctatgaaacatcaccacaatcaggatagcaaatacattcatcactttcaaaagcttccttgtgcccctctcggttccctctcttttgcccctccatgctacctcatccccaagcaactactgacctgctttttgtagtaacttatctattactgtacataagtttacattttttagaatttgatatgaatggaatcatgtagtacatagctattattattaatcatatactacatagttttttggggggcataggggcaggggattctgtcttgacacaatatatttgagtttcatccttattcttttgtatatcaatagtttattccttcttattgctgaatagtattccattgtatggatatactgcagtttgtttattcattcacctcttggtagacatttgagttgttcctgggtttggctattgtgttccatttacctgtttttctgttttgacaccagtaacatactatcttgattgtcatgttttataataaatcttaaagtcagtaagtgtaagtcttccaactttacttttctttttcaaagttgttttgacta

SEQ ID NO: 127007 - DNA, 1050 bp, Homo sapiens
tatggtgatcatgcgctgtatcctttatccaagacattcataagacagaaacaaggattacagttttcaactactgacggaaactcttacccatctaggtcaagctgttaatggatccatttgactgcagtcactgaactcttgagtttgttcccaattttgtgaccttatctttatcttgtctacagtagtattttgaaaggccttcatatgtgtaaaggctccctagccagcaggcctgctaaagaggaagaaagtgtggtgcacatcaaatttttagagtaataaacttgagaggtatgaggtgttaataaacattgtcagggaaatagcttttcacacgggtgctatgactccatttcatactgacttgatggtttctctcttaattacccaagatgctttctgaacaccatttggactcatgagttttctccagagtcaacctcaagtgtattgatttaattagcacttgtttcaacttgatccttctgcatattttggcaaaacttggcaccttgcaaaattggaacataagcaagctgtaaaattcctggggagaggcacatggagaatgtcgtccaggagaagtgttcttcttgtcatgtattctcttttcaaagaaatctggttttagtctaaaagatttgcaaaagataatggggttacagggatagtgacagttaaagaatggaaaattaaagcatacgtatgaggggtttgattttgtgaacgtgttaatttccggaggttcttttgtaaggcatagaaacagcataatataacaaagtagtgttgtctctcctaccacctctcatttacccacctttaccctattctcatgttaataacaaaaacctgagacccagaggtttctaataccctgtatagactgatgtcacacaccatagcagtagcacagactagaacctgtatctccttattctgattgtcctgtgaacctaatgcctttagtgtatttgaattcagaatctcttttgtaaagaagagataggagaattcagctgtgttatgagctaaacaggcctt

SEQ ID NO: 127008 - DNA, 1135 bp, Homo sapiens
aggttattgtggcttacatttaaaatttttttgacatatcctcttgtttttacaaatcaagaaatgagtttttttaagtcatgaattttattataaaaggacctcacttgtgtttgatcttccatagaaacaaagagcttctgcccttttgtctacagatagaagatgacgaatagcatactaagtagtagtatttctgggtgctccataccccaccctccacaaccaagaaaagggaaaaacaatagaccaaataaaatactcttaaattgttgacagtatttgttttaaatgaggtcttctaaaccactgtttaaatcccatgtgtaagtgcaagcaaaggaagttgtatctgacaaggcacctggcatagctatgagacccaataatgagattgctatgaataaagacctaaaatgaccagtatcgcccattgcaccattttgtaattgcccgactgaaattccttcatgcaaggaaggctgagagaacatcctgtaagttttcctcagatgacctgacctagcttagggacccagtcagcctgagcatctcatggtactgttgtcgaaaatgactgtttatagaactgtttacttggtggcatgctattctgtggcccttgcaactgtccattatttccttcagttgctataaataactggtatttcctcttcaacaacaaaaaaaattcatcccactgggaagcaaattgatgggcaaatctaatatattaaaaaaaaaaacattttagagcagaatgcagccagctgctggaagaattcctcagcttggtctctgggcagtatcatggagaaattgaaaaatataaagcaagatgacacttcactggctgattaattgtctgggatctgctgtgctcacgcagcttttgtgtggctttaatgatgggcatgaacttctgtggaataaggctcgtttctgtccctttccggtaccaccttgtaatgcgaagtctacactgtccaggaaaattgttctttcagacatgtgtctgtagttcaggggagtacaaaagaggtttttttaaaagcacttccttctcttttttttttccctttcttcctctggctttttaatcttccataatagaaaagggagagatgtgtgtatt

SEQ ID NO: 127009 - DNA, 1102 bp, Homo sapiens
tttaaacctcccattttgatgtcagtattttttagggcaaggtgaccttcatctacttctggaataagtgttggcgcaggaacgtgctccaccagactagggttggaggagagatttgggggttggaagccaggctgcctcttagagttctgctcattttctccacttgctatgaacctccttatgaatgggaaactcagatgttgaagttggaaaagtgttattcagatatgattcatatagattctgtcgatttcgtcggaatattaacccttagtttaaaaccatgatattctaaatttgggcttgttgcaacacatcagtttctctttattctatttctattctgtttttaactcgggtatctctcatctgttttaggtttagcagtttccttacagctattgcacggagacattgaacaaatcagaagggaatattcatcagtattttctcatggagtatccataacaaggaagctgggattttcaaatattattatgcctggtaggtgacttgggacgtaccgatatgatgaaatatgggtatactatctgtttttgatgtttgagaaatttttcaaattgccagctttgaagcattcacatgggccatgctgaagaatgaaatgaggtatgtgactgtaagtaagcacatttttttctaaaatatccttttcagtttaattttaaaatatttccttttgtataaactttcttgtcagtgatttgaagctcaaaaatgtctttacattctgattattctaaagttgttaacttgtgggggccatggctacatttcattatgaccaggagaaggaggaaaactgagttactgtccagaaaatattgtactccttgatggaaaatgttggtgaagatgcttagaggatatcctaagttttgataaaaacgtactgaacactagttagccatatgtaaataagcagccatatgcaaatattatatgtacttctataccttttctagatctatttgtgtgtatgatttagatctatattagtgcccccaaaattccccaaaagtagaaaagatgtgggttaagcagttttacagtgtgacatgaatgccagattcattga

SEQ ID NO: 127010 - DNA, 1046 bp, Homo sapiens
ctacttgtgttacagattggagacttataagaccataaaatatgaagccttctaatagatagttagcactcaaaatatctttaatgttaattaagtaatgtgacataaaacatgaaaaagaaatcttagttacagacacatgaaacatgttatgtcatatttttctcttttagtgcatttatttctacctcttggaataatgatattactgatataaaattgtattcaagtctttcaaaagttaatgtctgtttgtatataggtgctttctgcttttgtagttgctgctttgccagttttaacagaagtgaagcaaatatttgttgtcttcggagctctcctaatttatataagcaatgttgatgttaaatgaacaacctaatatttagcttacctgttgtgatgaagagtagttacagagggataaatctttaactattaaataattttcaaattgttaaacattttttctcttgtagtgagagatttttcttgaggctgaatagaaacgggcttcccaaagcccctgataaaccggaacgacattgctccctctttgtggtgagtggatcttgtttcattcataaggcagattcatccagttatgattcatactatttaggagaaataaattactgtgagagaacatagtgaatttgcttttaaactttatgtaaataacacacaaattacattagtgcccagaattctgaatatcacctcccaggattactttcattcctttagtgtattactgcttctgttatactattaccaaagtataacagtgattgcggggcacggtggctcatgcctataatcccagtactttgggaggccgaggcgggtggatcacctgaggtcaggaattcaagaccagcctggccaacatggtgaaaccccgtctctactaaaaatacaaaaattagccaggcgtggtggcaggcacctataatcccagttactcgggaggctgaggcaggagaattgcttgaacctgggaggcagaggttgcagtgagctgagatcgcaccactgcactcctg

SEQ ID NO: 127011 - DNA, 1002 bp, Homo sapiens
gttgatagaaaacatgacgctctccctgtgtgatctcctctcatcctctctcttccctacttgcctcatttctccttattctttgtaaggcacttccttgattctactctgtgggctaggaaacctcaaaccatgggaagatgtacctaggaattaacaaaaccaaatagaaataaataagactcttcacataaccaggacgccaggaagctaacagaagctgaacaatcaagactatgggagaaaaaggcttgtagattacaggtttctgaggctgcagaatttctgcactcattctgcagccatgtaggtcacctgtcttcacgtatcttatcttcctcctgcatgtgactgatgtctgaatttccaagttcagattctcaaggaaggaatcttattgacagccaatgtctaatattcctgtttgggctgagcattttataccagcctctcataagctgctggccagtctttgggttatttgtccttaggtcaggtgcttacccatggtacaatcaggtgtggctcaggaaggggagatggtcagatgactaccttgtctgccaccaccactcccagcagagaaagtggatagagcagcttctcatagaaggagctatgagtaagacaagtatcacagtggttatatgccctctttcatttgctaaatgatcttcatcagcaatattgacccagtgtcagatgctgacttacactgtagtacggtggttctctttcagaagggaatggagaatggaaaacagaccctatcagaatccctggtgagatgtagcaagggggaacatggacattttgaaaacaaatcacagtgtttattgtgagttaaaaattcaactaacattaaataatgggtgtgtgaatttttttctaggtttcccaaagagaaacatcatttaggaaaattgagaaactgttttactatctgaaagacagctcctactgtcaaggaggtgacagctttctaatcttcttaagaacaaa

SEQ ID NO: 127012 - DNA, 1428 bp, Homo sapiens
ctgtgtgttgtaaactctataagtaaactcctttcctcctagtgttctgagtaactgggaaagagaaaattatctaaatgtttccctggacactggaatggtagtcagtgccattagaaacaaatattaagtttaactcagaggtattagatttttgatactaggagtgaagctaccttggccatgtcagacctttggtttctcttttcctaatgtaaatgttttgtgccaaatgttttggttcaagttcctcatgctcaagtgtgtttaggttattgtccatcgtcttttccaacagttttaaggcacctagcttctctactggaagatgtttgatgggggccataatattttataaattgttagcaatttatatgacaatgcttagcataaaagcacatggtgaatgcttgaaaagtgctagttgctctttaaataacgttgccaaggacctaaataatggtctctaaaaataccacttaataatcagtaatgtaaccacaaaaagtttaggagaaatatagcagccatcttttactgagtacttttgtcctgtccctgagctggacattttacatctctttttcctggggctctgccaggcactttttttttttttttttttttttttttggagacagagtctctctctgttgcccaggctggagtgcagtggcgcaatcttggctcactgcaagctccgccttctgggttcacgccattctcctgcctcagcctcccgagtagctgggactacagctaccaccatcacgcctggctaatttttttgtatttttagtagagacggggtttcactgtgttagccaggatggtctcgatctcctgacctcatgatccgcccacttcggcctcccaaagtgctgggattacaggcatgagccacctcgcccagcgccaggcactttttattcttgaatcttatcaatgataatttacctagggtctcatgctgaagcctgaatctaaatctaagtctgctgctgccaaaacctgtactgttttcattttaaggcaaataaaagctcatcgctttctaaaacactaaaatactctcaattaacttttgctgtttttttatgtttccagaatctcttgatattgttttattccaagtgtttaatattgtaccctaactgttttcatttagcattaaatcaaaagcatttttcatatatctgaatagccttcataactatccagtgtttaaagaatcatgattttatgaccagatgttcagttttagaactttttcttacactagtagagtaggtttgctggccaggcctgcagtatgtcagcattcttgccacacctgggttttcttcccttaatggagagctgaccaactgattttcagctttataagggatcctgcaaccttttcttattagtgttctcttaaactta

SEQ ID NO: 127013 - DNA, 1027 bp, Homo sapiens
caagtgcaatgagaggggcttgcattgggtatcatgggagttccaaggtgaagccccagggttgggggagttggctgtatgcttgtgtaggagtagccagggaaggctttatggtggaggggacactctctcagttgagtctaaaatgatcaaacagtgaatggggctgttctcagcagaaggaaacacatgagcaacctggagttaggaagcagcattgtgagtgataggaactacaaggatctggtgttgctgataaagaaaataaaagatagtgagagaagagaccccaagtgaggcaggcagtgggccaggccacagagggttagcactttatttcattggtcttgaggatccattgaagggttttatgtgagagggatatgattgacttcgtttggataggtcataccggcacctgaatggaggaggaatcagaggggctgagaggcaggagctatcattagggtggctgaaaaaggaacttatcacactgatagagttggctatcctctccttggccagtcagcactttaaactaagaccagaagggcaagaagtctcataggtctcactgctaaaatagctcagatgcacagtgagtagctactccaacccacggtataaatcggaagctgggtctgttgtattccttgtcctcatccagggaatcttggagcttgtggtgatttcccttgcatagagcctaattggaagctcagtgagagcttagagaactcaatgagaatgaggtagaaaaggcagctttttattattattattattcatcactgaatccctagcacccagcatggtgccggcgtatggtagatgctgagtgaatattgaggatttggcttatgtcagcatttggaagacatctgtactatcatcaatgtcactaaatactttaggttggtcttcaacatttctgttgattagtgctttctcaatgacccagctgtgttatgcaaactaactttcttaacttgggaatttggttattttgtgagtgtatttagtagca

SEQ ID NO: 127014 - DNA, 1058 bp, Homo sapiens
gcaatgcactgggctgaaggccatccttatttgctaggtgtctgaaccaacccctctttccacatccttggatccagtgtcatcctttcttgcttttttgtgattgctagtgtctgattctttgatctagttgttaatagatagtggtagtatgatgctcctctatttgtataatcttcctgctgtttttccctctgccctgttctggttggcagtactacatgaagaggacagataggcatagcttcactatgttacactgcaaatcacgagagaacatggaccagtgacttctgccttaaaaggcatcatccttgtcctacattgcacctcttcctgagtatttgccatagattgtggccagtgcttttacaaatgacaatcgcccaaaattcaaacttgcttttaaaaagttcatgaactgagaaatctgaggagctgacttagcctattgctgcagcacctgttgggtccacgagttcattgtatcatcagagctctctccatccctctgtgaagacttcttctagcaagctttgtccatgtggctctaggctttcgtctgtctcagagctcaaagtcccaaaagatgaaagatctttctcaccaactctggttaaagtttgaaggaagagtctgttaagacttttctcattgcccaaatgagagggtgtagaatgtgtggggcctgtaaccctcaaactacaggaaataaatataattattagaaaagatgaaaggcaagctgcaccaacaatgtgtgttcactacagccaccttgctcctgtttcatgatttttgtagtttcattgtggtttagaaatacttgaaggatgttaatccattatttagctgcattaattgaggcggcactaacacagccaagtgggttattcatagttgactttgagcaggaattttgtttgtacagttgaatgtatgtctcagatttgagcatttgctgttcaaatccaacatgaatgctcatcccagcccttttctcagtcttgaggtgtgttctccttagaaaacagattcctgtatgcttgctgttacac

SEQ ID NO: 127015 - DNA, 1035 bp, Homo sapiens
gcttgcctatcaactggagcatcttcacattggcagctgtattcccctatacgcccataggctgacactctcattccagtggggtacagcttgactgtccagaagtacgctatctgatgcaaaaggggcaggctgggtccaagcaaatatcttctctttgccatagaatcacagaattttagggttgtggggggatggggtcatggaaataatgtatgtttggtccttcattttattgatgagaaaaggaaactcataagtgggaagtatcttttccaaaatgtaagttaataacagaacaggaaccacttactaaaaagtctttttcaatcctgtgttacccccatggtgaaatggaacaagaaacagatgggtagagtagaaatggtattgggtttggaatctgaagatgtggattttatgcccaggtttattgttacacagtaattatatgatttggcataattaacttccagcatttttgaaattgttttttatccatggaatggtgagtttgtcaaagaccccaccaaccttcatctgaaatttgttgtgtattcatatacattgaattacagcatattgttatgcttaaaaatctgttaaaggttgtgatttgattaaaacgttggctaatatggaaatataccatgaccccattttcttctctcccgtattccttcaggtcagaggaaatacatttttaacttcataattgcatattcttatctactctgacagctacacctcagggtctcacctcttctgaaaagaattataataattgggcattctgtgaccttcctgtcacaatagatgggtattggagactccagaaggatttttattagtagtgttcaacagtatttccctgttaaacccaagaaaaatagttcatcagacatctcaactcagagctgcatctgagcctgagctggtatatgttatcattgtcttaccaaaaaattatatttgatcatttgtcaaaaacgtaaaaaaaaaattacctctaaatccgtcatccagagataacta

SEQ ID NO: 127016 - DNA, 1019 bp, Homo sapiens
tgaactgtcctcttcattaccatcagtgtggcaccatccaaagcagggaattgcatgtgaggctcccaatagctctctgttgcctgcagaaaacatttcttagcaccagcaaaaagtccctcctccagtcttgcctctctttccctgcaaaaattattttcatgagcaggctctgcattttatatgttgttggtactttctcctgggtgaataccttcttttaagtgcctggctcaactattaggtcttcagtgtctttccctgaccccactgttatatttttccacaatcagtgtttccacatttattatagcatagtacagatagtgtatcagtggagtccaatcagggacagaaaccacaacagttacttgaacagagatacatcaatataaagaattgttagctaggtagaaaggtgatacttaggcaactgacaaggcaggaagaggaccctaagggatcaaatgtgtttcaactgcaggaaagagattgggttatttgaacatagaaacttagaggaggagccctgtagagctgaaatagatctctgagaagagaatactgctctactagtgctgctgtagctgacttcagaagatgatccctgtgggcctgggatccaggtctttaaggagggttggccagccagctgttggtgagatctctgggtagaggctggggtcaggatgaggctggttttgcaagtgagaaaattggccaactggattgaaatgctgctagagagaactgcttctgcccagatgaagtgttgcctgggtaacacaggaaccacagacagacaagaggcaaaatggaaacatccatagacaggaaggagtatgtcccttcttccttctcagccttgcagtcccccactagtatccccatggcagatctaggagccagcaactggcaaagcagaaatgaggtttgcagaattgttagcccagcatcacagaggaggatgaatttgtagttggtagacaaaggtttaataaccgacacagaagaataaa

SEQ ID NO: 127017 - DNA, 1028 bp, Homo sapiens
agggagattttctaagaaaacaaggattttctttcgttttcattatgcatgtcttgaaatttcctgcattgctctatttgtgggaactgaaacattttctcagcccaagcatcatgtgactgtttcttattgctagtcagcagcatgaaacctcagatgaaagtatattaactgagggtctggtagaactgttcagcaaagctaagcagactttatttaaagaaaatgctcattcccttttgctggacacacaacttctaagatccatgtatcatgctgctaagtagtggctttgggatgctctctgtataaatgaaattttctagtcagctgaaattcaaacactaaacattcaaatattttagtagctgctgatataaattgtactgaaatgtaatggttttaagcggaagcaatttaaacatcttttcactttttctttatgattgcatcagtcagctgttgctccataaaaatcaattccacaactcagtggcttaaactaattttcattcattctcactctctgtgatagagattggctgggcatgttctgggccaggcctgacggcatgactctacttcatgctgcaggcctgtctgggtttaggtcctcactgtggattaagcttaggtctgttccagaaatgtttattttgagggcccagtctgaaggaagcaaaccagcgaagctattcctatggtcgtggtaggagtacaagagtgttagcccaactgtgcaagcgcacttcagctgtcaactggaatcacatctgattccattccgttggtcaaagtaagtcaatcactaagcctaacagcagagcagggaagtatacttattccatgaggtggttagggaaaagtgattatttgccaaataccaatctaatttaccgtactaaactaagcctttggtatgatcctctaacaaggttccatactatatgtagttattattcatatctttaatatccctgccatcagttctgacttttcatcttgttcattctgtgccacggaaaacc

SEQ ID NO: 127018 - DNA, 1033 bp, Homo sapiens
actttaaaaagatcatagagtctcctgtttttccaggttataaaatatggttacttacatatgcagatgactagattatttcagaaatagataagaatggtttgtctaaacagatatttttgcaatgttagaggtgaattgactttttctgtttagctttcatatagtttttacttgtgaaaatatgtttatatctcaaaattattacaggatcttaatccataactctatattgtacagaatgtctaaatgcataatttcttccccccaatctcaaaatataattagaatcaatttagctgacagagttcagattttgatatcttattttataatttatttatctttttagaacctctaatgataccatataattttcctttatagcacatatcacccatgataattatgcatttatttgtgtgattgattcatgctatctttaccttgagactaaaagctaaaatagaagttccaggggcttatccttgaaagactaacttagaatctccagaaagagggtcttaagaatattttgtgattcttcagttgacaccataaaccttgatttggaaatctcagttagcaaaaactgatgccagctttcaagatttggattagttcaatgaatgcatttaacactgtattagtcaattctcacactgctataaagaaacacctgaaactgggtaatttatttaaaaaaagaagtttaattggcccatgattctgcaggctgtacaggaagtgtggctggggagtcctcaggaaactttcatcatggcggaaggggaagcaggcacgacttacattgctggagcaggaggaagagcgagaagggggaggtgctacatgcctttaaacaaccagatctcatgagaactcactcactatcatcagaacaataaggaggaaatccatccccatgatccagtcatctcccactaggagattacagttcaacatgagatatgggcagggacacaaatccaaaccatatcaaacaccaaaccgtaatttagtatttgattca

SEQ ID NO: 127019 - DNA, 1057 bp, Homo sapiens
acacttaaattcatgaaaattgcttattcaattttcttaaggggatttactgaaatgctttcatttcatggttgtgttttaaaatttcttgcttttattttgtccttctctacatcaatgaactttatacaagtatatcaagttagtatgcatggattagaaaagataccattttttgatagagttatcaccacaacaattatgagaaagaagacttctgtgaaatgtttgctgaattctctattcataggaatcatagtcaaataactttaagaaatgtcatgggtcacttagttacatattctttctcttaatagattaaaattttgaggtttgactcctttttgtgtcctgttcaccatttctcttgatttaaaactaaatctaaactaaatatttcttatagcaattaaaatcccttaccctccccaacttcttccctcttaaggcttttattttcctttatgtaacttcaagtctttatgtgttcctcagtgatttaacattgccctctcaactcaatttcattgtctttctttgactcctccttgctcataatccatataaaataaagaagccaaatgtcagccctataccattgaaagactgatcaatggtaagtaaagtagaaggaatttttcaggattgcaaattatccttttgctgtacaaaagttcacaataaaagtcctgtattaggctgttcttacattgctataaagaaatacctgagactgggtaatttataaagaaaggaggtttaatcagctcatgattctgcaggcagtacaggaagcatggtgctggcatctgcttctggggaggcctcatggagcttccaatcatggcaaaagacgaatggaggagcaagcacatcgcatggtgaaagcaggagcaaggggtcagggaggtaccatacatttttaaacgaccatatctatcatgagaacagcaccaagccatgagggatccatccccatgacccatacaactaccaccaggccccacctccaacactggggagttacaattcaacttgagatttgggccaggacaaa

SEQ ID NO: 127020 - DNA, 1040 bp, Homo sapiens
ggttaggacttctccgggctccagttctcattcatttttcagtacttccatggctactgtcttgttagaaaaattatacccttttcttgctttgcatttgctctccaagtttggggattttgatctgagaattgaaaaaaaaacataaaagtgaattatgtgctattttcctataacttgatgagaaaatgataaacagtgattcataagtttaagaaatggaactgtttcatgtgacttgagtttatttgtagatatttgaagtgatttctgtagtatcaggtaaattcagacatgtcagacatgtggacaagtcaatataaccagagacagaggtctaggcatctgtggggttcaataagaaaactcttaaacattttttaaacttcttattttactcataactttaaaagtttattggtataaacagaatttttaaagggctaacctattgtgtaaatggtaatttttgacacaaagtgtttagaatacttaaaggcatttaaaaaaagtgtttggcatatattaactcagttatttcttatgacactcagtaaagtaggtacctgctgtagttcatttgggctgctataacaaaaatatcatagactgggcagctgaaagaacaaatattttctcactgttctggaggctgagaagttcaagattaaggcaccagtagattcagtgtctggtgagggcctgttccccagttcatagatggcaccttctcactgtgtcctcacatgttggaaagggcaagggagctctctggggtcagttttatggggtctgtttttaaagagcattcatctcattcctgacgactctactcttacagcctaatcgcctcccaaaggccccacctcataatactatctgattggaggttaggattttaacatattaattttgaggcaacataaacattcagttcatcgtggtacctttcccaaggccacacaactagaaaatggcagggctgagatttgaaccctggcatttggctccagagtttttcctcttaatgactattttct

SEQ ID NO: 127021 - DNA, 1218 bp, Homo sapiens
tgctctcaaggtggagtctaggggtccctgagacccttctggagagtctgtaagggcaaaattattttcatgataattgtaagatgttgtccgcctttttactttggatttgatgtttgtgtcaatggtgcaaaagcaatgctgggaaaacttctggctacttagtgtgaatcaagaccctggcaccaaactgtagtgattgtaatttttacctctttttgttcttgcagaaaaaataggagtttcacttaagaatgtccttgatgaagcaataaaaatctcagtccctcgggttcacatctttttaatattctgtgggacaagataggaagcacacataaattacttgtgctgtgtactagagaatgctggttgtcttgaggaaaaacacttccacaaatattagagtgaaaacaagtgaactagacagttttttcatggaatatcattttacttggtagactgacacacaatagttactcagactttggtgtttgacagacatttttttggaaatgaataacaagagcctgtcacttcaaggtaaacagttgacaacatttattgccaatgataaaatttgaactttcaagcaaaaatgcaaattttggaaaatgtgttatttctgccactgagaacataacagcataccaacacttttagactttttacttttatattgtataatgaaatgcatcaacatttggatgatctgtattacaggtgaaccaacattttccagtattagtggtggggaatgaccgtgtcatgaaggcttgaccaggatggggatagctcaaggaggcaggatggctcattgtttatgtcttcttcaggaacacaatgaagtaggttgagtttccaggatttggcccctgcattggggatggttggaagaaaagccaaaaaccatagcttcttcaagccagtggacttaaaaaacagtagtacttttaaagaaacaaggaattcaaggcaagagctgtttgtggggctaggggtaaagaaaaatgatggctttgccaaaatttgctaaatttatatcaggctgggtcctgatacacatttctaaaaatccaggcgaagcatggtggctcatgcctgtattcccagtactttgggaggacaaggcaggagggtcactaaggccagaagtttgagaacagcctaacaacacagcaagactgtctctacaaaaaaaaaaaaaaaaaaaaaaaa

SEQ ID NO: 127022 - DNA, 4225 bp, Homo sapiens
aaaacttaaatgtggaaaatattatctaatattgtttgcagcatttttttatagtcaggagtaaatgtaaatcaaatacttatagaagtgactggagaaattgattttaatatagaattctatactatatactctgtaattcaaaaagaagagagtatcatctgtgtttaataagagatcagatataattttgcaccaggaaggtcatgactttgataagagcagtttcagcgcatgagtggggtcaaaaccactggtctctcaaagaagaataaaaggaaaccagaaagggatttcatagaccctgaatatctgtatgttggtccatgagccttcctgcctagagttattttctttgctgtctgcaaatgaaatctaatttttaaaagttaaaagcattcaatttgttgctattctctctcacattagagtggggtgaagatttcctgaacaagggtgatgaaataatgtaggtgggaagcctagaagggaaggtttctgaaagttaaagaaaattgaacctaatgctaagaggtcagtgaccgagagaacataaagtggacaaaagagagaaggaaccttgcccctgtggatttgtctaaagctatgttaaacgttttgttgatggagatggacctttgtaagaagcactaggagcctgtgctccgcagaacacataggggaatgtggggaatctaataacaggatagcatcctgttactactccctagaaggaagaagacttcttggagatcagagtctttatccaaggatacagaaaatatcatatctggtagagaaataccatgagacgggaagggggcatgagatttggagtcaggctgaccaagttcagatcccagcacttccacatatgagatgataagagagttatttagttttgcagttttatcatgaggatataacatacaaaaatatctagcactgtgtctggcatatagtaggtactcagaaagtgacacctgctagttaataaatgtctcctttatgctaagatgactgagatcatggggtgaattcccttgatgccagtctcgtaggctgaatcctctgttctcaaagaatgaaaaatttaaaggtacttcccaatccccctacagtcaaatgactgcagtgacctaactttgataattatgtatttcaggccttggaatgtccaactgtttctccaaatgttgaattattctaaaattagcaaagacttgttgaagaagctcacaagatcatggaatcaggcctctgaggtcattaatattcagtagatatattgcttatgagcctggaaggaaagatttgcaattttatatagtataatatagtatttgctcttggtatcaacctaaattcataaacagatgtgtatatatctctatttatgtatattgaagtctgtattgtgagggtgaataattagaagttgactttatgtcaaaccaggtttatagaattcagatgtgtccccaaaatttgtcctcttctagatatgtccatttacttttagtatgactagtaggaacataggggttttagtgtctgattttgaggatataaacacaaaaaaagtattttttctcttttgtctagattactaatccagacaatgtaaacctcacccaaaatttgtgaaatttgagaccggatttctttttcatggcattacaacattattttaaaatagcgctactaaacagttttatcaaaaaattccaacaaatgacatgtggcccagtggatgaaaaaaaattctgcaattattaatagatgtttttactgttcagagttttagctgttatttgtttagtaatgttggtgtttgtatgtaggctttgaggcaaggggactaattaggaattctctgtaataatttaagtgaagcttaaattattaaaaagagcaatcttgtaatcccagcactttgggaggccgaggcgggcggatcactaggtcaggagatcgagaccatcctggctaacatggtgaaaccccgtctttactaaaaatacaaaagattagcctgttgtggtggtgggcacctgtagtcccagctacttgggaggctgaggcaggagaatggtgtgaacctgggaggcgaaggttgcagtgagccgagatcgcgccactgcactccagcctgggtgacagagtgagactccatctcggaaaaaaaaaaaaaagccatctacccatttattgagcactaaatatacgccaggcactgtgcttcctgcctttgtataatccttacggcagctgcatgagatgggttccattattatccccattttatagataagggaactgagactcagaagaatcagtgagttccccaaggccacagaagggtggagctgggatgtgaacccaggtttctgacttcagaactcagacttaataaccacccggttctgtttccttatgaaagggctgtgtctccaatgttcgtttagggcacagttgcttggatttggcacacatgttgccacagaacctatatttcaatcagtgttagacgtttgggccaatattaatgtgtcagaggtgtctgagtgccaacagcactgtagatctgaagccatcctgagatggtgttgggcttttaactttggcgggccagaactactctttcctcagtgttgtcttgccctggacatatttgccctttattgtaccccttcacctactgcctggactggtggggatctactgccacagtggggtgggggcagaggctaaaagcggcagggtggggtggaatggggcggaggcttctatctggcaaagcttctgggattctccatttattcagttctctgtcttcctctgcttccctcccaccctgctgttttcacttcttgtcttggagagtgagtccttctggatatctcttctgctgctctgggtccttgatggaatgacataatgacttggccattgtctatgggtgtttttactgccaacaatgattggaaacagcgagccaaagtgactagctctggtcccatccctgccccattttttcacatagatacacaatttcattagaaaaagatgaagatgcgtacgagctatatgtaggccactgaatattcagacttatagggaaaggcacatctacatttagggaaaaatgaagttttgagtcttctgggtggttattgaagaaactgggctctgactctgtatgtacaacagatggagagtttgggagcatggcaggggtgagctggagggctaacagtttctcctgcttcctctccccttgccaaacaggcttgtttgccaaactggcttgtttcattcatagattgaagacaggctcaggactggggttgaaggggttagaagagaagatgatcttagcatcttggtctatattactgaagggaaaaacgtaggaaggggagtttgaagtatggagagaagtcccagtggccactcaacggtgaggtacagaaggaaggcttttttggcaatggtttctatatagagtcattgagtattagttactctatatttatacgaaatgtgaattttattttggtgtagtatctttgggtagattgagaggccaaaatatttatcttgttttcaaattactctgaaatcttacttctttactttatcatcatcttgcctgtctcttttgaatgattttcatttgaagcagttcaattaaatcttgttaagtatgacaataaattacttagtgattcctataaattctctaaaatacaagaaggagaaaattgaatatagcccaagtaagcagcagggatttttacagaaatgatttcttcaatcttgtctccatggttctgttgttattcttttataaaaggtctcaagaggaggagaaaaaaatataggagacaaaatatatatatatatattataaataagaagtctgcaagaagatcagagatttttgtggaaaatggggacggttcaataagcaaaatgaatttccttacacaatagctctgtattttgtgtagaaaatcgtgcatggattttcctggctctggaggaggaggccattctttcttatggtgatatgagaagaaaggttttaaagagttgagtggagagaggcttttagaaagtgcagtgatgtctttggatgtccaggattgactcaaggtaaaggaagaggcatgtcatgaagcttggtcttagacctaagcttctatttggaaatcaaagc

SEQ ID NO: 127023 - DNA, 1164 bp, Homo sapiens
ccacagcgcttttaaaacaatctcaagtgctgaatggagagctgatctcatctagtgagcagcatgtatctcatgctgtgagttttagattatttcaaagaacagaagacccctcaaaaactacaagaagcaggatcacatttgttagttttaagacatatttatggcatacggccggccatttcctttatgtcacgtaggttttcactattatcagcctccgtatttctatgccaacttgaccattgtgagaaatgaccctatttattgtctaaaatactggaagtcaaatggatttatttttggtaacttttactgaggtaatgacttgacataaaataaagactctgttccagagactgtgaattactgcccacgcaaattcaactttgcaatgccattaatattttactgccacagtgaacaaagttgttaaatttaagtcaagaattattggttccttttggtaggacgcgtctgtatttttactcagcctctgtacattttatttttccccacatttactaacttaaaacatgacctacgtttattttgagagtgtagaccagcattgagaaggcacatactcagagcgtatttttttctgattcaacctgctcttgagattcctttataatttgtgtattatttagagtagtgattttgatatccatcatcactagcttaattttacttgctttacatagaatccctgctttgcttagacagaaaaaacaactgacaaaagcatcacattattatacttattgggagaaccatgacatcttgtttatgttaactagcaaaagacattcatgtgaggaagagaaatataatgtaggcatcttaaaatataaagagaagtgttaagagactccctgtcattggtgagcatagtgggtgtctatctttgagctttgagagttaccacctgtcagatggcaccagggactttttggacctggtacccacttcattccaggctcatattggctctccccaacgggtacctgtactgtcacacagcccccgtcctcatcctgtagtgctccaagactgggatgctgtccaggcctgcagcttcctggattgctctttccttccaggtttgccaggtgacctcttacccaacattcaaactcggctcaaatttccctgaatgcg

SEQ ID NO: 127024 - DNA, 1084 bp, Homo sapiens
cccaagtagaagtttaaaccaggagtaaattctgtaaggccagagagtattctgcccatcctttaataacctttttgcatgtgtcccatgttccctcctactttctgtattggatactttcaatatccaataaccaaggatattgaatggaggtgaaatagcaagaccaaaggcctttccccacctccccccgccccttttttctattaaagcatttgcttaactgccttgcttgtgtgtatgcatgcctggtctctatatagcttcctgttttaaggtcctttcagggcaggcatgccatcaatctttgtgttgtttctagatatcatctctgtgtgaatgttgttgatgctatttttaacattgcatcctttgtgtgagctgccacaaggctgggatgaccaaatgtcctgtttttatcccagatttttcctggttaatttccactcttttgtttgtgatacctagacatccttttgagatggcaaaaggattcgtttctgcttcattaactgtgatgaacctaaattcaagcagaactgtgcctttgaaacagtgtgacttaaacctcttcagcaatccctgtagttaagactaagcaaccacagagaaaatgtcctccggctctaaagtagggggccagtttacatggatttatgagatcctatcaaagtgagaagtaacctttgtggcagtccactgttttcctaatggtctaagggctgccaaactcccaccccatgctcgtttcatccttgccttcaatgcagatattaataaatctgcccgaaatgagatttttgaaagcctttcaggctcacaatgatgatgcttgtatgaagggatcccttttttcttctgtctgacttagtcttctgcctccagaccctgcatattttccctgtaggacactggcgtctttctagggatagaatttaaaagcatctcctcctccccccataccaatagttcagtttgaaaccatgaagtgtgttacaaccccactttgtgcttttcccttcctccttttttgtgtcattagtgttcatgtctgtctctcctattacatctttaagggcagaga

SEQ ID NO: 127025 - DNA, 1026 bp, Homo sapiens
agcttttgcttggagactttgaaactcctcccatgccaaccttagaaaaaggctgattcgatgaagtctttctggcaaagcatttaagacccagccacttttcaaaggtgagttcctctgtaaagtcacctcaggttcttgctacaaaaaccaatctttgtgctaagtgtttgatgaatactgccatgttgtgattttagatgttggatccttggcttcgttatgtggacttctggctttgggaggtattttatcctgttagaatattatctcttccagtgtatttctctcattttctatatcacaaacaaacatataagcacattctaatatagtacgcagtttaagcgaagttagatgatattgaataatagattgttataaatatatttttacatacttgctctcacaccctccttgacccacccagtgccccatttttttttttcttccaagtaactaagttctgtgacttggatgctgtgacttggactttagaggtgaagtcagatgacaaaagatttccatgcaaatcatgtttccagaatcatccctcatgtgcatgtatgtctagtggaatgcaaggcttactagagggaggttgaaatttggtgtgcgttaaaggaaatataaaaatcctgcttaatgatcctgttaggtttgtatacagattaactgttattacacaagaaatggtatgtccgtttggaatttctcatcctctgaatagccagctttagcactgtaaactgggaagaattctgttgtatctctgaatatataatattgcattactgcgagccccgcggcccttttcccaaacaacatatgcctgcatgtgcctcagttttatgtgagccaaaccaatcttaggcctagcatatgggagtttattagtatgtgtatgttcctatgttgtttaagagagattttagggtctggagaactgagacgtggcaagttacaacaaagctttgcttagggatgtggttcatggatctcagcctaagtctgaacacttatgcc

SEQ ID NO: 127026 - DNA, 1023 bp, Homo sapiens
ccagttgctgaaaacatgattgtcctgcatttttttcttccttagagctggcttatgtcagcctatgggctgtttgcttgagcatagaaatagtggtatattcaagtgggaagctgagaaaccataatgacgaagggatggcagcgccatcctcttccagagcctgggaagggccgcgcagttgcaccatcttttatgccataggcattaatgaatcataagtctctcttgaaaaatttccatggagagtttctatgatgtacctgccaaaaagagatgtgttaacaaagcacttcttaaaatggtattttttaaaagttcaaataattaggaacagagcaagatgaagcagtagagcttgcaggagggagcagcgtgctcagtggccagagacttcacctgagttccagaaaatcagatttcagggctattggcgcattatcgtagccacaaaacgttggggttcatgttacctcttttgtccagtggtttgtgtgttcccttctcactgaattggatttgacattcaatttgaattgacagtgaacttcggggtaattcctttcagaaacctgaatcattttaggatctgggaagcattactctgtggcaggggctcttaaccaaaaagcccatcgctagaattctagggtctctgaatttggatgggaggaaaaacaaaacaaaacaaaacaaaaccctttattttcactgtgccctagctgaaatttagcatttccttcaattatgaatatagacagcaaataatggttgtatttgaaatgtgaaattgtacttgtgaaacatgctactggcccctagattttatgctagtagtcctattattcagtgttattaatggagaagcacaaaacgactctatcagaactttgctttttaagggttagataattgtatttcactttaattgtttttcattgtaattacatgatttttatgcctttaaaaacattattctgaccaggagtccataagcttcaccagctttccaaagggggttgg

SEQ ID NO: 127027 - DNA, 1048 bp, Homo sapiens
agcaaggtattgtgtcaggccagagctcctgaagaatgctccccgctattgcatgcccgtagcctggctgaagttgcagtgcaggatcttgttctttctagagggatagtagtaatgagattgacatgatgaaaaataccttgagtaggagaagtcttgatgccatgggctgcatgaagtgtcttccctttgtcaaccccacgccagtgttcctgggagatgagagagtctttatctcatggaggaaaacatatcagtgtctgttttagtagatctgtagcagaggacagttgtcttgatatattgtagactgtaccctatgtatcagctgccatcctgattcaacaagggggaaggaagttgtctaatacttgttaagcgtggaaggacatttgtgacaaatgtaaaacatcactgtagaacttcacattaatctgtatttcagaaagcaagtgcaaagaaaaaggagtcaaacaatgtctaagtagcatggagttgtgctcttagttgtgaaagcagcagtctcttgttcagtggttattgtaattctcagacctatgctttcttcatgtatgttgtttaaagattacttattcttttcatctaaaaacagtattttaaaaaaccaactgggtacaggtgcttatgcctatagtcccagcactttgggaggccgaggtgggaggattgcttgagcccaggagtttgagaccagcttgggcaacatggggagaccttgtctctacaaaaaataaaaaaatgagctggacatggtggcaaatgctcgtggtcccagctactagggagactaaagtgggaggatcgcttgagtctgggaggtcaaggttgcagtgagcccacatcaagccactgtaccccagcctgggtaacagagtgagaccctgtctaacaacaacaacaaaaattgctacattattgtttctacaagaagtttgccactctgtcacagttgtccattttttattattgctagcttttaacttagaggctgatgttgctgaaatattgctactttctatcctccgaa

SEQ ID NO: 127028 - DNA, 1050 bp, Homo sapiens
gtatgtatctttgccatgagcattttaaagtaataggcggaattcctaatgttcttcatggcattcacagattctttaatcaagtgagtattttcatggccttttcctgtctttcacaaacatttttttttttgtaaaggtgggactgaccactatacagctgtgcattggggagtcactggtgacctcagccaagaatgaattcaggccatccggctacaggccagaagctttgccagcttagctacttgaccacctgcttctgtttttctgttccacttgcaaatggagggtgtttgttcttttcctggcatcaacatcaatttaaaaaaattccttggaggaagttggaaaggggaggcaagaagttgatcagtgttattagttttgttccccgaagaatagcatctcttaattgagatgctgggacattggtccagctataggccactggctgaatggaattttctccactaatgaattcttttgtagttgagaactgttggagatgtgtttgatggcaaccttgaaaattacaaaccatttatcttacttttccttcactatacagccccaacaaatacagtgggtttcattaaagtaatgaaaatttaagctggcacatattctcagctactctgaaggctggggcaggaggatcacttgaactcaggagttcaagtccatcctgggcaacatggcgagactctgtctcttaaaaaaaaaaagaagaatttaaaacagatatagttatcagaatttattattccatgcaactattatcacctaagagaagtgacattaaacatttaacagtttttcagtgatgccaccattatcaagtaaaaacatgttaggaatttcttacagcccaacgaggtcaggccctttttaaaaaaatactaatagttctagctgggttgttacatccaattcccttgagagaattgaggtttaaatttaaaataaatcctctatgaaatgattagatttcatagattagattagattcactgtaggctctgaaggtacctcctgtgacatgatatg

SEQ ID NO: 127029 - DNA, 3508 bp, Homo sapiens
gtttcttagtcagtatgttgtagtgtcttcccagtcatgtcttcattactctttgttttgtttggggtggtggtatgggaataaggggtgtctgttaccataaagctaagcaactgacaaaattcatagtaaatattgaagcacaggttccctgaaaccaagcaaccccactgggatgcaggggtgcaaggtggttgttggtgcagagccagggctaaagtttgggcagcctgtgatcttgaaacctctgctcggtctgcttccaatggagatcccccgaggatgtcccagtgaagttgccccctggcctagcccagcactcttgcagaactcatcagaaggtagtgtctgagactcagccaaggatggtgtgcttccagaaggcaggggcttcagccgtcagccctaagtgtgcagctgtggtggtccttccaccaaagtgactcctaccctcagctgcagccagtgatggcaggcaccttcccacctggcagtagttgccagctgatctataaaagactggattccgcttaggaaaggcagtttaagactgtgcattcattggtgtgggaaggagcaggtagtgagaatggaacacgttaagtagagacctgcctgtcctttagagatggatctgtggcagtacaagggagagctaattataacaccattgtgtcactcaaatgttgtggtcagactattgaaggtgtcttttatttcaagtgaactttttcttttctttttttttttttaactgagggtgacccatgttctgacttccttttgaagtcatcaggcctcataaacagaatcagacttgaatgcttaagtcatccctttcctgtttgtagaatactaccctattccactttttcctgtttggatgctttcttacttgtcctgtttgatccttttaactcttataaggtagacagagagagttgttcctgtattcatgatgagacagttaagacacagcaaattaagtgaccagtgctatttgtttgaagaacttagtttattcttctgtgtacttattttccacatctgcagaactgtgaccatcctccacataatttatagtccataccaagtagtggatcaaacgagctcctgccaggcagtcaccagcttctgatgagaacagcagcatgcagcctgcacttcaatgctgcactcccaagaccagctgtggcccccacactgccagtgctgtgtgtaacgggtgctctgtagttcagtattattgatttcctatagattctttattttttaaatagcccatgtcagtttctttcttttaagtgtgggaagggtcctaagctttagtttcctgttctgtaaagagggatgatactctttgccttgtttatctaccatgcaattattatgatcaagtgagattatttttgtgaagccatgtaaactataaagtgctttccaagcatgaggaattactgtggatgatcttgagtttcacatggaggtcaggagcagttaaaattgttggttgtgataccatccataatctcttctctcaacaccctctgcaagctctaagggggggggattgtaggggtcacacaggtgttattgctagaaaatgaaagagcagaaaggcttcacaagcccactgagaaggacttagctcacacttctgggaaccagtgtccaaggcgtgtgaccataggaacagagactctctgtcaggaaggagtcaccagctgactccaagggccggggtttttatgaggagagtcagtgccatcctgcttggaagcagtcaaaaggaggttagtagcttgtaccttttgctccaaaaggaaaaaaaaagaaaaatgaatgacaagttgcagaatatgcactattaaacctcagagaagttagagttagccaaaggactaaactgtaatgcccctgggtgaggccggggtggagactacagctctgcactgtgaagaagttgcccaaagcagcatctgcaagaggtgcctgcagatcatacagaggggtgcgttagggaaaacctgaccctgcccagttatattagcaagtggtgttcacctgtgtggctgtgtgtgtgcagttttcactgatgtatgagttcctcctttgtgccaggcattgtggtaggtactaggtctacgttggagtgtggaaggttttcagatctcacaaagcttagaaactcatgcatctgttaaatacaggtctgtgcattaggcacgtgcaggggctgtgggcacagagatgaagagtgaattccaaagaactcaaacctgtgtggagaagtcagagaaagggtcactgataatggtcctaggagaggcaaggtggtgtgataaaagtctgcacagaggaaggggccctcagacctgggcaggtgcgtgcatcctggagaagatgatacctgaattgagttgagaaggtactgtaggaattaactaggtgaaagaaataggagagggtattcctggataaagaaacagcaaaagcaaaggcaaggaagcctaaaggcttgcaggagtggctgggaaaccgcacatggattactcccataaatgttaccactatcgaaatactgctacctgttgctgacacatcgcctcactccaagttaaatcagtggttctcaatctgattgaactacccaaccctcacccccactcccagggtttggaaatgtgttgcttttgataaatgagtgattggacagccctcctggcatttgttggacaagactaggtatgctacatgaccatcagaaggaagaactgccctaccccacatgcccatgccatcctttttgagaaacccaggtttaaatcctggcagacataatcccgtgaggtgacaagacagtgagtgtgtttactgttttcagctaaggcatgaaagccaaggtcacatagttttcaggccatcagtaaagcctggaatgcttttctcatcaataccttttgtttgaaatttcttttgccctttcagtttccatgttttattgatgtcctgctttataaaattctagataatgccttttgttgatagtatctttgttaagagctcacagttctccccctcctattcccaaatggaggaccttccattaagaggtagttatggcctttctctgccctttctctccttcccttttctactcaattggcaattggttggtaaatttggaagatgagactgagctggccttgctcattcccttctttctatggacatcttccgtctgtagagaggctgccttctgatttgtaaggttagtggcaatgtgggaggcctacatgtttatgacctaaacttagtctaggggagtgtagctgggccctgtgtacagtgatgctgtttgtgtcctgcacgaagggagcaagtggcagctggaagccagccagaattccactgggcccagccagctgtgctggggcccaggcagttccttttgcacatttgaacaagtgcattgtccagtcctgtggccaccctgttgcacagctcc

SEQ ID NO: 127030 - DNA, 1213 bp, Homo sapiens
attggaactgtctgaagtattctgtatctgaaatgttttggtttgtgttcaagtaactgaaggtgaagtgtatgagatatttactgtttgtgctggtctcttctaccagacagtatactatgtttgcagcattatgtgttatcttgaagcccttgggcaattccctatagtacttggttctgttaattttggtaagtatttgataaatattgtataaaaccactctacttccctaagtctttctgtccttaacagggaattgccagagctattaagttatttaaataaattaactaaaccctatattcaatttttgagtcacatggtaccaattcaaagaaaacattggttaaaggggtcatatttggaaataacttattttttctgaaagtcttcttttctttttcagttgtgaaaaaaagggatgaaaatataatattgcacttagctgtcaaatggaaaataatcattttagatctcattctacatccaaattatagcactcactgaccatactgtgcaaaattggtcagattccatcgactggttgcatttactccactaattggaaaaaattatgactattaatcattgtgacacaaggcagaatgtcatcatggcatgacattcttattttccacctgagaagtggtggcttctgagcgcaaaagcacactcttctctcctactttcgcttgccatttcttttttgggtttggttatagttctctgtagtaaatcagacaaagacttgtaaaaagtggagcatggagaggcagagcaagaaagtgttccttcatttttattctccagaaacagctgtgaaaatgaaaatgggatagggagagaagaaaaacatcataagagaaggaaatgtggctgttgcacagacaaagacatttgaaattattcgcatgtagacaattgatggagataatgtctttttgggcataaggacttcaaagtgactggactctgaagttttattttttttccctcctagattaactcagaagagaaatgttttcagcaatttgccaggatttcctatgaggataataattttctagttatagaagtaattatggttgtaacacgtgagttattttgctattgagttttgtaatttcttagtgttttggtatacttaaaatttatttgggcgattgcatttcttgaggattgaaaataaaaaggtaactgataaatgcta

SEQ ID NO: 127031 - DNA, 1887 bp, Homo sapiens
caattctttctctcatacgctgtcctccatcctatggaaccactggctcctcagagatgccaggctacttgaggactgttgcctctgcaactgctgaaatgcttcctgggctgaccatccacctcctgcttctttacctggaaaacctaactgcaatgtctgttctttgagagtgtctgtctctttctactcctcctggtagagtactgctctacctctgttcctgctctgtgccctgcagctgcctctctcagggcctttgctgctgctgttttgaaactgtccgactttgctacagtgtagggaagcccttgaggccagagatgctgtgtggttcagctttgatttctctagagggtaacacagagctaacctgtagtaagttcagtaagtgttgaatcaatgaatgaatgggttccttggatgagggagaaagcccaaagctcagcgtgttgtagttatttgttacatttatatacaaggttgtccaggatgtataatccaggctttgttgagtggatgagggtatcctgactggggcctggcaaccccccgacatccacagaggaaaacaagtgtttgtgagagaagtgatagaatttgtcaaaagtatatgaaattagttacataaaatctgaaacatacattgtggttctgtttgtcctgtgactatgtaaaattgccattgaaaaaacccagaaagccgggtgtggtgactcatgcccgtaatcccagcactttgagaggctgaagcgggtggattgcttgcgcccaggagtttgagaccagtctgggcaatatagagaccctatctcaaaaaaaaaaaaaaaaaaaaacaaaacccagacagagaataaaaacaagaaggctaggctgctatgtcatgaagaaacctaccaccaaccgctgaatttcagtgaagataggactgtattatttttattgtatcctctgctcttagtataacatttgctacataataaattgtaacatatagtgaaaatgtacatgttatttgagtcagtgtgtgtaggtataaatttttaatagggtatttacacctgaagtctttacaacaccatgtgactgctagactccgtttaaatgccagaagatactcagatacatctgcttgtcatatcctctggccaccatgtaatggtcagttgtagaaaatcttcggtcagtactggatcttaggcatttttactgcttcctgcaagtttggggtgcttttccaaccttttagtgattgcattttgtaacaaaaatttcccaccacagttttttttttttccagaataagagtatcttgagatagcaaggcaagctgttatcaaaagacagaaacaaaactcctaccaaatatgcaattagccattggtgagaaacagcattttcactccacagcataaccaacacaaaatatagaaatatatggcatgctgaagaaatagactacaattgttatttatagcttcccattccaaatttttgttttcattagaataggcttattcactagaacattgtgttggcagtgatctgtcacacacttgtatggtatgctctgcatatggtggctggattttgggatgtctcagctgggaagaaggataccctctttctcatttgcagtggtgtgacatgggctaccaggaaccctcgtcattgttcttactgacttgatactgagaaaatataaattcagaaagataaaataagtttagtaggataaaatgctgcttttatatgatgagggtgtatatgagcatttatttgaacaacaacaacaccctttactgtgaaaaccaaggtttgaaaaccactgacttaaaatgaggctggagtattgcatgtaaattctgttacaacaaggtttgaagt

SEQ ID NO: 127032 - DNA, 2522 bp, Homo sapiens
tcacaaggcccctgaagccacatagagatgctgctcttcctctatgatcttgtttttttttgtttttttttttttattttagaggctgttatggtagctagtacgagggagattatacaaatttcaagaaatttaggatttcctatctctagctctattcttttccaaaaggagacaacattttctgagttatgtttgatacaatatgtctatgtttctatcacagtgacttcatgctgtgaatatatacatcagaggaacattaaactctaatgaaacccttctaaaaggctgtaaccgtaacacagtaatacaatgttttacttaaaaagtgaaattattttatctgagtctaccctttgaagttgaatggtaatttctatttaagagatgagaaaacagtttcatagagtttaagtgacttactctagattagtagcttttaatcttgtttgactattacccataagaaatatagttaatttcctgacctagtatatatataaatatcccccagtaccaccccacacacatataattaaaacagcacttgcttatactctatgtaatgttctattcttttttgttaaaaaaaatacttgtcactaaattgacttgttaatgggtcctgacccacagtttgaaaaacactgctttaaatgctacatttgtgataccagaaggactgcaactcacatcttactgggtttctgtgaagttcctttcatgacattggcaaggagttgatggtggtggtggttattgtctttgatagtcagatatgtgggtttattttaacaaagaatttaattatccttttttccttcagtctaagtcaaagtctgtcttctgtagtatttcttattaaagatggaacaaatatttaaagccatcacatgcattgcgtaagttttctcttttagtacttgtatgtcttcctaccaggacctttttgacaaggattacataatgaccaatattagactcttctgtatcatgtcctttgacaacactctctggtcactataacagaagagtaaagataatggtttactgaggtactttgccagttgtaggtttaccactcactattcttttgtacctttttttatgttgctgatcattattagaaagacaaggcaacttgtataacttgttttattaaaaaagtgaactatatgcttatttggctagagtatataagacaaaaaaataaggaattaaagttccccaagcctagcttcatttaagcaacttaaacttacttcaggaacaactcttggactctctggcatttaaaaaaaattgtgccaagatgacattgggtaactactaagtaaataaaaatcatcaaaaaagtggaatgcctttggtaacgtaactgcagtaaaactgatatgcagtaccctgaggaatgtatggtaatcatgatccttttggaaacttttatataacttttattggaaactgcaatataaaatagcatttgtggagcacttgctacatgtcaagcacagttctaagagcttgtcttatattgtcatttaatcttcatgatacctcatgaaggaggattcagttatcactcatatttcacaggaaattgagtcatacagggattaagtaacttatttaaggtcatactgtaaatggtggagctaggattggaacctaaattgtcttgcatagaaactgttctcttagccattacgccatgttacctagtatgacagtggttagcagaagtttgaatcagtaatcccaccccttaaagtttatgtgacaaaataaatcaatagcaacaaaacactttatgcacagagttgtcccttgccgtgttgtctgtgaaacaacttacatgaccatgtagtcgttaaatcagttttggttatgagcacgttggagcatcagacaatcatgaaatgaaatattttcataaacaacactatttcaaaaatatattccaggtatctagtgttaaatgacaaaagaagagtaaatatagactatgattagagctacataaaatgtgtagcctatagagaagaggcagtcgatgcacagatgagaacaatttttttgttagaatatatagattatcagtaagttcttttttaaaaaatctgtttggaaatatgagcagtattgaattttaaattacacattgttatttatgaaggaagaggtggcataaaaatgagtaaagagaggcactgcagtaactgaggtgagagataagtccatgaatcaggttagcagtcattgtcatggtgaagtgtggatagatctgagagatatttaggaaatgaaagcaacaggtttggtcatcagatatgaggagttaaagtaaggaaggagtttaggatgttgtcttagctcaggatactataacaaatatagactggatagtttaaacaaaagaaatttgtttctcacagttccgcaggctaggaagtccaagatcaaggtgttggctgagtcagttcctggtgagggccttcttcctggtttgcaggtggaca

SEQ ID NO: 127033 - DNA, 1520 bp, Homo sapiens
gagagggagacaacaacactcgggcagagagaacacccccaaaacagtagggaggcgcaaacccttccctctggctcggatcgacattcccggagtgtggaatgtggcagggtcctggagagagccgctctgacaagctgagccctctctgaccctcctccctctctgcgatcccggatttatggggtgtgtatgttgcggggcgggggcattggtaaatttcaacatctgcgccgctcggttctttggtctttggagaagaacgggtatttcagcagtgtttttacttctggccaccctctcgaccccgggtgagcgcagtgggggcggtgtggcggtacagggctgctgagtgataaatggggagggggatcggaaagcctggttcttgggggcagggagatagcttttaggaaagcataccctgacactggcgttcggagaaaaaggaacaggatagctctcgctgttctgtgtaaaggtgaacaacaaaggacattaatgttgactgatgaatacaggagtctcccttccttttcctcctcccatttcaggcgggttacagttcccgtttttgttgtttgatttcagctgggtcgccccttgacagttactccttttagggttgagactattaagaagccaggctctccgacaaggctgcagccggccaaatgcaattataacctcccagaaggtctaacagaaagcattatggattttactaacactctttatttcctataatgccctgttctgccgactggtgtactttgtgtgtgtgtgtgtgtgtgtgtgtgttttaaaattgaggacaggtctagtgatttaggtgatgtgtagatatctgcttatgttctaaattcattttcctgcaatttaaaacatctggaaagccttcccagggagtcgtagtccgaggggatttttgtttttttttttcccaactttgcctggggataggactttggggtccattgaaaggactgtaggattcaacaaaatcattcccacatttcacgttagcttccattctggattgtgactaattaccaagacaatagtttgacctgaacccacctttgggaaaggtttccagctttccctccttcaaagtgtcagaggagtctttgccagcctctttactggcaaggagtagatgttagtagttgttattttcgttctcctcactcttctcttttttgggaggtagattaacccttgctagggaaaaagatagtccctttgctggactggtgagggacccgagggcatcgcctcctaagcggctttaacactcagtgcaggaagctcagatccatccaggcaaaactgtcctgcttggagtcgatcccagatgttgctttcttccaagtgttaaattatacagattatggatgggatttattttcttgatttcttcatgtgccaggtcacagctggggtgctggtatcgattagttcctctcttgcctttctttacaagcggtgggcagaggcttaaaaaccactctgggatt

SEQ ID NO: 127034 - DNA, 1247 bp, Homo sapiens
tccagtagcgtttctactggtgccaccccgcctccgacccgccctgcggccctcccttttcttttctgccgggtaatggctgcttccaagacccagggggctgtcgcccgaatgcaggaagaccgtgatgggagctgcagcacagtcgggggtgtaggttatgggggtgagtacggtgccccggaggcgcggctgatgtgtcttcctttctctatgaccgggtgtgcaacggacctctggtctgaccctaggagcccttcagctctggggccacctgggttcgactgggccccacgggtggtggcccagcgggatgggttggagccggtggcggctacttggttggggctgcccggggatggcggagaaaatgccatgggatggcggagaaaatgccatggaatggccttcccctccgccggggaagctccctgagcgtttgtcttctggtttggagctcccagctttgagctagctgctgagtgggtttggttcagatctggttcgcgcgcgtgtgtttataattttgggattagcagctctttctcctcaccagtacactgccttggtttgcttggtttgacctcgcaggtgtgttttatttagcttccggagtatttccagtcgcagactggtggtcactgctctccactctacagatttgcccagtttgtggctgaggtgacctctgaagggaaagtgtgtgtatctcacaacctccctgtagatggttaactgctctgggtgttcttcagatttgtatgtggagcctgagagatcttcccagtctctgggtccttagagaaagaaaaggaaagtgatagataatttgcactcgtggcttcaaagaacatttgaaaagagttttgaaaaccatcacaactttggctgtacctgactttcaggttgtcctctgatccactgtaggaataaaaaaccaaattttgaaagctgcaggtggattgtgtttaggactcttttacctttagtctatccctcccccattccccccaccccatttttgtcttgatgtgtaatttagcacaagttgtctttttctgatgaacatggtttggggcttaaatatagttctcagactgttgcgactttgtttttcgatttatttgtttttgctttcacagttaaattgatatcatcttaagtatttacctcagcggcacagagttgaagtgcagttttttcccacttcccaacagtggaactccctactctgaaattattttagt

SEQ ID NO: 127035 - DNA, 1141 bp, Homo sapiens
tacatttgtttcctttttttttaaggactgtgcccatcatattccaaaatatgattgtgccattctttatccattcccttataaatgaacatatagtgtgactttagtttttcagtaatgttgcaatgaacaactttatgtacatatattcttgcccactggttgtatattttgggagaaaattgctggatcaaaggttatgcaagtttaaaattttgacagatgccagactttcctcttaaaatatattcagcatacattgccacctgtagtatatgagtgttctttcccccatattgtcacaaactttgaggaaataatccaggaccaatgtttcaatgactagtagattgaattaagtaactgatagaaagcttagtttttgattccagtttgttttcaataaaagtgttgagtagtagtgaatttgcggtatctataacataaaaaaatttctcaccctcggtgagaaatacccagtattctcattgacttgtagcagtcaacaggagaaattaatggttgattttttatgtcatttttataagataaagttgtcattaaaaattctgcttaataacctatgtatcattctgttactttttccaaaatcttttcaaagccaacaaggtgtgatataaattttaggtgtaaatatttatattaaaagtatattttttgttaggcagtcatttaggttatcaagtatgtctttccctgtaaaaatcatacacctttttggatgagttcatgtcctttgtagggacatggatgaagctgaaaaccatcattgtgagcaaactatcgcaaggacagaaaaccaaacaccacatgttctcacttataggtggaaattgaacaatgagaacacttggacacagggcagggaacatcacatacccgggcctgtcgtggggttgggggatggggaagggatagcattaggagaaatacctaatgtaaatgacgagttaatgggtgcagcaaaccaatatggcacatgtatacatatgcaacaaacctccaagttgtgcacatgtaccctggaacttaaagtataataaaaataaaatttttaaaaaacatacacctttttgacttcttgaaaactgcttcttttaagagattttcttcttgctct

SEQ ID NO: 127036 - DNA, 1357 bp, Homo sapiens
ttgtttttgttttttgttttttttttttgtttttttttttgagacagagtcctgctctgtaacccaagctggagtggagtggcacgatctcagctcactgcaacctccgcctcccgggttcaagtgattctcctgccacagcctcccgagtagctgggattacaggcgtgtgccaccatgcccagctaatttttatatttttagtagagacagagtttcgccatctaggccaggctggtctcaaactcctgaccacaggtgatccaccctcctcggcctcccaaagtgctgggattacaggcgtgagctactgcacctggcacactaggtcaagggttaaaggacactgctttacatacatctgaacagtaaccagaatttcaatttgtctcctaaaattaagaacagataataaatagattcagcatccctcacgtggtgtcattggcatttgttcttttgctgtttttaaaaatcagcaaggtagcacaattcagtaataatacatttaggaggcttttgtgactgaggctatttcttctgagtattaatctgtatctccatattgtaatattctgtcaaagtcaacttttttccctccgaatgggtgtttagtagttgatgattttgctaatgcttggattctggaccttattatctgatgattttggtaatgtttatcttccagagaacttactatctcatgtgtgatgtctctggaagaaagagggaagggtagcaggtgatgtaaactcctcattcttgtatttcctatttcaataaatggcatcaagtctaagctagaaacctaggaagcatccttgattcctaactcgccctcaggtactgaatttgatcagttagcaagccttatttttctgcgcctgtagtatattttgaacctgttccctctattcatagctacagccactgtgctaattccattactaaccctcaccattactgctgaattacctacctgcatctcccatgccccagaaagtgctcttgagaaccagttgtatgtgtgtttgtcagcctgattctgttcttggcacattgttaatgtttaataagtgtttgaccagaatggaattctagcctgaacgattgcaaaaccttcctgttgatctcactgactcttgactttacctcctttaatccacattgtaaaacaaatatattcatggatctccacttgaaatcttcagtgtaattctgctacatgtataattaggtccaaactctctgtgtggcatttaagattctaatctacttgtctagcctcatcttcagtcaccctgcttcctttcccatatctccattatccacttaccatgtcacactgtagttattt

SEQ ID NO: 127037 - DNA, 2444 bp, Homo sapiens
tacaatacacactcatacacttccatctggaaaaactgtaaagaggatgtcgatcagattcatataatagaaatcatactctcttctaaatataaatcacgagtatatagaaacaagcaatgtgcataaactgctgtctccagtgattaaatcttcaaatgtttctattagctcttcttagagaactttgccacaaaattagggttcagttttgacttatttgataaacttatcagactctgaatgagttggcttttcattgacagtaccttaaagacttgccacctcatgctgaaacaagtatgttctactgacctacttgacccaaaggtgagcagggcagcttttttcagaagtggtgatagatttgactgatcagtcttctgtttttctttacttctcactgatcatctttgtaactagtggcatttatttgcaacataggcagctggggttgaatgatatctttggctataggaaccaagtaaagttttctagagctaaacaggatttaaacctttgcttcatggggtgaagggaggttgggaaagagggagtcaacaattgacaagtggtaaaatatttaaaattttataggataatgtgggatagtattaagctttctccatgagtagcatatttaaaataatcaatgtacagtattgaatcagtaaaatatgtagaaggaaaaactggaataggagtcagaagacctggattctgaatctgaatttgtagctttttagcagtgtgaacttggggaaaatcgtttaacctctctgagcctcagtttcatcaggaaaaaaaaaatgatgttgatattattgggaggtgtggtgagggcagagtatgttaaagcactctatgaatcttgaggcactatgaaaatatagggacaaatgatgctactgataaaagtctgtctcaagaggcagtagcgagtacaagcccaagctttagacttggataaactggaatcaaaaggagctgtcagctaaaagctgtatgaccttcagcaagtaataggacctcattattactattatggctgctgctgctgctactgctactactactacaaaagcttggatgtaactttaaaatgattacaaactaatcaaagaacattaaagctggaatcaagacaaatcccacattatacaatatataaactctgtaaggacaggaactgttaaatatacctttaacctcatcctctgggacagtgtcatgttgtgatggcatttggtggtgtttggcaactgtgaatcagcgccatgctgggctctatatgggatacaaatgaagaacccctagccttatccatgtggacatctcagtgtagttggtgggctctgcatccctgtctcaccggagctaataagagagtctcttctagttccatatagcactgtgggatgaagtggatacatttgattctgtgatatgcatgccttgccagaggcgctgagcatactaaagcttttacatgtgtttatttttaaaagaaaggaaattcttgttttgcctccttgtttctctaatactgtcctcatttcatgtttttttcttaactgaaagaactctcccctccctgcaagtaatcacagaggccctgcctttaaaaaactttttttagtgtttttatccaaatagagaggtttgtttttttactagtaaagatctcagaattgtaatcgtggttatttaacacagtcttctgttatgtaataagctgctattcaccagtaatagccaattagaaaagaaaatatcctgtacccgctaatcgtaattaccattataaagcaattaatagcagaaactgttgctgaactgtaacataacatcaatcaagctgtctttgccaaggcactgtacaactaattttctcaaatgaaggaggagaagggaaggaaaggaaggtgagagtctgcgggcttatttgaatttctttcaaaccagtttatgaatgacttttgaatgctctttaaatatgcatccactcacaaaggtaagtaatgctaataatgtactgcgacattgagttatttttccagcagcagtgatcatagacagtacagctttgcaaaaagctcactggacaaggaatcagaagaactaggttttttttggttttgtttgtttttgtttgttttttgttttttagacagggtctcactcttttgcccaggctggagtgcagtggcatgatctcagctcactgcaacctctgcttcctgggctcaagccatcctcccacctcagcctcctgagtagctgatactacaggtgtgtgccaccatgcgcagctaaattttgtattttttgtatagatgaggtttcgccatgttgccaaggctggtctcgaatttctgagctcagtgatccgcccacctcagcctcataaagcgctaggattttaatcccacttctccttccga

SEQ ID NO: 127038 - DNA, 1324 bp, Homo sapiens
ttgaaagctagattacaaatgaagtactaagaattgaggccacttctctgaggttactagaagtgcaagcatatgtctatacccaaacaataacacacattacagttgatgataatctaggcattgaaaggtattatagcaaggattgaaacggtctgctccctgggatgcactttcctcaagatccccttgagttgtatatctggatggcaatttaatatcagttttgtgttagcgcagttgtgtatcaaatgttttttgcagtgtctaagtcaaaaatatggtggtgcacgtcctatcccattgacctcacttcactatgctgaagttttatctatggtcagtggagtactttgtactcttcagagtgatggccagtaattccaaaagcctaaggttttctgaatgatctactctcattatctctgcatattttgaaaaagtttatatttattatcttctgacctatctaaccctaattcatatattctctctgcctaaaatcatctcttccctgcctgcctacctcaccaactcctgctcattccttaagatttcatttagatttcaccttcaacttttctgtgaaatgttcttgctgactactttcctccacccaaaaggtaaacttctatccagaattttcttgttttatcttgttaatgcttcgttttcattatcagtttctgatttcagctcagaaatagggatttcacaatcctatcgggattgtgattgtgatgcactttgctcttgtattttacattcagatgcccagtaaatgtcagtgttacttctttggcacttggatgagattagacatgtgcctgctatgtgtccagtgcagaagctaagtcacctctggttccgtcttattcttctgtgcctgttaaccattgcaagatactgtccttgcagggccagtgctacattggctttcctccacagtcctacctacactgttagcaagtcatattttttggagcatcattccatgcttgatctcattttatcatctcaactacttttagcatataagtgaattagaaagcaaaagccagaggtcatacaactagtttctaccagcagcactgtcatgggaactcctagatctatttactcttagcatgtcatcattatgcaatgatattactcccttaccagcaatattggcagtgctcttttttcaaagcagaggcacttaaaatggttagaatagttggttttggttttcaaattgactacagggttattatattttgttgaacagttttctgcacagaatattctgagacttcacctctaaatattaaatcacaggttc

SEQ ID NO: 127039 - DNA, 1508 bp, Homo sapiens
gaggtcgaggctgcagtgagccgtgatcatgccactgcactccagcctcgcgacagagcaagaccctatctcaaaaacaaacaaacaaaacaaaacccaaccaaggtaagtatatggcaatatttgtccacaaagagcttaataggaaatttgatattataactgagtactaaggggagcagtccaaaagtaaatggaagatgagaagaaaagcctttgaggacctaagagagccagttctagaggacctaggatttggacctcatttgagattggatgatgcatagtaaagaaaggcattgcaaatgaggaggaagcatggtgagtttggagtctgtgtggagcatcagtttgtatggaagacatagccagtgaagacactgactggagcagatttatgtggaagcaggacttttctgtcttgttctccttggtaccttcagtgtccatccaaatgcttggcatacagtaagcactgaataaatgctgatttaatgaatgactattagaaaggcagagcaaactattttggttagtgaggaaagaaaaagaacatttatcttaggaatgcaagtcgttttaattattaggccccagagagacatttaaatgagactgcagtcatgccctgctacctgctttgagttatgtattcatctcttgaaactgcttgctcttgccacaagtacctacaaattaacctaataatgccacattgcacactgtaacccataccctatagtttagcaatgtataaccaatcactaatcaatgtttttgtataagccagtgagaattcctgacaaacaactttgtatcagtccactccctgtcccccttttttgcctttaaaaatccacttgtaattgccgctaagtggagggtatattcagggcaacttaaatctgtgctcctgggttgcagtcttcaagtttggcccaaatgagctctctacttgtattcatttttgtctccgtttcttccttttggtcaacattagctagggtagattaaaataggtgcagaaaagttcaaacatgatggaatacggtgcagctataaaattttgagatagcagattgacatgagcaaattgtattaggaagattagtctgagagtaacataaaggcaggatgaattcaagcttagagtgttggaattctcagaaatgaataataagctagaatgttttggaaataatattggtgtgaggcaaagaagatgtgaagttggaaatagaagacagacaaatctaagagatacatgttgaatcattgagcacctatcatgttatatgactaaatgtttttttaatttattataatttagaattagagagtctttgagattgtaacataataggcatccaggcacggatgctcatgcctgtaatcccaccactttgggaagtggaggtgggtggatcacctgaggtcaggagttcgagaccagcctggccaatgtggtgagaccctgtctctactaaaaatacaaaaattagccaggc

SEQ ID NO: 127040 - DNA, 1174 bp, Homo sapiens
tatacatatatacccgtgatgtcgctaggataaaaataactttgcccaattcctgaaaaggaattctactgggtagaatcaacaaacctggaatctgggggcatacaatataatttaccagtgatatccttgggcctgaaactaaacatctgatagctccctgcttctgtttccttatctgaaaagtagtaatgaagtaccctcatcagatgaaagtgattagacctttatattgaagtgcggtgacaacatatggtgaaatcctgaccatgagatccagtaaaagaaacaaaagatactcagcatttcaggctttgtatagtcagtgagtaaataaacaaagaaacaaaccaaagagtattccctaagaacctagatgtagtgtcttaggaactgggccacctactgaggatagaacgatgaataaaccaaggcttttgtccttgagaaagtcacagagaggaagcaggcctataaacaggcaaatcacaatatggtttgataagtagtgtctgtgaatggatttgataagcaggtatgtttaacaaggaatgcgcagggaaaaggtaaataggattttgacatcttcaaagaggaggttgtaatggaaaaggcttcaaaagggagttattttgaagactgtattgctaggcattcaacatcaaatatcgggtgtggtaaatcttggtcctctgttgtctaaatataataatttaagaattttcctgttagattttcttctaaaatcaaagaactgaaatttgaaatgggaaatttggagaaacttccatggagatggcattttcatttgctaacgttgagtctaaaattctaatataagtatcgttacaaaccataagcaaactgatgcatacaaccacgtgtcactaaaagcaatttctaacgatacttgctacccaacctgttgaaatctacctctcatgttatttttctctctctctgactcttcttaatttcattatttgaaaaactgagagcaggccattcacctacctttctccattcctcatctcctgaactatatttttttacctacttgagccctctgtcccccatatccagttgggcaaatagctcatccttcccatgtagcccccagcctcagggccatcatgccttattgtacataataaaatcctgcaatgttatttct

SEQ ID NO: 127041 - DNA, 1022 bp, Homo sapiens
ttttgaagttctcttttcttcccttactgatattaaccatctgtattaatgaggtaataaaccaggcttgttgctaatgaattgattcattcagtgctggatttaattagaaagatatttaacatgccagcagatgttctgattttgtttcattacccccaaatataataaaataaaatacaataaatttttatatttttgcataaattaaacagagtcaagatgtattactctgttgtatattgtaaaagcctaactgatggagattttgttactagtatattccaaatattagaaggaaagtcagttttctctttaaaacactcacctaactaattagcataagagtaaaatctaggaataaaaattacgtagtagtagagtgccacgacccccaaatctatagaaaagaacctaagccgcagatacttcccgaagatttctttttattactttaatagaggatgccttttctaaattaaccactaaacaggttacttaagagcgcttaatttcagagacacgtccagtgactttgttttattaactctttgcttttcgtagttttgtttgcagtgtccaaaagacttatttaaaaagaaagaaagaaagaaagaaaaaggcagctttaggagagatttttaatgttcaaggctttatgagagaaattaggatgaaaagttataaatgtgttaatgcatgcacaaaagtaacagctcatacaaactgagtagtccttattttggactttcagcctctagcatgctctttctagaaaggaataaaaggattttgtgcagtgtcccaggtaccatatcaacagatacgtgaattaagcaatcactgacatacaaatacattaggagagaaaaactgttataagatttaacaagtagataagttcatctatcaggtaaacatcctgagatataagtataaaagctacaggcagcacagtggctcacgcctgtaatctcagcacttttagaggtcaacgcgggtgaattgcttgagtccaggag

SEQ ID NO: 127042 - DNA, 1040 bp, Homo sapiens
aaatccatcaggaaaatacctcttagtaagtcacagcttttcaactagtgtccagagaaagtgaccatgtatgaaagtacaaaaatggaaaggaagcagagttgaccttcaggaaagaaaagctcattttagatttagggggaaagtataccatatgcctgcatgcacacacacgcacacacaaacacacacacacacacaaaacacagcttagtgactgagtattttgaatcagtttttgaactggaaagctgtagggcttaatttttttttttttaatttgtttaatttgaataggacttaccatgaggtaaagaacagtttttctcaggagcttggaattcctaattagtattatctatatcttccttgaggacttacaatgtgttgctttttgtctttttctgtttgcatatgagatcatttggtaaacactagatcattagcccacataggatcatttggtaaacactagaaatttggagtgattttataacacaagaagtacaaaaaaagtgtatagattattgttcctgaaacttttttgcatatttaaaattaaaagcacaaagtagaaaatattttagaatcatgataactacctaccttcagatcagagtaaaatgtaccaaaaccatggtgtattttaatgcatataattgttccttggcttgcttattttgatttactctcaatttttttaagattactgattatctgttttatgtggtttgtataaacatctggtttggtttcattgattgccacttaataactttagataaacagtcagttgggcattttgttttaatctagatttttgaggagtttcttcacttttaagattctacatctctacaccatgcagtcaacccacagaagtgtaagctaaacaactacttactgtcttaagcttctgtgtgttgggacagtttgttatctggcattaatatgataatacctgactgatacaccttgatttgtcagtattcaaatataattgcctcttgttagtcattagtatagaaccatatggacaa

SEQ ID NO: 127043 - DNA, 1031 bp, Homo sapiens
aacccaggaagaaatgcctttgagggatcttcatcctcattcttggctttcttgaaaatgtccctatttgctataaggaaggacttagaattttcaggagttgtgttaaagatctgtatgtattgctgaggcttgcttttaataatgagaaagctcggccctgattgattcaaaccactgttgtgctggcaaaaatacatatgaaccaatacaacttatattgtattctgacattattctttaatttatcaaatatatatgagcagactcaaaggaacatatattaataaagactgtagtctaattatgtttcataaataatcatttctttttttatcaggtatctacaaaatataatatctatcacaaaatatttcttcttccaaaacctatagaaaaggtaatatgttttcctaaaaacagaaaccattttttaactcttactctacatagtgtctatcttcttatactaacttataaagttataaaattgatcatatcaagttttcattagaacagtggtttgtgctttcacataaagcatatctctgtctaagcagctgggagtagcaaaaaataaaataaaaataaaaataaaataaaatacaaaacatatcccagccatacattagaatctctgtgtaaaaaaatcagcatattttcaaagctcccaagttgattcatacatactgttaggattgagaattgttgcctgaaagtaaaaataatggtattcattaggatgtcattttcagtaaagttccatttagacattccattgaagctagtgctaatcagattaactgctggcagaattcattgttaattgttatgagtaatttgcaacatgtaccatttatgtaaactagacaacctattctttcagagatacgagatttctatcaccttttggatttatttttgttatgtaaaacaggaaatttaataccgtatccaaaatgctaggaataaaatctgttgtgtcttgttttattgtccagcatcattttattccctcatccttcctcttt

SEQ ID NO: 127044 - DNA, 1043 bp, Homo sapiens
aaacaggaaagagtttgcagatgcgacaggaagcaacttaacagacaggcctggcatcatctgtcgccttaatgtataccatttattcccttggtgtgatgattcttagccataggtcacaattgagccttagaaccttaacccagagtgttgcagccttcccccttgcaagtaccccgggaattgctgccattggccagtgtccaagaagaaggcttgaacagctgccctgacaaatgggtttcccccattcaagcaagcaaatgaggggtttgagctgctttgcaatactccctgcctctgggctacaaacactgtttaaaatgataataaagtatcctactctccagcactatgtatttttctttttggagacatgtaaatatctttaggatctttttaatgcaggaggtgggaaatcatccatatgaagagttggtttcagcttttctttctttctttttttttttttttttttggtctattccagacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaaggtaagttctgtttttgtccttaaaagaattaaatttgaccatgtgtggtggctcatgtctgtaatcctagtactttgggaggccaaagtgggaggatcacccgaggccagtagtagttcaagatgccagctctaaaaacaaaatttaaaaattatctaggatcaatggcatgcacctgtagttccagctacttgggaggttgaggcaggagggctgcttgcacccatgagttcgaggctgcagtgagttatggttataccattgcactccagcctgggtgacagaatgagaccctgtctcttaagaaagagaattaaatgtattgtttgttaaaggagtgacataatctat

SEQ ID NO: 127045 - DNA, 1054 bp, Homo sapiens
gtgaatgtgcttatagattcctgtcattctaaagcaaatagtatattgaatcttctcatcgttccttattttatgttgttctaaggtacattttatattggaggaaaaggttcactgaacagcccatcacagatttttgtagtgtaataagaattaattccactgctccatttggtaagtgtacatcttggctaccatcttttccctacagtataaaaattcaaaggaataatcttactgtcttatattagaattacttttactttcatgatagataaaattaaattgatgtgtttattttgcctaacttgaataaagctaaaacagttctatgccaaagagatcctaatagacacacacatctgtattttttaagaaataagtccttctggggaaaaaatggttaatatctgttttcttatttgttttcctaatctctcaacagaagaacaagagaattattttttgttatgtgacgttttaccagaagatagaattcttagagaagagcttcagaaacagagactggtaagaattgtttttaaagggtgaatagtgtcttgaaaatacatataaatacatataaaatcatattggttttttttttttttactttttgttatggaaactttcaaacatatgtaaaagaggagacaatacaaaaaggtcttaaaacaaaaaaaaagtatacacttgactgaaaattaaagcgttttatgttaaaaatgcagagagaatttttggctttgttttgcttcctggattatctctaaaataacaacagaacttacacattttagtgtaattttagctgcctgacacatgctagggttcagtagtcatggaaaaatgccctcagctaaaattgagttgaattgattaacctttttttctcccctttactggaatgtgctatgcactagcattttttttatttccctttatgaattaagcatatggtttaatctacatagtagcctttctggttttcaggcttaaccataagcaagctaatttgaaaacctcagcatctttagcctttaaaaaagataac

SEQ ID NO: 127046 - DNA, 1050 bp, Homo sapiens
tatacaggaaaatacttcttcaggctggtaatcctataccgagtcatgccatgctgatagctttctttttcctttttcttctaaaagatgggtattttgcaatctcccatgcccacctattgaattttttaaagtccttctcttcctacctaagctaaattctcttgtacctttaatataaataggaatttagcttttctagtttcttgtgtgtttaactcctgcatttacattttattttgtacgtctaccttttttcattgtgctgatattttccatgtgaatgtttaaattcgtctcatttttttatctcctagtttattttttttggatattctgtcctgttttgaagacactcttaaaaagctatctcagtgagactcaaaagtagaagaaaaatactatatttctatcctgtatagcaagcagatggctgttgcctttatcattgcagtttcagaaacggtgggaggtactgatatctttcaagaaggtgaaatactagtcagatcaactctcatggatttgggggtgtatatcatcatccagttaagaaatgtatctctgttttttatgtttcactatcttattttagtcattgatatggatggcttttccttgtttatttaagattctaatgtcacaaggttaactttctatcatctctcataaaatgctgagaaaggtggattttattgattgtttttaaagaaactgtattttgccattaatagtttttgttttagtacagttatccctgccttatacatgcagagctgtgtgtttaagtatattaagtattatttagtatattatttgagtatattgctaacataaattcaaatgctctagtgatcagactctggcaaacagatcagtcattcccaatgctgttcagtgacccttttgacacttaaaagagaattttgggggtggggaaaagtagctttttatttgacccctggtgtgagggcttccaaaatatttaactcagttataggcagattccattctgaaagttgttgaagctatacatcattatctgtacaa

SEQ ID NO: 127047 - DNA, 1219 bp, Homo sapiens
ctcaggaaattctcagggttaataagttatctcctaggaacagacaacaagggccatccgaattctccacacaaaccctttacctggtgtgtttcccttgtctgccaaagctgagagccacatttagggcctacctttaggttaggtttgagagagagagagagagagagagagtgtgtgtgtgtgtatgtattttattttttatttgcaatgtaggtgccaccctacttttttctttcttcttttactcccatttctatgctacattgttctgtagcagcttgaaacatttattagaacaaagtggaggtataagtgaaataatcccagatacctcagagttaatccatggttcttaaaataaaaagcaggagaaataggaaattctgctgcctttctgtggagactttgggccactgctataattttcatgaggagatttgttgtgttctatattggaggagtgccactggactcctaggctgagaatgcctagctggttctgccatgctgctgcctttaagctggtttgggaaggaacctgaggagtgtgcctttttctctcatagccactcatatatccatttagccaagaaactctattgtaaatctattacttgtcagtatccataaaatgtttttgatagccatagctaataacatccatcttggttttactttcgtctgttaatccaggttatttccattggatttgtccctttaagcatcagttttttactttcctgtgtataaattcttacctaaataaacattttttaaattgctctttcataaattgactggtttttataattttcaacctaactcacattttcattttctacctatgtgtcaatcccctatgactatgttgagtgccatctgctatatctgctgttttattaattttttctctgcttttagcttatgaataaagatgaaagactaggcattgacccctttgctgtcacacttgacattttacactaattagaaaaacatatatagcttattattatgactctgcctaacacataagttgatcttatattcttacaactatggttttatctaagtgtatttgtaatgaaaatattaactgatttttatcagcttctttgagaggctcaaatgtataatgtctgagccatgctcttcatctccctattcctagtatatagccaagaataaacttaaatgaataaaacctgatatatag

SEQ ID NO: 127048 - DNA, 1035 bp, Homo sapiens
ggtaattgaataaatctaagtattatctggacactacaagctattttaaatttactgttgattttcttacttgtgatgataatggttttgtggttatacataggggaatgtccttactcttaggagaggcatgctgaagtatttaggagtaaagcatcatcgtatctgcaacttattttcaaatagtacagccaaaacaaagtatataatatacaaatgtacgcgtgcatgtgaagagagagaaagaaacaggcaaaatgttcacagttaccgaatgtaaatattgagtataggaatgttaattgtactgttgatttaacttttctgtgttggtgaaatttttcataataaaaagttttaaaaaatagaagagtagcaaagtttagggatagctacctgtcttatttagcttcctggtttaccaattcatttagaatgtcatgacatagctatgtcagcaaaggcaatttcaacaaataaaggagagctttcttctccttactgaattgattacaatacaataatgaaaactgttccagacataatagttacatatttaaaatatttttttcatattttatgtataagtgaaaaatggtcaaaagtatatgttatatctttgttgttattttaagaaatttacaaggcaaaagtactttgtagactaaactttattagagtggaaaggaggaaaaccttgatctcatatttcaattcttaatattttttaaaaaatgaaacaaaagtaattgtgttctataccaatgtacttcattttccttagctgttgggctttataattatcactaattcgtttccttattatgacttgcatcttctattttgctcaaaacgtcatgttagtaacaaactgtatttgtgcccttaaaaagtatgttttaaaatttttttttttttttcagactgggcctcgctgtcttgcccaggctggagtgcagtggtgtgatcacagctcactgcagcctcaagcttctgggctcaagcgatcgtcccacctcagtcagcctcctggat

SEQ ID NO: 127049 - DNA, 1075 bp, Homo sapiens
ctttatttatggtaacccacaatgactaaaaactgaactcagaggggtgaccttgggaatggtagagaaaagttatatggaagatagttcaaatgaaaaattgatcagaacttgattacaaatcaaactgagaattagggaaaagagcaagtcaaagatcccagcacaattttggttttggaagaggatagggatgggaaaacactggaaaagacagggtagcaaaggacggtaaaaccttgttgattttaattcccacatagctgttaaagtggagtgttctgtaagcattttatgggacagacttggagtttaatgcaaaaacaggaatggagaaatttgaaatgttggcaacttttatatactccctttatgcttccagcccagtttcctcccatccagactttgacattttttattagccaattgtgcattaagataataccataaatctgtttctactttccagagagaaattctggaacaacagcagcaagaacgaaatgataccaattttcatggcgtttgtatgttttgcaatgaagaattccttggaaacaggtttgccattttgcatctttaaatgttactgtttttaatctgaaaactcatcagaacatccctaactgttggttatataaattaagttctatgtgttggctcaggaccctttcgtatataagcagtcctttttaaaaatatacccaacgtccaagatgaactgtaggtgctctaagcagcagaggggtataaattcttaaaatgacagaagcagatttatgtttaatattacaggacttttaaaattggctgacctgcaagaccatatgcagcaaactactgcagatgcacctctgtatactaactcttttcttctaaatcattggtaacttttcacttttggttattaaaaataaagacataaaaaagaagtgggggcactggtgattctatcaccaaccccagctggtccaaaaccagctggtgcagtacaattcaattctggcactaatcacctgggattagcataaggttttacatatttaagggcacaggctcaaacaagactgccttc

SEQ ID NO: 127050 - DNA, 1050 bp, Homo sapiens
aacactgactttgccttcactcagtctccttccagctcttagatgtcagtcatagaacccttggcaaacctggctcaattttggcccactgtggtagaactgtccttgatccagaaggcattagggatggtagcaattaagtatgtggccagggtagcctcccaacactcatatctgctttgagacagctgcttgttagccctcgttccctcactttcaatatctgtattcctgtctggcaggccccaaaaaagttcagagcaagcctaggctcacacatgggcttgttctctggggcaacattgcctgagatcatggggaccttcctagtacacctatacctcctgagccagctcttggtccattccaaggcttgggtgtcaggcctgaaagccctgggtagacctgacatgcttggttactgttgggggaacactttggagtcaggaaggtctggcctataagcctggaaacaagttctaaggactgtcagtctgttccacccacatccctcccagcaagctgctggctgcggccaaaatccttgctgaaccaatcctcttaggtcccagaagccactgtggcctacctgaacagagtcttcgagactggccaagcctccaaactcatttaccccaggagccaaccactggcctctcatctcgtaactcagactctagatgccagattcttgagccccagagaggttgagagccggattcagctcccctgagtacattcagtgtgactcttaatggcaagatattttgatcctagatagactgagggtgagggaaacctcccaacccacccataccccttgagtcagataccatttctgacagcacccaggcacaatctaggctctagatcttcatcctggaagttctaggcagatgttaactatggctcggccactctaggagaacctccctgaatccagaggcactgtactttaccccaacatggcctcggggatagggggaactttcttaccctctgcctgacacccttcccccaccccaaaacacacacacacacctaccacac

SEQ ID NO: 127051 - DNA, 1024 bp, Homo sapiens
gtttcagaatgaaactgttttatctcagatcatcaggcattagattctcataagaagtacacaacctagatccctcgcatgcacagtttacaaaagggttcgcgctcctatgagaatctaatgccaccactgatctgacaggaggcggagcgcaggtggtaatgctcactttcccgcctctcacctctttctgtgcagcctgcttcctaacaggccatggaccgatacccctggtttaaaggacagaacctgattcttctatagagtgtagccaagcagcagatagtagaacaaactttggtatccctttacagaactgatgtgactgtgtacacttacatactttataatgtcactctttaatagctgaaatctttgtgttagtgcttagcacttgcttatacctctaattagtgtttttattatgtgaatgctattccaacccaaatgtgttcttagatgatttgtgaataatcctaattgctcaaatttcttcctagatctgttattttgaaccacatggccagagaacatgctttcaacattggattgccagacaacattgtaaactgcaatgaatttttgtgtacattacagaaaaagcttgacaagtaagtactgatttatgaaacactgcctaaagctgttttaatcttggactctgttgtgaatatttttaaattaatttaatagagtaattaaagaagtgggaatttcccatgttggaggagttcacattttgtacgacagtccttattttgtctagatcatattgccctttggtgttttttaaatttttcaaatacactatgtcatatataccaaacaatatacatatcatacaatgtatgccgtataggatatgaagaatatactcactgtctagcctaagaaatagaacattgttaattcctttgaatctccctgtgtgtctttcctcattagtatttccccagaaaccactattcttaattttgtaattgtaattcctttacttttcactgtaacttgtctacatattcaa

SEQ ID NO: 127052 - DNA, 1037 bp, Homo sapiens
tgactggggaactgggcctgccttcaatctactgatttttaaaaaatatatatgacaaaggagggaaactactcatataaaagaagaggttatgtaactctccagaggaattggaagaaaaacagagagttctgttttgaatgggcatttttcttaagcaaatggaatttttttctctctcaatgtaaatgaattaaaacccaaacccactggtcacaaaaggctaattgaatataatcagccattttatctattggatagaaacaagcatatcctgaattatgttggaaatctctgctttagggtggaattttgtctgttctaactattccttgtagtgttaaaattccccttgagaagcaagtttaacatgtgtttgaagattgactctaagaggttgccatggttttctacaaatgttttacaaccagctaaaggcaaacgtaccctttgagcttttcaatcttttcttgaaatcactcagtcattacttcctagagcaaatgctgcttcaggacccagcccagtctaatagggagtggacttcagtgctagctctaagaaatattcagctactgcatctagctataggagcaatttaatagttcttccttctggggctcttttaaaactaatattcaagatcttgagactagcagaacattatatagctggaggttttcaccttttagaggagacttcaagggatttgctcactcttattctgccagcacttttagaaaagtatgatacttcatttcctgggcatcaagtagggtagctgtcaaaactgaaatcatctgccagggccagccatctctggatgagcatggcagattgtgctgctcatacagggcacggatttgatgtggcgtggactacacattaagagaagtgtttcaaaagaaagtaagggctttaacaacgtacaaaatgaaaattaaattacaactttagagtcatattgatagaagtcttttttttagctagcagctatttgagtacttataatctgcaggcactatcctaggtattta

SEQ ID NO: 127053 - DNA, 1387 bp, Homo sapiens
cctatcctgtgtaaggattaccttttcggcatccttgacaggtgtccttaacctctgctgggtcactttcagtgataacatcacgaattcctaatcatccttcatatggtgctacactaaatgccatcccagtgagttaaatggtctttatcatctgtgagattgtaggttaaaacatttacacagacaattgcaggtgtcaaacaaacacgcaaaaaataagtgcattgtaaaaatcaaaagaaagcgtgatttataggaaggtgtgagtgaagagaagctttgaggtttaaacagtgtatttgacagcataaaatgaaaagcagaatttgtaaaaattacctatgtggggcaaagaacctatatccataattctagtccaaatgcacagtacaatagaaacatatcttacctacacttttatcacactgcagaatgcatacatagacttctacatttttagaaggctacaaaatggataacattgtaaattataaaaactatagatataagctatgagcaattataatgttgttgctgttctttgatatggagtctcgctgtgtcacccaggctggagtgcagtgtcacgatctcagctcactgcaacctctgcctgctaggttcaagcgattctcgtgcctcagccttctgagtagctgggattacaggcacccaccaccacacccagccaatttttgtatttttagtagagacggggttttgccatgttggccaggctggtctcaaactcctgacctcgggtgatccgcccacctcggtctcccaaagtgctgggattataggcgtgagccaccgcgcccggcccaattataatggtttaactgattgacatgacttgtttggactatgctgtaaaaaagttgggtatggagggaagtagttagacttggaagacttcaaaagcagaagataccgaactcagactgagtttctaaactactcaaactcctgtgaataagttgtttataacttcagcctgaaagattaaataattcatatgcttacagatgtattcattccttttttaggatgcacacgaatttgatcttctcaaaataaagtcagaacttggtaagtttgattcagaggtttttttctgtgatgcttcattttttataaaccatcctgtaagctatgcctatgttcagtagctatgattggagagtgcaccaccaaaacatgtctctctatagatggtcttgacagaactctctgtgaagcagtgatgctcaaccataatagtcaaatatggtttttggtttcatatactccttctttctctttcctacatatatgagtgcttcaagtgaaatataagttagtggttaataatatatcataaattggagggggctagtggaat

SEQ ID NO: 127054 - DNA, 1043 bp, Homo sapiens
gatgtgttactttgctgcttttatagacatatatatacattgtttatataattagcttagtagtcaagcatgggctttgcagctgacagctatctatgcgatgctaggcagtttcctaatatgtaatgtaggtatgatactacctatctgatagggttttatgaagattaaatgtattaatacatggaaaattattagaatagtgcctagctcataagccctgtgtaaatatgtgctgttattatttggtatctattattatgctttataattgtactgcctcttcaggttgattaataaaaataagtggctcctttaagaaattataatagtgcaaaaaatgggtctgaacagttgtctaatgattctgtattttgtcattttcaggattaaatttctatcagcaagtgaaactggtcaattttattcggaggcaagttcaccaatgcagatgttatggctgccatgtgaagttcaaatccaaagcagacttaagaactcacatggaagaaactaaacacacttcgctgctccccgatagaaagacgtgggatcaactggagtacgtactgcaaaaccaaatgtgcacttcttactccaactctttgattttgtccctttatttaatttctttaagcctacagaaaaaaaaggaatacatatttattataaaaagtatacatcagtacagtgtggggaaaaatgtaaaaatattcaaaatgcttatttttaaaataatccccctcttacaaatgaaaccaagtatttttcagtatttgtgatatggagatagatacatatgtagagagatgaagtagatacagattttttaaattatattttattaacaaaatattgtaaatatctttcaatagccagtatccatctgttgcatcctttctaatggttgctaaatatccattgtatggatataatctattctgcgagatacttaggttgtttcttactttttgctattataatgatacagtgaatctatatgcctacattttagcacacttatctaattatttaattaagct

SEQ ID NO: 127055 - DNA, 1055 bp, Homo sapiens
aaggaagaactaggacctttgagtagaaatgagaaagatgtcatttttagcttcacaggaggtgtatcaaacaactagatctacccactactggggtcagctaccttcgaagatagtgtgttttgttatcatgatagatgatcaagcagaggctaagtggccagcggacaactccagaggcaactctggagggtgggaggtccacgatcttggtttaccaaatctggatagtagatttggtaaggttgatgtcagccagtaaaagtcaaagtgaaagcaatcagaagttgtctccagtatagcctttgcaaaatgctatgaaattgttggcaaggatacctgacaaaattatagtaaatgtgtacattcagctacctggacactgtattagcttggtaatttaatactatgtatctgtggttgttttcaggtattattttccaacctatgaaaatgacactctcctgtgtacactatctgacagtgaaagtgacctgacagctcaggaacaaaatgaaaatgttcccatcatcagtgaagatacatctaaactgtatgctttgaaacaaagcagtattttgaaccagttgctactataagagtacttgaaaacctagaagaaactaccacagaagcaatttttcatgtttttctcctatgagacagatatgaaagaacaatttaaatttgaacatcaacaaaagattggtccttggtgaaataaacttttcaaaaatgaatgttcttttcaaaaaataaagtagaaaaatgcacttactaagaacatgaaaaaaaatgaagtaggaaaataagatgaagactttgtattttggctgtaaagttttattgtgtgatcatcttaaattatctcacttcattaaactcataattatatatagaagtatatgtcaattacaaagaaatgaaatgttcaaattatttataaacctgatttttcaatcagtagtttcagtctcctccccaaggaccttcttcatccaacaagttgcaaaatttgaatatcccttctgtactatattgggtgagctgtaaat

SEQ ID NO: 127056 - DNA, 1049 bp, Homo sapiens
tggttttcaattattaatgctagtctgtgtaggtaatgccccaaaactcatcttggagtcgtattgcctgtccagagactcaagagtcaacctcctcccaccatgcggtcctaactcaactgtatttgttaattacataggctctggccacagctctagatttctaaccctcccactctgcagacaccatgaaaggcttttattgaaaactaagcaaacaaagatataggagcctgtattataatgaaaaatgcctaagttaaagatgcaattaagttaaatattttaaaaccaaagattaaagaggcagtctagacaattagactgtgcctacaacagtctgtctctaggaatcaggttcattcaggacatcaaggaatgtctgaagaggtttttagagcatgcttcagtgttaggacaggagcaatggaagaatgagacaataaactaagtaattgggaaggagaaagcttttttggagaaaaagttgatagagaacaagtcaaatagatataaaaggaaaaatgaaattgaagaacagaccaacacataaaagggaaaagatgttgtacttagggtttaattcatattagcagttgtttttttaagtggctaaacgttttcaagtttatttggggacagaaatggcaacttggacccaaagaaatctaacaagaatagaaggaaaatctcagcaaactgtactgactcctagatggagcaagagcataggccactattggcgaaggactctatgtagctctaagctacatagagactccttgataaaaaccactgggaactgctcttcaaagactgggacagtgatacgaagtgtaccctgaaagtcaggacaatttgagaggaaatatcagatgaaagcaaaacattcaaggaattattggatgaatttccagttgttactataattatagataggcatacaagagcttcttgtgtcccaaaggaaatgtgcctgagaaatttttagaattaagacagaattaaggcaacaagatggaagataacagaagagagccaggcaggac

SEQ ID NO: 127057 - DNA, 1042 bp, Homo sapiens
tccactctccattctaaggtcgcatcctcaccccacctaccaccagcacctccaccctgcttatattctcccaaagtacatcgcactacttaatattttttggcccaattattttttgtctcttctactagaatgttagaattacaagaaagagatcctgtctgttttattcactattgtatcttcagtactggaacagtacgtggcacttagatattcaattattttttactgaatgtttacaccactcctgagaagaataagcgtaagcgaaagaaggtgaagctggctgtcctgaaatactgtaaggtggatgagaatggcaaaataagtcgccttcatctagagtgctcttcagatgaatgtggtactggagcgtttatggccagccactttgacagacattattgtgacaaatgtctcattgcttcagcaaaccagaagacaattaattgtgtatgagttaataaaagacatgaactaacaaaacacatttactgaatgaataaatgtattaataattaaatgtcactcctctgcctagaacatccttccccacgatctccccatcatcctttaagttactgatcctcggtcactaatcctgggccccccaaattgtctgatttaaatgtctttcttttttgttcttgcagtgccttctttagactagcattaattatatgtattgtagggtttttttacttctttttttttaatatgtattgtagttcttgattacttgtctgttttcccctcagacatgagatacaagctacatgctacttgtgggcaaagcccagttttgtcacttctgaaacacacatgtagcacctttgtgcaaattagaaacagaacaccaagtctgatgagtgtttatgggctggaatccagtcaccaatctctcttcagcagggaacaacctatacatctgtacatagtggcccagtagacaataactgtgtttttaattgaatgagggagtcaatttcctctgtattttagcagttttcttaaaagcaaaggaactaatgtggggaaa

SEQ ID NO: 127058 - DNA, 2593 bp, Homo sapiens
cgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtaaggggtatccccgccgccggcatcccagttgccggccaggctggcgagtcttccatgcttcggcacggtgggagttgtagttctttctctgatgtacacatttgcatttccagggtgcgtggtttggctactgaactacaattcccagcgtgccctgggcgctgctcctcgcgcgatttagatctggcgtgcgaaccggactcttgggcaccggccgtgggggcagggaggaacgggtccttgggcctgagagtgtgtcgggacaggggctgaccgggagctgggcgggaaaggaaccattgtcagagttcctttctcggcggcgatctcgcccgatctctccccgaccacgggtggggaagaacggggagttgagcccgtgccgtcactggccgcctttgacaccctggctccaacatggagctcctgggatgccagacgtccggcgggtttggacgggctcttgcgtcacgcggcctgggccttgcgcggtgggcccggggtgacgcagaggcgctggggaagctttccgtctcgcaggtccacctggccaggcgaaggcgtcggaggcggggggaccactttctcccccctaggctgtgctccttcccctaactggcacctgcagaagccctgaacctctagcacctctgcgaccacccgaggcgacctcctgctcacggggggaagaaacgcgttctcctttgtgctgcattctatatgttctctgcagtgagccccagagaggcagggtggtgaggagcttaggttgcagttggctaaaagttgaggttattgtgccctcgctacgaagttgaaacttttcctgggtgggatgagtaggtgcttaactgaacttatggttttctacttattatatggttaagaaaaaggattccaattggaattggaaggcccttctaggagagaccccaataaactcaaatcgagtattaaataacctgggtaatattttatttagaaatttaaacaggagttaaatattggagtattctccgacgttatcacactggaactattagccatcaggtatttttggacacagttgcccctctgccacggctgccactcagaatgatatgcctttgttcacaagaaaagtaaatatggggttatgttgttaaaggttattggaaactggcatttaaaaaagctcaaaaactcgtgatcatgtattaaacatttaataattgaccatagggagggattcttaaaacagcaattttttacattttttaggtgcctctttattttgaatgctctccatgttgatgaaattcattctttatcaagatgtaaaatatgtaatttattgtggcctctggttgctctatgtgaattgaggatactttttttttttttgttaagggaaagagggagtctggctctgtcgcccaggctggagtgcggtgtggtgtgatcatagctcactgcaacctcttaactcctgggctcaagcagctctccctcctcagcctcctgtagctaggactacaggcatgtgacaccattcctggctattttttacattttttgtggagacaaggtctatgttggccaggctggtcacgagtccctcgtccccagggatcttcctgcctaagcctcccacaatgctgggacggtgcctggtctgaggatatttcttaccactgtgtttcagcttttcctcatctgaatcaaacatttgaattctttctagaaggtatttattttattctattacccttttgttgatgaaatggaaaagtttgaaagctaaagtttgaaagttataatgatgttagtaatggcctagatcacgcacaaacctttaatcccgtctaaagtttctgggcaagcctccttccctctttgtgcttatagtacctatacaggcctctggtggctgtatggggattgccttttaaattttgcttcagggctcatttgtgacctttcatcagctttattgctgctaccttttcactattttagtagaaaagatccatttcatcactgaattttagcatatgtaaacaagtggaaaataattctttgattaatttataacacaatacatgctttgaatatctttggaagtgtgtgctagaacttgttaactgtggttacctcagaagtggagctggggaaaggtatgggggtgagatttactttttaaaactttaacttggtcctatgtgaatgttttacttgtttaataaacaatgaataaataatagttgagtagaagagatggaaaattacacaaacttttgcttacttaacaagccacttacctaactagtatttttaaatgacatctaaaagaaatgggattcaaatgaggtctccactatgta

SEQ ID NO: 127059 - DNA, 1028 bp, Homo sapiens
tagaaataggctatgaaaaagaaaaactgtgaattgacttgtgaataaatgttaataaaattaatcagatgacactcatctgttgccattacttcagtcataaaaacgaggaagatagatccagaaatagagtgtgatgtcataggtctttgtttattcctgtcctaagcactccaagaaattttgagattttggcttcattgcttaatctttatgctttactactttggcaccacgcaagcaaatctgaaggccacttgcttgctgtgttaatttaaaaatctgctaaattctctgttttgattttaaaaaagacaactccgttaaaaaaaaaaatccagcccaacagtaacaggcttaaatttggagcattaaaaaaaaaccgttaaggtggtgacgtttgaacatacgaactttgattttactgaaagggaattaggttcagaggttaatcaggtgactcacggtcacttttggggcagaatttgggacttaatttaactcagtgctgaattgtagtttatgacttggcagtccttttattaatacaaaatccctaagtgactgtatatttattcctgaagttaatgaagtttaaagaaagattctagtttttaaaaagaagattttatttttttagtaacagcattggtacttttttttttttgagacagaattttactcttgtccacaggcaggcagtgcaatggtgctatctcggctcactgcagtctgtgccacctgggttcaagtgattctgtgcctcagcctcccaattagctgggattacaagcgcctgccaccagggccagctaatttttgtatttttagtagagactgggtttcgccatgttggccaggctggtctccaactcctgacctcaggtgatctgccggcctcagcctcccaaagtgctgggattataagtgtgagccaccgcacccggccagcattggtacttttaaactcttgcacattgtagaaactttcccttaaaggtagtttatctgataggcttttatactat

SEQ ID NO: 127060 - DNA, 3586 bp, Homo sapiens
cttttacctaataggtggccagcatcgaaatgttcagccttttagtgatgaagatgcatcaattgaaacaatgagccattgcagtggttatagcgatccttccagttttgctgaagatggtatgagttttaaatttaaatttgcaactttagataaaatgtttcaggtggaggaattcttgtagctaaagtatactattattccctgttttttttcttttaaattacgatggctgttttatattatttcttaggaccagaagtccttgatgaggaaggaactcaagaagacctagagtacaagttgaagggattaattgacctaaccctggataagaggtaggcaatactggaaactccattctgtgtgagtctatgcttgatcttagtcaaaagctaagagaaatgattattctgtgtgattctaatcagttaccttacatgtatataatttgtgcagctctcagataatagcaatatatttttcctaaaggttaatttgtttactttggatgtttcttattccgttggactttaatgtgggtagtaacatgccattagaatttagattgagtcagattagtcattattctagcataatagcacatacatagctgtatttgattataatagaaatgaatttgttgaattaaaagttaatcttcaactagaaatgataacgaaaccttgctttaagctgcttgtccactaatgttatgatatgaaaaaatgtcaaagctagattgtttcttttcactatagcttcagaactgaccttaatagaattaaaaagccctgaagatgcaattctagacttttatagttttaaaaaaagtgtaaatttacttaaatatgtaatataggaaaacaatacattaaaactatacttgtacattgaaacgataaaatattatgtaagcatttaaagttgtggctatcaaactaagaaaaatgccatgatataaagcagccttaagtgttttgtgtaacaaggtgagtcatagatggaaattaaattatattattgacaaatggttagagcttgatgagaattagatttaaaaaatctatacataggtaaagtttagaaggaaataagattttaaaaagttatttattgtatactccaactggatcttctttctcttacattgggtgttaaatagtgcgaagacaaggcaagcagctcttgaaggtattaaaaatgcactggcttcaaaaatgctgtatgaatttattctggaaaggagaatgactttaactgatagcattgaacgctgcctgaaaaaaggtaatgcccttatttttgagtcacagacgtacaactaataaggagtgtgttatcttcttttcagtaacatttagtaatagcactggaacactggcccactcttaaaattttctaatagtcaaggagtgcaccatcttgttatggctcaaaatgagacttgttagaactttgtttttgtattacgtaaaccaaaaaaaaatagcttgaaactaagaaggattagggtagattgtcatcaaccttttttgtatcagaagaggtgatggtcattctcttgttataccagaaaagcttgaaagtgtgtgtcagacatctagctcattttcccttgcacttatataaaacattgattgtacctgtaaattacatcattttcaggatatcccttggaatacttgaattctagaactttgtaatagaaattctggaattcaaattgttacagtgatagaacttttaagaccaaagagaaatcttaaagataattttatcagaccttaaagtccagtgttagtaggcttactagatttaggaaccaccaaatttaaaaagacttgtgactcggcatggtggttcacatctgtaattgtggcactttgggagaccgaggtgggaggattgctggaagccaggagttggagaccacctgggcaacaaagcgatacttggtttctattataacaaacaaaacaaaacgagatttggtgtctgccaacttattcagccaagtaagaacattatgaaaataattatcctccactatcattattttattagcaaaatattatagcaccaaaaatgtagaaatgcacttttaaaaaattgaatgaactaataagctttatatccttatttttctcattttacctgagagtaaaaattttgttgtaagtgaaacctttgatcaaattcactcttccattgaatagaataaagaaaggcctaggaaaactgaggtgggtctaagctgatatatcttgttattggtatagttgatagcagacccaactttttaaagataacacaatggcgctattaaaggtgttttacattcaaactatatgctataatggttgttggactagatgacctttaaaaattccattttagtttgcgtattttttacatttttaatttatcaggtaataatttaagctcagtatttgccccacacttgtggtgtatacagttctcaagagttaatttatatgtacctttatataaatgtattttttgtaccactgcattccagcttgggcgacagagtgagaccctgtctcaaaaaaaaaaaaaaataaataaagttaataaatgtattttttacggttttaaagagttatttttaatcccgtatttatttttaaaaatgttggtagggaaaccctgaaggtttacctaatggactgtgtacatccgaaatgcttaggagattaattcaagggcaatttgagcactgtttatatgagtacattaaggagtttgaagatagaaattggcttgaaacacatttagttgaactgttaaaataatcccttaagatagatactaatctccattttacagatgaggaattctatttagagaataagagtaactaatcgatgatcatttggctaataagtgggatctaggatttgagtgaggtctgtttctatagtttgagctctttagcctaagtttgtaacttacatcaaagcctggagcatggggtttcaaaaatggtaaatgctattttgtcattgatcaaatttgggaaataactgtcttagtaagttagtctactgaaaagactatcgtgattgcatcttggctgcttttataggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaactgtaagtataagatatttacatttatagatctgtctattcatgacacccagacgtggtgcgcctatagtactgtaccagctactcaagaggctgaggcaagagagaggatcttgtaagtccaggagtttgaggcagcggtgagctataatcatgccactgaactgtagcctgggagacaaagctacacactgtattttaacaacaacaacaaaaaagataattctatatttatggatttgggtagacataggaaactgaaattctgatttgtgaaagtcttctaattttggggtttgagaaagctttcattctctaa

SEQ ID NO: 127061 - DNA, 3407 bp, Homo sapiens
aaaaatgattcaataatttaaattatagattatggagctgcaattgtttcagaaattatgtaattcttttgcatgcttttgattttatggatcaataaaagaagactgaagaggaacagaatcactttgttaaagtcatgctgtgaatttagtagcagagcttgagctgaaacgcacttcctttgatcttagttcaatattctttctctcctcacctcttttatgtataatgtttgggacctaatatattatgctgctgagaacattttcacgttgaattataaaagcaggaagatgtagaattaataagaaataaaatcattaatgtctatatatatatatttttttttttagtgtgcaacttgctttggtgtttgctgttttattgccacagatgacattactgtaagtaaaaaacctttgattctagttatctgcagttatttctaatttaagatggttatcttacttcatattcttatgcattaggaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgtatgtatttttagtttcatattttataaaagcaacatttagtggacataattggttgtattcacatagtaatgactaactattttttaggcatttccataagcttccaagcctcctctcttgtgatgatgtaaacatgagaatagctgctggtgaatctttggcacttctctttgaattggccagaggaatagagagtgtaagtatctaactggcagaggaaaaagcttgtgtcacaaggcccattgttccatcattaccttgcaattgagaattgggcaataactttggaacatggccagcttgagaacccagtgatttatttccctacttcttggcagtggtggtgtaatactttagagagcagaaaccagtaggggttggtacagcagtgtttgactgtggttcattatacttaatttttgctatctatagaactgaagtttagggatcctcatggagagagttttgtctaatataatctttatgaaactgcttgaatttctcagatacccaatacatcaagctaatgaaggcatgtgatgcttcataattaatatcaaacaaatgaataaaatattaagtcagcataggtttgggatgagatgggttcagtaacttctctaagccaaagatggaaataaacactgctcattaagactgggacatgtgctttgcagttacccattcacttgtccactcacagatgttagttaccatggcttggctctcgaagggatttgagtttgtgatagtttgatcagtcgacccaatttgctttgtacctgtttttggtttagcacttaccatcttatgttccaggaaatcctttatctcgggcaaactgggtcatttggtaaccctaatttgtcatctctattttaaggattgctaagagaaaggaatgcctcaaatcttaccattggaagggagaatgtattcttaagatatgtgattcagatactgtgctgatatttagaaatgaggagcaggtttgactgtcttcacactgaatctgtgaaggatccaataagaaaactcaaatatatgggaaatgggtaactaaatagtagatattattgccaaccttgaattacttactagatgctttttaatttaaggagaaagaatatattttcattctgaaacttttttgcatttaaagaagttatttaacagtgaacggttccaaacaggattaatacagttctgccatgtatagtcattcatattccattctaggcctgtattgaaggaagtttacagtcttaaaatttttatgtgtaaagtggctctctccaactcccctacactccttttgtttgagggatagtaggtaggaatggaaagtaagttaatgttgtcagtagctaataattctccttatgtgagaaattggactcaaatttagcaatcaatttaattttattgagctagttaatagcttcttaacctcaacgcatggaaaccagatgtcccaatttttaatcttacattcctctactggccagaaatggcagtttcttttcttttttttccttggaaatgcatttttaaaatgaagtcataatgcagtttaaattatacatgttgaatttgtttaagtttgtataaacatatatatagacacatacatacatgtatatacatatacatatatatacacatttatatacacacacacacacacacacacacacacacacacacacacaccccacgtatcttttctccaacttaataaattacacaggataaccaggagaactcatccagacatatttcatttgacttgaatttttatccaaggacaaaaatgaactgggttacaaaacagaacctagtgtttttatttgctttttttttttttttttaaaataagctttttatatgtgggtgctggttgggggatagttatagggtgttcaaaaattaaatccagggcgttagtgaaatacatagacagatttaaaatagggttcatacagcaaatgagttttgaattattcaaggctttttgctaactgactttctgatgttactaactttgaaatctagtgatgtcatgaattctgcctgagagacttagaaaaaaaacttttgaagagctaacttttaggttggattttaatgaatgagttggttaaataataataataaactgtgttcaaagttgaaattagtaattattactcctttatgagagttctaggttaatggatgtttgccatataaccaattagataatagtagactctggagctgttctgcctaccttcggatctctttctctcttactagttggataatattgggcaacttctctatgcctcggtgtccttatcattaaaatggataaattattagtcacaacctcatagagtttttgagaacacatgataggtacagtgtaagtgttagctgttacttggaatgttggttgaattgagtattgcatttggcagtagtctactagtggccttttaggaactgtagagtaacttaatataagagacattatttggtgggcagaattaagatcttgggagccattgctggtgcaatcctcacttgggaaaatttaacaaaatatagttagaccttttccaggtctcacccattccattccccagctgagcggacaggggaagtgctacagcacagcgagaaaaaagataatcaaagaccaaatatactccttggagccaaatctgaaatcacctagattttatacttcag

SEQ ID NO: 127062 - DNA, 1330 bp, Homo sapiens
tataagaggagcctgagacagattgctaatgtagtgctgcctgaggttgtatagatctacatggtggatgcttgtgattcaaacctagatgttctgactgcaaaacctatgtcttaaatatggtattaaactgcctcgtatggttgtgatggctacacagattttttttaaaaaggtgagttctatatacctccaagtctagaatattgataaaatagttaatgcttcagaatttattggggaatttattgtctttttaatgcttacaaccattgtttgaaaggttgggtattttcttttttttcagatgataaaatagatttataatttataaaacttggtatggagagcagtagattgatgattctgatctaggacttttgaccctgttgtgtagtaatgactgctggttttttttattattataagagtatattaagatatttatttctctgggagctcatttcttatttgtcccagagtggtacagctctattatataattatcgtaaagtcctattaataggcttttggaagctgtttatggacttttttattacgtgttacattttattttcttccttcctttttttgtgtttttaatgcccaagtatatagagtcttttttctaaactacttagcatttaatttttcaagttttaataggatattgaacttggtgattcacaaactaaacttgattgggttttatccattgctaagattatattaccgtgaagtttttcaatctcagcacgcactgttgatattttgggctggattatattttgtcattgtaggggtgggggctgtcttgtgcattgaaagatactttgcagcatccttggcttctccccactaggtgccgatagcacccccttctcctagttgtgacaaccaaaaatgtctcagacatagtcagatgttcaatgggaggtaagatcatccccagttgataatcactggcagtgattctcacttcttagaacaaattaaaataatgtatagaattttcttaaattttgatttattcttctatacaaattaaaaaaccctttacatatacatatatacacacatatatatgtttaaaatactgtaaaagaacaagtagccaataaaatgagtaggagactgctagtccctgaaatgtacttgttttttataaataaaattattcccatcttgttatgatgcaatctgattctttggaatttaaacacagtttggtctattttaatacccactttgcatcttattaatgggtgttgtctctaacttagatataggaggttgaattggaacatttgaagaaaacatttgttggaat

SEQ ID NO: 127063 - DNA, 1461 bp, Homo sapiens
gcttattttccaccagtgtaataatccttttcattttagacattaaaagaaaccaagaaggcctagaagagctgttatattaatataataagttaaatgattcttaacctctaatgcaataaatgttaaacatgtatgaataaactagaactggagattgcccatctcctggcttcttagtaagaagtgtctgttctagttttgatcagctaaataagtttgactcattttttagtttttagtgtggttgtaaaatggagttaggaaataaaaacacctcaaataaagagacttcttaaatgcatagccacgttaactgtgacaaggaagcccataatctgcttaaggtcacagcaaatttcaatacattttgcagctgtcccccaaaagggattaaaacttgttcttaccttaaataatttaatcacctgaattatgtgctttattgcttatttgaaatatggcagtaaattagaaagtagatgctttaattgtagctttatgcctttgggataagaataattggaagtctgtgaatgtttggtttggggactggggagccaagggtagaagctatattggtatatctgtctctcactgaactttgaaatcccagtaatgtcttatatatggtgggaacacaagaaatatttgttggatgcatttacttggaagggaaatgttaattgttttgctgtagtacatcatcttgtagtcagcatttctgggttcgatttttgcatgaaaacatgtgtttatgtgtgcctagtccctaaataccatgaagatttacattgccttatgcaactggatattttccaaatgtagactgttctttgttagctctatatgaggtcagaaaagaaaaataataataaaggaaacaaaattgcttttcttgtccaggactttttttatgaagacatggagtccttgacgcagatgcttagggccttggcaacagatggaaataaacaccgggccaaagtggacaagagaaagcagcggtcagttttcagagatgtcctgagggcagtggaggtaggcttcttaaatgctgtaatagcttctcattttgaaattggattgtttcaggctgaacttgacaattgtaccattttgttgattgaatttcacctttgaaaataatttctcattttacgacctagcaggtttttaacaatataagtgaagactttttttttttcaaaacaaaagaaaattaatgctggtgtataaagatactttattttagttttttttcttttaaataaaaagacccatagtgatagaaatgtatttgaccttggtgtatttgtcatcatttaaaccatggtgcttagcatatacattcttagtgtacagtgttttttgtgaatttaataagttattgcctaccccttagactccaacccagcttgattgtcatttatttatttatttgagatggagtctcgctgt

SEQ ID NO: 127064 - DNA, 1871 bp, Homo sapiens
tttcagtccatggttggttgaatccgtgatgcagaaccaaccagatatggaggattgactatatatgtaaaagattgagattaaccttgaattgtggagggacagaggtttgtctgttaccaacaggaaagaggataataggtaaggatgctgatgactttatagagggttggtgggaaacagttctttcttggtgccttaatgttttctgaattaaagaagattgaaataagataactctactgttatttatttatttatttttgagctgctgttacgcaccagacggtcactgtgtttgcctcacatgcatgtcctcttttacacctctaataaccctcatgcagtataggtaaagatggccccattttacgggcaagggaacagactcagcaaggttaagttacttgatgaaatcacaagcccgcaagttgcatgtctgtattaagtctagggttgacggtcttttctattacattatatactttgtctgctgagtgagaaggggctgaggtagatgtctggaaggcaggtggagtggttttgtcattcaagttccatctcctttctcctctccctgtggcagtcagctcctcccttcctggttactctgacatactcatgatttaccaaagaattaagtagccagttttcttcttaacaagttctgccactattccagctgactttttttttaatccatctgacttctgtttctgtgtcatttgggctgcactcccatggttacaccttcgaaatggtcttctgacagaattgtttcatcactaaaatcttagattctagtgttacttcttattttcttagaaacctagcctgagacctcttggagcccttctggttgctggacctttcctttttgcttggtcagttaaccctatttaccctcacttccttccctggatccctactgcccatcatttcaccccctgcttgtggtgccattttgttttcctgactgttctgcaactttcttccctctcccatcctaggccattaaaaacacctgactttttttaagtttgttgagagctgttgaaatttaaaggtattctcaacaatgtggtttttgccttaattgttactgaaactcagttgtgccttcaagtttatcaaaactagaccaattctacacccttacatacaggatagcaacagtttgtccacatctcaggtatggcagtatcagtttaagccatattgttcatttatctcagcatgtatatgactgtttagaaattgtgtttacataagatccctctgagccattttagtgcctgtggtaattttggttcttccattggttaggaacgggattttccaacagaaaccattaaatttggtcctgaacgcatgtatattgattgctgggtaaaaaaacacacctatgacacctttaaggaggttcttggatcagggatgcagtaccacttgcaggtaagtgtcatcctttctacatatttgcttttaaagtagggagcagtcttgaatatagctcacttaattggcttttgaaattaattaggtatccagagtgcttccacatgttagaaaacagtaaacttgtttttgaaagtagacttgaataaatctgaagctgttcctttttttttctttgtattgttaaagttgggtggacggttactgatgtctgtatgaaagcaaatagcttgacatagctgtcttggattcaaggcattgaaaacaatttgctttctattgagaaacagaaaataagtgatctaagtttatctgtgggttccacataacttctgttaatcagagtcactctgtctagtgaaaaagagctataatgtttaatactgagccataccacctttttctttcacata

SEQ ID NO: 127065 - DNA, 1253 bp, Homo sapiens
acttttcttaatatggaatagccattaactctttatttatttattttttttgagacggagtctcgttctgttgcccaggctggagtgcagtggcgtgatctcggctcactgcaacctctgcctctcgggttcaaacgattctcctgcctcagcctcccgagtagctgggactacaggcatgtgccaccatgcctggctaattttttgtatttttagtagagacgggatttcaccgtgttagccaggatggtctcaatctcctgacctcgtgattcgcccacctcggcctcccagagtgctgggattacaggtgtgagccaccttgcatggcccctgttaactctttgtttttctccttcattctttgtgtgtgttttataaacatttaaatgtttatagggtcaaattagttcatttcttttctttgtgacttttaccctttttctgttttgtaagaatatcttaagtcttactgatgcacgtttttcctttttttcattttagcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttt

SEQ ID NO: 127066 - DNA, 1065 bp, Homo sapiens
gaactacagaatttgtagaaaagttttgttgtagttgcttctgaacaattagtttttgtttgtttgttttgttttgttttgtttttctggtaacctagcagtcaaagctcacatttttgtaagtaatttgcatgctattactctactgagactgaattatgattctcgagtctgggaagtttttgttgcatgtgctctgtgtttttcatttttgatagaaatgatttagacttgattttaaaaattacttcctgaatgtgaagaggcattgactgggaaatgaaattaaagaacaaattaccatgactcattcaataacactgcttattagctttgaattatgccctattataacaattctgattttgtggcaagcaatactggtgtgagttatttctgtggtttgataccaagcacctgcctggttaaaaaataaagcaccaggcaatttttcatagacaattatctttatttgttggaatatttatttgtaaatagtcaaagaattcttaaatgacaaaaaatcaactgttagcagtgatctaaaccagaggaaaatgaaattacttacatgtttccagtcaaggtataagaaagggttctgttaaagggatgctgctttagccaatcttggtgaataagcaaatttgcacactggagttgaaaggagggtcaagttagtgtgatgaagaattgctagtaacactggcttctccagccttgctggttgttcctagatgccctcatttggagatgccaaagatagcaactactgggtgtcaaacagccgtggggcctggttttaaggccatgtgatcttgtatccctttactagcagcctcatgagtcatttgcaagtcatttgcaggctcttggagccctggaacagcacccaactcagttttctctgctagttctttatttttccatttgcgtgttgcagctcattaaaaaaatattggaatagcatatatttacattgtgacttcactctaaagaagacattttctttcaaagcacgtcatggctcactaggttgttgtcttagttttttttggagtcacc

SEQ ID NO: 127067 - DNA, 1064 bp, Homo sapiens
ctttgcagtggctgaactaatttacatgcctaccaacagtgtgtaagtgttctcttctatccacaaccttgccaacatctgttactttttgactttttaaaaatagccattctgactggtgtgagatggtatttcattgagctttgattggcatttctctaatgatgaataatgttgagcatttttttcatatggttttcagctgtgtgtatgtcttcttttgagatgtgtctgtttatgtttaaaggcatatttaggataacaaccaaatcataagattttgctaagtatcaatatatagtcatgtattgcttaacaatggggatacattctgagaaatgcatcgttaggtgatttccttgttgtgtgaatatcaaagtgtgcttacataaatctagatggtattgcctgctaaacacctaagctatatgatgtagccaccatcattgatgtgctccacccttgaccaaaatgttgttatgctgcacacgactgcataaaaaacctgaagccatttttcaaatccagggaccctggtgtcccccttgtggagcattatagagtcacagaggataaaacctccaaaagagaatgaacgcagaactttcctcacatgaaaccattctctctacttattgtcagaggatgatgtttcaactgagtgtctactctgactctagaaagtgattttcatccttggatacagtcactgaagtatcttgcctgactgtgaccatttactgtggagatacagcttagcttattctgacacttcaaaattagacattcctaccataggctggttttgacaactttgccctggatacgataaaagtcttcccttatagaacttcatcaaagtctgtgactgcctgtgagtatttcctgaacacctgtagttctctctcaattgtttttatctggcttatgcaaatcgttgcctagaatcccaaacaggaatcctgtgtagtacacatattcacttaatcctgtatcatacttgcctgctctttaattggtcatacttgctataatagattgtgaaacccattctcaagcccaac

SEQ ID NO: 127068 - DNA, 1101 bp, Homo sapiens
gtaatctacatccatgtgtattgatacacgttctctcctatttctctcctacctaattagaagaggtattctttacaacacctaccctttggattcctctctttccttcctcatgaaacaacttaataaaaatgacaatggctattacttattgttcgctaggttctaacactgtggtaagtacttctgtatactgatttcattgccttgtgattagcctgtttccaaaatctctagctgttcctcatctcaatcaccttcctgtcatttagaactgtttgtaaatctctgaaaatgttatgtgtttttttaaaaccagttctacgtgggttcaaaatacatgctggtctcaaaacatgttagtcacaagtgaagcaaggctcagcagggagaatagatcgtgctggtggcataaatctggcatgaaaaatgttttcccatgttatttatgaatcacaggtttgcattcaggagagatactcgagagtagagaatcatggacagtgactaatgaatataacagcttaactgactttttatgttattgatccctaccacaacatgttggagatgggaggatcatggcaggtagaggggagagccttacagctggtggggaggtaggtctagagtgcaaggcttgggctacataactatgtggcatcactaagtatctctttaatccaaaggcaggaacttgcttgccactctagttttgccaaaacatcataggaaaacgcttattacccaggcagtgctgcaaaataggatcggagctatgaagtccaggggtgaagtaagcagcccccttgcaaaccatgcaccattttgttttgtgatttttctttttttggcccattgcaggtagtgctgtttcagcagagctgtaagcagagctgcatggccaacatctgtgaaacagtaagagcggtccccacatggccttctgtcctcaaagtgaggcttatcaattcagaaagagtagggattctggagctatgctagttaatatgcaggactcttctcattccgtgttatccagtaactggtagaatagatagttctgcttcattacgaatgacacagtttcacagtcaaggg

SEQ ID NO: 127069 - DNA, 2280 bp, Homo sapiens
tttctgtatagttgttttcactaaatacaactgtgtaaaactatttccttaattttatactagcagattcctttttatgtgagtaataaggattttttttacctcaagttgaaaatctgttgtaaaaaatatcttttcaaaagatactttgaaagtgtcatttaaatactttatttttttgcttatttaattctaagaacttaaggaaaatacatgtataacaagagtattttctctctagaagaaaatgattaagagggttttcttaatgagaggctgcagaaattattgctccattgaattttctcttgttcacaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcaatggtcaatgatgaattactaatgccttattttctaggcatataataatagtttagagaatgtagaccagataaatttgtttactgttttaagaaaactaccagtttacttacagaagattcttttttccaaacagtaggtttcatccaagaccatttgaagaactgcaaactctttctcttagaaaagaaagagggcagcctaaaataaacgcaaaatttgcttatactccatcacattcagatgtcttggttgtgacttattaccagtgtggcagagaacccaagttacattttagatcaaaatattctttatgtaggtattgttaaaaggctagagcctacaagttgctcttccatgcgttggtcagggggccctgaaaacactggtaatattaagagtctttctcagggtaacttaatgttttcttaatgaacagtgtttccagctacaaattcttccaataaattgtcttcctttttgaaaagtactctcatagaagaaatttagcaatttctcgttgactgactcagtctattttaagtattcagaaaagattttgatccccattgagttaatgctctgccttgaaaattatttttctgatccttgttagtgataacattttttttctactgaaggtcagaggataggaaacaagtatttctcttctggtatacatgtaatgtattctgtaaaaaagtattcatattggcaattttagttaggcataatattgtggttgtaatttttaaaacttagtgttttgtctgattaaagcaggcactgatcagggtatctcctaagaggtaattcacttcttattcctttccaataattattacattctaaattttcatctatgagaaataacaaacaagaagggaatagaattaaattggggtataatctaatcttcattgtttaaatggtttgccttctcaccattgaagccatttttttatagcctcagaaagaggaaataatgcctccaccattttctacctggtgacttgaaaattgaacttttaagttaggaagaagttagagtcagggaacttgtataccactatctatgcagcattgttatagtctgattatttctgtg

SEQ ID NO: 127070 - DNA, 1021 bp, Homo sapiens
acatgtttcttttatgcagccatttctctgaaggttttatataaaaggtgatcagatatataacaacatagcaggttcttaattatagattagaggttatcctaagaaagaaaacatgggtttcacagtacctttgctgcccagaaatgttttctaaaaggttcttgtagacaaagacatttgtacagttggagtttgcatctgcagtattaacaaacccagtcttccattaattgagcatgtattgactatgcactatatgccaggcactatagtgggtgcggaagatctcaggatgtctgtcaaaggtggcacagtctccaatgggaggaggaagaggctggcatgtaaacaaacaattatgattacagtgtgataaatactataatctgtgtacatcagactgggatgtggggcataaaggaaagtcagctctgcttggtgcagctctctgtaagagtttgttgctgctgactgatttctagaggaaagtcagctctgcttggtgcagctctctgctttgtaacagtttgttgctgctgagtgatttctagaagtgtgttttgaagagggagatgtgaagacttgcctggacatggtgctagatttctagtcagctgggctagggcagggatcctgtgtgggagtcagccaaatgaggaaaacatcttgggtgtggcctgaggatattgtccttactttgctctacttgctggtgttaggtactgtcagaattatgttgttgatgtcaaaaactcaagcatgagttttcctccctcttccttgcccctcctcctgctagctcctttcccagccctaaatactttttcttttccaagtcagcctcattcatgctggatgccattccaggctttcaaattctgttaaccaaatatgaatattttcttggtctccaaactttttcttacctagtggtcttcagatatggtgtgtaccactggaggtacacaaaaactttccaaggagtctgtcagcagagataattttaagagaatcagtt

SEQ ID NO: 127071 - DNA, 1498 bp, Homo sapiens
aatgttgaaataggagttgcggatacattggatatactggatgaaatacaagcggttaatttttgtaacgtgagggaaaagcccacattgctggttacatgtgtaaatcactgcgttattgctttagtcattgtctctatttagcaatgacaagactggaagaagtaaatagagaagtgaacatgcattcttcagtgcggtatcttggctatttagccagaatcaatttattggttgctatatgcttaggtctatacgtaagatgggaaaaaacagcaaattccttaattttggtaatttttattcttggtctttttgttcttggaatcgccagcatactctattactatttttcaatggaagcagcaagtttaagtctctccaatctttggtttggattcttgcttggcctcctatgttttcttgataattcatcctttaaaaatgatgtaaaagaagaatcaaccaaatatttgcttctaacatccatagtgttaaggatattgtgctctctggtggagagaatttctggttatgtccgtcatcggcccactttactaaccacagttgaatttctggagcttgttggatttgccattgccagcacaactatgttggtggagaagtctctgagtgtcattttgcttgttgtagctctggctatgctgattattgatctgagaatgaaatctttcttagctattccaaacttagttatttttgcagttttgttatttttttcctcattggaaactcccaaaaatccgattgcttttgcgtgtttttttatttgcctgataactgatcctttccttgacatttattttagtggactttcagtaactgaaagatggaaaccctttttgtaccgtggaagaatttgcagaagactttcagtcgtttttgctggaatgattgagcttacattttttattctttccgcattcaaacttagagacactcacctctggtattttgtaatacctggcttttccatttttggaattttctggatgatttgtcatattatttttcttttaactctttggggattccataccaaattaaatgactgccataaagtatattttactcacaggacagattacaatagccttgatagaatcatggcatccaaagggatgcgccatttttgcttgatttcagagcagttggtgttctttagtcttcttgcaacagcgattttgggagcagtttcctggcaggtaagcttattgtttgtccagcaaccccaatgacgtgtaataaaatgctagcttcaataattgaaattaaagttataaggtcaagttcctgatttcaaaaggatattcatgtttgctcttaattttgttcatggaattgaagcactgaatgtgtttcaagaggataatttatttgatctctagcaaagaggtaccaaaatgttatgaacactcagcgttgagatgcctcccgcttcctgactgttcattagtgaaacactcatcgattaaag

SEQ ID NO: 127072 - DNA, 2063 bp, Homo sapiens
ctgttggtgatctcataaaatggttttgaccttttggtatcttaatttctatctaaactttatcagaaaattttctttgaatatatcaattagttggctgtgggaattttccctttccacattaataaatgcctttctgtgtttctgaatcagaagcaaatgattagggaaaaatatatgtccaaacaagacaagattagtttaaacagttaagaacatttagtccacattgtcttgtcagccagcaattgtcatggaagctatcatttttaagagtgccactgtgtggatttttttttcaagtggttattacattaaaattacctcatactgaggtttttgcactgaaatatcacagtttcagatttcatggttaatgttgtgcgtatgtttgtatgtttttaaaggaaacttgcattttcaatagttgatcctaaatttcataaactgcacttctttactctggtaaagctgatgtttttgtgcttattgtgaattgccgtagtacctttgaatgtcaaactttatttagaaatataaaacttatcctttatgatataaatggttgagtgtatgtacccagtatttctaattaaatttcacatgctaaattaatgaaagtaacaagattgtaattttttaaagtcagttgattaaatgcaataaatattggttgctcaaatatgccacaaataactcgaaatttttcatttactttcaacagcataagattctttaatatttaggattgactgttctttccagttaagcactgaaggattatgtcttgtagcttccccaagagaaggggaaggaaaaaaaagcactatgttaaggataatacagaactcttttgaactattttggtagtaccttttaccatactgtttgctttttgatttgggtaaatatcttaagagcaaagaaaacaatacaccaaatgaaaatgctttgaaagtaaatgaaaacagcgcttttgaaaggctggtatagtatgaccctggagtcagcctttgtgttacagcgaaaatgttggtgctataaattctgattgtttacagatgttgattctgcttatgctccaaagtgtgcatgatgtattttacgtagtactctgaggaagtctctttataaaacctactaccacttagtataaatttgtttgaatttatatcatttgttactgtaaattcagcttattccaattaggttggcacagatttaaactgatacacattccacaaaaaccaattcagtgtataagtattgaagtataagcagtcattgcagcttgatgccagatcatgtatgtaataacaagtggaagttaatagggccttctaatactgtatgggtactcctaagaattatttcattttggatataaagaagttatgaggcctcctgtcacattcacagctggttctccaaaataatttggttgtttcaaaaacaaatggtaatcatttggttggattcttcagtatcatgactagatcatgtggttttaccatagttgccaagtggtgggaggtagcatacctgaaaatgtacgtgtgtgtttgttgtattttttcacattttgtgaacaaagcacatttattaaaaattttaaattttctagtattctttgtctgttacttgtaaaccgaaagttctgtggtctttgatgtatctcactaagtgatttcagcattgggaagcaatttagaacttgagtgacttgtacaattttcccactgggtttcatttttgttaaatcccttaatgtcataaatttattcactgagatccagagaactcaggtgacttcccattgtcatgttttgtcatgtttatggcagaagcagggcaacagcataaattctactttattgtatgtcaaccatatcatattctttttttttttttaagtaagctacataatttatcagctctttcaggacagcagatgtcttcctcatgatatgaaaggttttttgttgttgttgtttattaaacaaatgtttgaattctgccatgtgctatatgctgggaaagcagcaaggattggagtgatcatt

SEQ ID NO: 127073 - DNA, 2017 bp, Homo sapiens
aaagttaacagtttcaaagaactaaagttttggaatcattctgcttgtacaaattttataatgcctctttcattatcctctttatttgattcatctttatttcatggtatttcttgtttagcatttttatattagtttgtttttggtaactgtaaatgttaaagtgaatgtaaatagaaatgtcattcctgtaaactcctacccaaattaaaattcatgtaagtcccaacccaaaatacacaaattatttcccattttaaattgttaggcaaaaaacatatatttaaatgatgattagcaggtctttggacttaattactttgagatttttgtaaaagttgtggttgaatacatctgttcaagtttaataatttaaaaggaaaaatgtataatcaatgctggaattactatgatatgtgaaatggtttgctgaaaagtctatgtactaaagtggaaataatcttgaagttcttaatatgccttgttttctgtttctgcagagtgtctataaatgtgatttcctgaacttacagcttcagcaaccactccagcttgcacaggatgctatagatgcttttttgaagcagctgaaaaaccctattgattctcttcctggagagcttttccatgtggttgttttctctctccttctttcttattttccatctccttaccagcgatggatttgctgcaagaaagcccatgaactgttagtgttaaatggtttattactaatcatcacacctgattcctcccatcagaaccgtcatgctatgatgatgaaaagctggaagattgctatagagtccctgggctttaaacgcttcaagtactcaaaattttcacatatgcatctgatggcatttaggaaaatctctctaaaaaccacaagtgacttggttagtaggaactacccaggaatgttatatattcctcaagatttcaacagtatagaagatgaggaatattctaacccttcctgctatgttcgatcagatatagaagatgaacaactagcatatggtttcacagaactccctgatgcgccatatgactcagattctggagaaagtcaagccagctctattcctttctatgagctagaagaccccatattacttttaagttaatatagaagcaaaaagcccctttcagtccaggctcctaaactaattgcttacaccaattggaaatactaacatgaactcagtactgaaaacctggtttgcataaaagaaatgcagaggtttacagagtttgctatttttttctacttctcaattttaaaatttattcttatatagaaagcttaaagtttcatgcagagtgactcatgtcatagcagaaactactgttactttagcatttagcactatcatagaaaggtacctttttctctttagtgctattgtgaaaacaagcataatttgctatatgttttccttttcaacttttcagtgttgactataaaccattgaatggaaaactttaagatgtagaaagctgtagattgcactttgatgactcacaagttaaatgtgatacagaaaaatagatcggttagttgttttgtgatgcacttatctttttcttttttctaactaaaattgtgatgttacagaaagtcattttatgttccttttttgtctgatgatccaatatttactgaactttttgtaattggtgataattctttttatttcttccttatattaaaagctcatttgacagcatcagacattgggggagagatgtcccccaaagtgtgtattctaattttattagccctatccaataaacaccattgccaaagtagtattttcataactttcttgttgatttgggccttggtgtgaagtatatttacctgagagttcacttttacttttcttaaacttaggcttcatttacaaaatgttttatttaagcaaggaacaatgtaatactcaataatgacctaaaacacctttttgaaagggtttgcacttggaagagagtttatgttctgttgaaacca

SEQ ID NO: 127074 - DNA, 1033 bp, Homo sapiens
gggggttgggggtgggggagccaggctcagtggctcacgcctctaatcccaatactttgggagctgaggctggaggatcacttgagctcaggagttcaagaccagcctgggcaatacagcaagaccttgtctcaatttttaaaaaattaaataagtaaatatatataaaacaaggctgtacttttttactatcctttttaagtctaataaatgaatatttttaagacttgttcatcttaacttcaaatatgatcattattaatagatataactcacagaaatgaaagctcattggggccgtcagtaatttttatatgtgtaaaagggtcctgagaccaaaaagttaaagaactgataatctatgtgatttcttacattctcatatttgattttgttcttataaaatatctgtttttaggttgctacaagcctcaggaaaaatcagattacttgatgttggcagctgctttaacccatttctgaagtttgaagaatttctaactgttggcatagatattgtacctgctgtagaggtatgcatagttttgtttttggactttaatattttacatgtatatttacaaaagaaaagcactgtctttgcatccctaaaatagcaaatgtatttcctgtgtacccattgaggagagatttcaaaactaaatacattttgtgaataattgagcatttaaccaaatattgtctttattttctttatcatctaaatagccataatctaaaactatgttagagcaaaatcattgcaattaagaaacttcaactgggcatggtggatcactcctgtaatcccaacactttaggaggccaagatgggtggatcacctgaggtcaggagtttgagaccagcctggccaacatggtgaaaccccgtctctactaaaaaataaaaaaaatgtagctgggcgtggtggcaagcgcccataatcccagctactcaggaggctgaggcaggagaatcgcttgaacccgggaggcggaggtggcagtgagtcgagatcgcgccactgcactc

SEQ ID NO: 127075 - DNA, 1084 bp, Homo sapiens
gaaattctgtgagtaaaatgctgtcaagcagcatcacatgctgatgcttcagagaaatcattcatgataggtacagccaatgtatgtggcaaactttagtgttgtcttatttttagaaattctgatagcaccccagctttcagcaaccatcatgctaatcagtcagcagccatgagtatcaaggcaaagcttccaccagtaaaaagattacaacttgctggaggctcaaatgatgactagcattttttagccataaagtattttaaaattaagatctgtacattgttttttagacaatgctattgcacacttcatagactatggtgtagtggaacataacttatatgcactggaaaaccaaaaaaattttgtaacttgctttattgcagtagtctggaaccaaagctgtagtatctctgaggtatttcgctgtaatattaaaattgttcctatacccttttaccctgttggtttgtggtatcaagtgtattttgttaattacttaaaaatgctaaacttgaatagttatagaaatattcttgatagacacagaaaataattatgaaagtaagatactcttaagcagttccaaaactatagataataacaagcattacttttggttgctttgattttaaatcatgttgaaaatattacctagttttaagcaattacgtttaaaaatcaaaatatctttgattacttcagtagggaaccataagccatctttacctttattcaaaggttactacaaagcttataatgcataacgacttactaaacatcctttaactcatgtgttatggacattcttaaatattaatattttaagtgttggccagttaaagaaattatatagttatacttctatcaaacacagatatgtatggaaaatatcaactttagatttctatatattttttatagctctgttatattgttgagattcccttatttattgagtcattgttactgcattttcctttgattctttaagcatgatttccttaaatttgttaaatatttttatggctgggcacattggctcatgcctgtaatcccagcactttgagaggccaagaca

SEQ ID NO: 127076 - DNA, 1022 bp, Homo sapiens
tattttatcacagaaggtcattttcaaatgaaactgctggaaaaaaacattaataggaattcaagtcaaactgctaaaaaaaaaagaacattggccattatattaaaataaatcataatttattatgatttaacatgattgaactcgaataccttaacatttctaaaactgaggaatttttatttgagaatctagaaaacttttccctgctttttttaagttaatagttattgccagtctgatatgtaacaaattgagaggccagtcactacccaaatgttagtgattaatggaaatatttgtatatgagtacatagccccctcaaaaataattctctcaggtttaaaatcagtattcaggccaagactcagactgatatatagtcatcttaacaatgtgtgagagggtttgtttgtatccttactcttctttcttgatcaaattagagggctaatagtttggttttcaactcagtacttattagactgtagaccctaaaatacccagtaactgggattaatggaaagattttcaaatttgaatagttaaatattggttgttacatttggactattataattccttttctgtttaaaaaaaacctcttagatgtaagaattcaataaccttaagtggaggaagaattttagtataattatctcccacatttggctgttctatttatagttttttttcttttttttattattattatactttaagttttagggtacatatgcacaatgtgcaggttagttacatatgtatacatgtgccatgctggtgtgctgcacccattaactcgtcctttagcattaggtatatctcctaatgctatccctcccccctcccgccaccccacaacagaccccagagtgtgatcttccccttcctgtgtccaagtgttctcattattcaattcccacctatgagtgagaatatgcggtgtttggttttttgttcttgtgatagtttactgagaatgatgatttccagtttcatccatatccctacaaaggac

SEQ ID NO: 127077 - DNA, 1001 bp, Homo sapiens
ctaatagcttcttcattttacagataagtgagcggagtcctaaaaatattaaaataactttcttgatgctttggtagttcattattaatactatacatattttatgggaataatataggttccccacccccaactccaaacctaatattagtgactccaaatgttagaataggagggaaaatgagaagcaggaagtggccctagaatttccattaggtgaaaagttataaattgatgggaatggatgatccataggataggtatgattagctgagttggggctatacaaggtgagggttttttggggagagatggcagggaaggaaataagttagggtagaataaggaggcaaaacagccattgaatattaaggacaggatagatagtgactgggaggttggagaacagagccttcttttcccttatctctattagtggaattgaaaataaaacaggaaaaacaatgaaaataagttgtgttgttcttttttgctgtgataagaaaagatttttttccactcttctccaaccatttgcccaactgatgctagttgatggtgatgaacaggcttggggtggggaagggtgaacagggttgtaaagagtagcaggtaggcttaatgcactcttttcgtttaccactttttccttccccagtttatggcctgccttgtttcaccacttaagagatgctgtgccaatttgtctaaaggtaaagtgagaactggagataaaggtgtgttccaggcagcactcgtatctgaagcagttactaaaaagaaatggtagggagatgcctagcagtggtgatgcgaaggggtatttctggtgtctgccattgatagttaagagacagtcttttaaagtgaggttatattcataagatattcataagataggtttttcactatctagtgaatagatccatatttataaatggaaatatgcttgcacatataggtgttttctgtctttgcatacataatttttaaaatttgac

SEQ ID NO: 127078 - DNA, 1081 bp, Homo sapiens
gggccggcggccgaaatactgctcgtgcgcagagggccgggtccccgaacactccgccgccccgggagcaggagcggaaactggagcaggagaagctctccggtgtggtgaagagcgtccaccggcggctccgcaagaagtaccgagaaggtaaacagcgcgctgagtgagggaggaaggggaggcctcatcacccccaaccgcttgtcacctcttccctcctccaaagaggccaccattaaaatgtaaaggatctgcacgtccccccagccgctgctgctctcccgggcctggtctgagccccctagtcggcatcagacgcgctcctccccgcccccttttctttgagggcccttcgggagagttctaggcctgtaaaggaattgagtccccaccccctccaagcccctgtccccagccggggtgctgaggttgttgtctcggcacacacaaacacatacacgctcacagaggaggtgggggtcgctttttgcaagagacgccgaggtaaaacaagacaggtaaaatccatttgtaaaagacgaaaagaaacctgagttgtccctcctttacgcttgacctaccggctgtaccatttgcttccttatcagacccccttcctagtacttcattcctacaaccatgccgagccttcctcgcattggcttccagggctgggaagccagcaggccttttagctgactggacttcacattgttaaaagggggcgggctacactcgtggcccccactcccatttcttaaatacttggtcttaactgtttatttaggcgatgaggaagagatctgggcaggttctgaaaataccgtttgtattggaagcctcctaaagacacctgccgataaagcccaccctcggcttccatggatggggttccggtgagaaccccctctgtggaagctcataggggaagaagccttagtggcttttgcctgtgcctgaagagtgtttatagttggagtctacagttatccttgatatctttaaatataggcttttgtacacagctgttttataagattttgacagtgaaaattctgttttcataggcttgggagag

SEQ ID NO: 127079 - DNA, 1028 bp, Homo sapiens
tcaggtggaccaacttatttaatttctactcttcaaagtagtgctactaaaacaacaacaatactcaaaatcaagaagacaaagcctccaaacctagaatccttttagaccctgtggatcgagaagtggatgaaataaaagaatcggttgattccttggcaacttttcattaacattcaaagcagattttaaaagattaattgagaacatgaaaaatagatgttattgtaaccattctttttattttggttagaaaaggcccaactgggtttttataagttgaacaaaatacatttcccattatctatgaaaacatggtaatctattatggataaatcattcttattatccttttctttttgtgctctttcaatgagaatttcttctggactcttacccctcttataattgggtaatgataaaattagataaattttaataccaatgatttggcttctaaattttgttgcatttaaatggaattggagccatttagcatagattaaattccagatcttgtctctgtctcagtgaataggttcagatttctaatggaagaccaagactgatattaggaccagctactgataaagtcagcaaaactactatatgccaccgtgtttgccttacataattatagaggtgggttttacattaggctggctgaaagtagaattctgagatgaagagttatatgtaaagattttttgagatgtgctctccagaactgcacctgtgaggagatgagaaaaggaagatagggtagaggggaaagctgactcacaatgcaactgaggtcttgggagagcttacagggagctctggaaaggagatgtctctaagaattgttccaaattgaagcaaaggggactttattccttggcgtgtgttgggcattgactgtggctctcccctgagaagtatttagtgaggtagttgcttgtagccaagagcatttctctgtcagggttacatctgtaagcttttaccagatggtattcctcaaagctgagggcagtaggctttaa

SEQ ID NO: 127080 - DNA, 1011 bp, Homo sapiens
taatttcatcccactagcttggtccaaaaatatggggtgaatgctggagatgaagggtgattttggatataacgtatacatgctacttgggtttctttttagcccagcttcgtgaactaaagcaatgttttttgggaaaattgtcctaagtagagattcttaaaggaaaaatgaaaaaaacatgcaacagtactttgtgtcctcacaaaaggtataccatgacctactctcttatttagaaaatctgtggatctcaaagacaaatcttggtaacaaaagtgaagttacctaagcactctagacagattaaacaacaagtttctcccactattgaatggagaaaaccatcagcatccgtttagcatttattggaataatctcaatagtttcagctttaactttaccagatacaagctttcttcaaatctgcactaatcttgtacaaatcagtgacttattcagggcacagtttggctattagtggaagttaacacagacaggcctgcagataagtgggtgatagtgtaaaacacatcgtgctgtgggtttatattacagcaattaatccagagtctgagaggaacacaaactcgtaccttaatatcatccctcactcaaaatcactcatttagctcatttgggaagccttgtcactgcctgaaaataaaggagtacagatgaaagttgccacatcctgtggagaagaggcaattatcctttatttggtttccaacttcccttgtaaatgtgccagcagataaagtgttggtgtgagttcagggctgttagaatttttttttttttctcaccacatgagtcaatcctgttcttaggctttatttcccagtgatggctgtgtaccgagcaagtgttatcttcccatgtttatgtctccacgacaagaatttaccattttaaaataaaacgatcaagttggtggactgatggcttttgtgatcacaccacaaattttacttacttgttttcagtgttgaaagtgattgatgaaaa

SEQ ID NO: 127081 - DNA, 1004 bp, Homo sapiens
gttggttgtacccttctctcttcctactatctgccaagtatatctagaacataccttcccattatattgataagtataatatgttatacagaactgattcttcattttttttctgctgtggcaaattattttcgttaacaagagtgaatacagtttaaatgttgaaaagcacattgctgtgaagaaaatgaattcccagtggtttaagagatctcagcatttttttagtttattaatgttcttcaatttgctttaatttctgtcatgaaagacttaaaatgtacgttgtgttgttaatgttgatttaaaatttatttaagtttttagtgtttcctcttgaagatttttctaatggaagtctataagattataccattagaatgtcttaaagatttttttttcttttttagcagattaaggaaattaactttgaattccccaaagaaagaatgctactagaaatatcttaaagattttctggtatttaattttatgtttatttgatggcattctctgtgaaagttttctttattattttagctttgtatcattttagtatacacacccaacgatagccatcattttgcaactttttctcaaccttaaaaaaaaaaactttcttaaaatgtattttaggggtaggaaaaaatcagtggtagacatattttggagaaagcacttataaaatttctcactggcagatagtgaggaaaaacttacagtacactaatccaaatatcttaccatcttaacatatgtagactgtcataaaatcatctcatttttttttaaaaaaagatccccaacatctttaagaaccattcctcactattacctcacccaaatttatgttccaggatttggttgatctatgtctgtatgcctgtagctaactcttcacttcctttttgttttcaatttttttccttatggagtctacctttagtttagctaaatggcaacaaaaaatgatcttgttctatacatatagtttgtacagccac

SEQ ID NO: 127082 - DNA, 1078 bp, Homo sapiens
tttcttggttagtgtcactatgtagttgttagtctttattgttatgtcttcttggaaaagcaaaaaaacgctttgttaaactaatattaaattataatttaccatgggcaaaactcatccttgctttccttaaaattacctactaaaacatattaaaatcaataaagtttacattttaataaactaatatcgtattaaactgatactttatcttattttagtttaaacaacataattctgatttttaaacaacataattctttttctacttttttccccttcattctttgtcttcacatcatcatccactcagttgcccaagccagaaacttgcaaatgtccttgaacctttcaccattaacttagtctttcattcatgtgtttcttctcatgattctaggcattgaagatacagcagagaacaaaacataaaaaaatcacttatcttctgcagtctgtgttctcatgaggggaaactgacaaataaatctgttaaagataaagaatataagatcatagtaagtactatagagaaaaataaaatagaaaagataaattgtgtgtgtgtgtgtgtgtgtgtgtgtgtgtgtgtgtgtgtgagagagagagagagagagagagagagagagagatggggtggggtttgcaattttagatggaatggccaggaagccctcactgaaaaggtgatacttgtgcaaagatctaaaatcagtgaaggaaaggaaagtaagctaaggcagaaggaatggcaagtattgaagtagaagtgtccttagcaagttttgagcaactgcaagcaggccagtacagctggtatagaataagcaagggtaaagagtagtaggagatagaattgaggattcagggatagagagcatagggccttttggattattctaggccactggagggttttgagtagatgagtatcacattatgatttatcttttcatataatcactctggctgttgtattgaaaatagtctgcaccagaggtagggatgaaggcagggaaggaaacagggacgaaaccggttaggatttattgcaagaatccaaatagcagatgaagat

SEQ ID NO: 127083 - DNA, 1027 bp, Homo sapiens
aacacagtaattagactgttgcaaccatctaaaaccttaggcttccagtctgtgctgttagtgttaagatgtaaagtgcaatcctaagctaacattatctgtgcaagcaccatagaaacatttgcatatctgcatagatcttacaactgtactctttacctccttgtgataaagctttgtctacctgcaaacacagtcaaaggctacagctgcaaaccaaagccaactctaaccatggccaagagctcaaggacagaagcagccacatgctttggtcagccttctgtaacttcaattagtacaaaggaaccttttccatgaactacctgctgttttctgatgacctctgggatcttttcatttagccctaaacaaagaaacaaatatgacaaaaaccacaactaaaaaatgttaattcagtcacagagtaatcttctgaggccaaaagtccatctaaatgcaatgaagatttgctttcattaaagacagaggtgaggacaaaatccgcagtggaagttatgatatgctagaaagcaacaaatgtggatcactgaccaaaacgattatgtacttgatgcaaatgcagattgcatattgttatatatatagtactttgtgtttttgttttccctcattcagtcagttattttcagtggtgaatacatgttgttagaagatgtcttgtatggtcttaatctttgttgtgtactatttttttatagtcttaagttataatgaaaaaacaaaaagtaggaaccaaacataaaaggtctagtaaagccaaaaattaatttcatattgattttaaagtgatctagctgagtttttacactgaaagcaaagattatagcaattgtagtccatggtatttattttcagtcaaaccaaagttacatataattctgcctctgcttatacgggatattaacactaacaatacactcccttcaaagacttgcacaggccaaattgttggaatgctggttttcttgacaattccaaaccccaaaactatgataatgagtta

SEQ ID NO: 127084 - DNA, 1029 bp, Homo sapiens
tcaaatcaaaacttccccggggtggagtttgagggagggaagtggagggggagggaacgtcccgcaggggtggtgtgctcttctctaaaaacatttttttttttaattttgtatatttttccgccagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggtgagtgcgcgcttgcaagtggcaagcttctttgtcattgttgcatttttcagtttgctcacaagtgcacagataggggtggggggagtgctgtgaggaggggctcccactcgtagttgagaacttttgcacagttcgcgttactcaggcaagttcttcaggatccttgccctagatcaacaaccgggtaagagggcgggaaccgttggtccctccactcccccttcctttggttgcgaagaaacaggatgacaggattgcttctttcttaagcatatgcatgtttgggcctaagactcaatgtgtaggttctgaagcgcttctcctctaggtctcttcagcagatccaggactgccgcagctctctgaacaagcgtgcacttactccatttcatctttctgtttcttgttggctcctctaccacccggttgataattcaggtttctgtgaccagtagctttggaatggcttatgcttgttttcaataactggtttgttttgaaataaataaacaaggtttataagaaacactttccaagaatgaattagcttctttgtgttcttccaaagtgtaaacacacacagcctataaaatactcttgtgtctgggaaacttccataacaagcttctaaacgagttgaacctttcttctcttgaaggcaatatactttaggtttccattggtgacagagaggaagg

SEQ ID NO: 127085 - DNA, 1028 bp, Homo sapiens
gtgttttgaaaatagttacagagcagggacataagcttacatgctccaggctgtaagagggaaccaggatagatgtcagacagtatggagcaatggggattttggggaactggagagctcatgggccaggaaacaacattcctcagttttagctaattgttgccatgtgggttagtatcttcagatatttcaagtgatactggaaatccagatttttatgtatcatctctccatttttaagagtttgcaactaattaaacaccaattttgtgcaggccaaacaaaacaaccacaactgtaggctggatatggcctctgagcagctaatttgtgatctctcatacagaaaatagaaagtaaacatgtaatttaaagctatattcttatttgttactaccttgtgaaatattgatttactttctcatgcaaagtacttgtatacatgtcttgataggtgaaaagccatttcagttatactttattttaagagataatggatcttgtttgtgtggtccctgtaattgccatttgtcctggtttgattaaacattttaaaattcgtgttatggaaccacattgaaaatgtaagtatttgccctttggtgcaatagttactagaactcctataatccaaagagcctttgaattaagtgcttctttcataagtatgggatttgtaactagaggggtctttagaaataatttaatccaacccgctcattttttaaataagggaaaggatgtccaaagaatttaagtgacttgcccaaggtctcatacacagtcagtagcaagaaatcagggtagaagcacaaattataacataaattgtatgtcattgtgataaatgcagttgaagtagagaatcagttcaacttttttatagggctggatgcattgacaataggcttgggatattgtgaatcacttgagcttgttcccatccctgtatctttcccccaaccccccaagacattgcatttgtcaagacgtagatcgttggactctgagtgctagaatatatttta

SEQ ID NO: 127086 - DNA, 1032 bp, Homo sapiens
tggatgggtggattgaatacactcactgtgcactaatgagaagaaagccggaagttagagagaaaatgaagatgaaaggagatggaggagggaggaagtggtgcagtaggtgtttgtaagggaaagataaaaattctgggatggaatgggatgaagggaccagtctttggaaagttgggaatattcctctttgagatggaggtgggagaaaaggataggtgataatctagagaacatttgatgtgaaaatgaatattgagggcctagatctcagcaaagtaaatggtaacattttctgagagcaaaggaggttaggatgaatcaagaagtttgagatgtctggaaaagatttggaagagggaagaattaaagggatagtcaatctggggcaaataaaatgcctgctgggtaacacaaagaaattaactaggactgaatggcatgaattcttagtggaagtgatcagcatggttgattgtctttctcagccagggagcatgcaggagcttgggaagggaagcagacagaatggattttgcaattagcatagggttggaggttggcagggtggaagtgatgagaggatgacaagtgacaagggatgcatatcacgcatgtgtgggaagtgtttatgttaaccggtcttgtattccaggctgggaagagaatccagagaccagaaatgcaattgacaggctaagacctctggcgagaaaaaaaattgtggctgttgctttgtttggtcagttcacatatgaggatttaatatatatgattgagtgacctttacatggctatgagggaagctgtggaatttttgggtgtgtaaaggcttttcctgtttctttgaacctcgtttcctggatcttgttgagatgatttcatggaaagaaggcctaataacagtgtgcaattattttattggattatgtttctataataataaaaggtttgggagtaatgaggaaacatcaattgacaccatctaaagttaggccatatgcaaatacaaagttatttagaacaacaaca

SEQ ID NO: 127087 - DNA, 1716 bp, Homo sapiens
atttaaagattgtaattggtaataaattccttctcatatttacctctagttctctggaattgtaaattggaatttgctcatggattttaatgagttgtgaaatgacaagttatatacaaacgaatttgcagagtgtaagaaaaaagagactgctttacaatttatggaagtagatgtttctatgtatacttctctgtgtttcctccaaacaaagcttctttttgtgtttttctagatactttccattgtgcttaagtgatcagatttgttttcgtgaagattggataagaatatttttaaagtgctttgtataccataaagcacaatgtgtgttgttattattgtcttattattatcattaatatcattattctaatttattactttacctttcacttttattatattctatgacatttgatttgtaatctatatcctacttcttttgttaaaggtttttaatctcttcctgttattcctaaattatttgggtcattattgggggaaatgagatggcattaaagtgtaagtagtggacaagggctcagtgaggaggtagatttattcctctcctattggagagtgtttctgagcctcaggaaggagctgaggcttgggaactggcttagagatcatcccaaaaatgctaaccactgaagaaataaataacatttaatgatcaagaccacaaatgctgtggtctagataattttagttctcaaacctcaaacttcctggatctgaacactctgtgaacttacacgtaaattatgtttttgcagatcatgttgttatattgaaatttgtgaattaggaattaaagagtaattttaaaaacaaaattaaaaattgattacatgaagactgaatgcttacagtttaccaactgagttatgttggagataacagtgatgggtgtgggttctgcattcaaagtttacagtcttgtgggagagacaatttattgtgatatgataatgtgtattatgagtgctccagtggggaagtgcaggctgtagtaggttctcatgggataacacaaaccctaaatgtggggagggggccagagggagctttccagtggaagtgttgtctgtgatacctaaagggagtccaccaactgaagctgttcgtgggagggactgaagctggggtgttccaagcccaaagcacagcacacctacagttctagaggtaagagaggacatggccattttgaggggagctggggaagttttgtgtaatctgggatgtaaatgttagatgaggcgtggtgagaaatgagaaagaatctgttaaagactaagggaagatagaaagtattgaagggagtagtgacttaatcaacattgtgttttagttgggctatattttaggatgatgactctggaaatagtgagaaaataaataggaatgggaaggactgaaggcattaagagatcaactggaagactgttatgtaatgcctctgagaaaggaaggtgtcttggactggggtaatgacaggtaggattacaaggaggagatggattcagctttctatgggatgtagccagtaagacatataggattaaaggaatgacaggtgctgagaatgaagcccaaggttttagtttggacaagtgatagttgtgatgaaatgacggtggagcaaatgatttgtggatattgtccaaagagggtgtgaagtgatgagctacggctataaaatgggta

SEQ ID NO: 127088 - DNA, 1192 bp, Homo sapiens
tcatggtcaactggaatctgcaaatgatctttcatgatctccctaaattccataatcttatggcatttctgccatgcttatgctgaaactatggtaacagaccacacatcggtcggtcttctcacttcaggttcccagcctgtggggcatagaggaagagtgttatgtaatggaaggattaattatagaataaatatgtgttctctcatctcagttgaaatgtctctgcttctcagtttttagttggtttccattttgggttcattattgccttttgattttataacacttactgttctgtaaggattcagattatattctagtcctctcattactgggtcattgtagtttatatttaagcacagctcctggtagtcaaatccagttctggtctacatgcctgataccttaagccatcttggtctatgtcctgggagaattagtaaatactactacagtagtgttttgagactgataggttgtgtttctcatttagtgcagtgggctcttctcagtccttattctatctgtaggatttgacaggacatgttttctgcttgaaactccctccctatcctaccactcccctcaccactttctgcctctatagttcatgttgactccctttcagtctctcagatgccactgggttcctttctgcctctcgtcggtcttttgcataccagatcttccttcaggcttgtcccttcagaaaggccttcccagacccccatctacaatggcttttcctatttctcacaacaccctttcctttttagctgttgccacaatttgtaatttatttgtgcaattcacatgtctaatgtctgctggctctaagttgtaccccaagcaatcagcataattccaggaccacagtaaactttcattaagcaaatttggatgattgattttaaaaattgaaataaattgatttttttctctactacttcctttcatgaactttcgccatagccaaaatatgttatttgcacctctgtccacttgtctagtattttccttttcccaggcttcactcatgttacccatctctccacgtctcccgcccaacaagcaaggctcgtgtgatttctgcctcatctgggactgggagtgtttaactgtatctctcctaaaggactcattaatttcaaaattgtaatacaggtgtttatgaccctcttctccatta

SEQ ID NO: 127089 - DNA, 1047 bp, Homo sapiens
tgagattgcaccattgcactctagcctgggtgacaagtgtgaaactccatctcaagaaaacaacaacaacaacaaaataacaaacaaacaaacaaacaaatgattttccctaaaatatgcagcccattacttagctaaggattcgccactcctcatttattatcttcctccggtttgcttattttgataaacattgggttcacaatcagttccttgtcctcattaagcctagaggaaatgaggggtttgttgtaacactcactgggaagaagtcttcaattttgtttgtttgtgttatgacatctacagtgttaaagtaaaaatatttaaatgatacagttcacagagtacatacttaatgtgccaaaagcacaaatgtgtgggagtgttcattttctgaatttttctttttactaaaaatgaacaaacataagaccaactattacttcttgagcctaaaaaacaaaattagataactaagctctcagagtcagaatctacagctctggtatgactgagtaggtgtgatcatagcctggtcagtaataatgacagattttagtgtccattttagtgtatgaaacactaaattacagtaaattgaaaaatgggtggtttatagtcctagaatagtatttctcagagagcaaataagacattaaatcatttggggatggttttattcttcctcttaattgaaggtgtagtgtcattttcacatctttgttcattaatacaaatatgaaaatatttgtgaaagtcctcttggaagacaggctcattatcatgtgcatctccagtttggacatatctgcatgatattgttttggcatacaacattaaaacttagtcttttggaaaatgccataaagaagtttcattattcagataacttaatttcaacttagagagtttccagttagtcaggcctattgcagtccactctagtgtgccttgggaaataactgctgaaatttcacacacataatgattatgtaggaagactttggaataagtggaggcgtcagtgactatagatacaaacat

SEQ ID NO: 127090 - DNA, 1020 bp, Homo sapiens
atatgggatttgaaaggctatattaatagaaaataattacttgaaattaatgggagtttttaagttcccagatatatagacatttaattcactgtcaagttgcccattttgttctcccataagggtttgcctttatgataaaaactgcccttggtcatcattctaaccgtccatgtttccagtattagaattatgattctccagtgaagtgcataaggcaggagacataagaatctctggaggaggagtctgttttttttgaaccacacaggatattactagaggatgtgcagtgctcagataaactctgtggagttggaaaaaggttgagaactactgctagagaattatgtgttttaaccgagtaaaggaaccagatttacgaaattagacaaaaatatgaagttagatacaaatcagagtgatagtgtcatttctaaaatctgagcagattcataagaatggcaacatgattccctcacaactgttcatttcattattaaagagcatcaaatcattcatactattctttctagcctaagaacaattttcactcaatttcaatataaataagtttgtatatttcagagaaatgaatgtatgtgtttctttcttggaaagtaattaaagtataaaatttctgaaagtgttttctaatattccaaattgtggttgtattttacatttatatacagttgatggcccctttatgtaacttcaaagaaccttttattgggagtgcctcagtttgcagtaaatatttaagccaatttctggtcagttatactgagagtggtcttataaatgaataatttataatggtaatggcgtatatggtaaataagcacaatatttggaagactattgctgggaatggtttatggaagtacattctgtgatttttctaatatatttgttaatgtttataatttgaattaggtaataaatatacatccagaggacagtgtgtgtattatctagccacactggctttccatcaggtcagcaaatgtgctgagc

SEQ ID NO: 127091 - DNA, 1101 bp, Homo sapiens
ttaataaatgttgagtgactatatgaatgaaggagtggaatgtttcttgttatggaaaagcatacagtttggtggagaggacggatctttaaacaaattttgctctagaggcagaggagggagccacaaggttcccagcggaacaatttagcaaaggcagatagtagatgacatttcacctaggtgttgatgtaagagtaagaggcagtgaagggcattccaaggagaggagtagtaggtacaaggcctagaggcatgaaaagattgtggtaagtttgggaatcaggagaaattcagtgtagctagagtgtgggaaaataagagaaaacaatggcataggggtttggagcaatactgtgaagggtttggaagaggctactgagttgtgattttatcctggagatgggtaaatactggagctttcatctaggacattaatgtaaacacattttgtttttggttttattttttagaaatgtatttttggtagtgaaatggaagatgggccggaagagaaaatctggactcccagagttcaggttaggagaccaagataacctagataagagatgatgaggacttaaactgatgttgaccaggtagacggaggggaaaggatggattatggaacacagttgacatttgagagatacttgtgtgcaaggcacacagcaaaggttactgattcagttagtgacaggtggtgggggatgagcagggacgggccagttttgtaatctgggagagttttcaagatgtattccctctctgacatctattaactagcacagagtcttcaggatattattaggtgctcaataaaagtttattgtatgagaataagcaatattttctttatctctcatttggttgtatctttccctactttgttatttcattttttcttacattttatccttgtattctgacactatttcttagttttgcttctgttttccccagaagagtactttggttaaaatgtatcacttgcaaaatagaataacacaccgccatgtagtgttgcttcaggttataattttccatatatgtacagtatgccaaaaggatgctgcttctagagagaatgtttaaaactca

SEQ ID NO: 127092 - DNA, 1048 bp, Homo sapiens
agaatacagactggctcagatgaagtgttcgatatgtgttagctgctgttatgatcattagtattaaggttcatagaggggtcaggaatgttagcttcttggaaaagtcaatgcctggatggggacctgaaagacaagacaaagatagtttagggagttgagaatagagggaggcattcaaggccaaaggattttgtttttcttttttcttttctctctctctctctgtgtgtgtgtgctcttctttttgtttgtttgataagtaaggtttgttagataagtaaacatgtgtcatgggggtttgttgtacagattatttcatcccccaggtattaagcctagtgcctactggttatttttttctgatcctctcccatctctcaccacctccctctctgaaagttcccagtgtgtgttgctcccctctatgtaaattcatgaattcatatgttttattcagagaactacaaacagtttgctgttgttgaaaagctaaattattagagaagatactagatgagtaggaatgaaccagtctacggagcctgggatggcccgttcttctgaagctattaatatcacacaggtctatatgatttatctaaaggacatcatatcccatatatactttttttgaaaaattgtgttttcttttctctctgtaatacaaaaattccatggttggaattatatagaatcagggtgctttctcacctgtagccaatactgctatgtattaacctgccctaccatctgcaccgtgattacctttgcagtttttttttttttttgtacattaataatgaacggttatcgaaaaggaaatgatgaattggttttagccatgttgagcttgggatgctaatgagctctacaggagacatttggacctatgggaggactgaaacccagtttatattgtacaggctttttctgctttctttttttaaaactattttttggtttctgaggtctatgacctttctttgttttctttttaggcttcgcttctttgtctttttggtgattttctcttgcatttataact

SEQ ID NO: 127093 - DNA, 1058 bp, Homo sapiens
cttcatctcagaggggtactcagccgtgtgaggtgtcagtctgcccctactggggggtgcctcccagttaggctacttggggatcagggacccacttgaggaggcagtctgtccgttctcagatctcaaactctgtgctgggagaaccactacttcaaagctcagttggaaatgcagaaatcacctgtcttctgcgtcactcatgctgggagctgaagactgcagctgttcctatttggccatcttggaaccacccagcattgtgttattcttgaaggtaactgaagagattggataacttcagttctaaaatcaaacatctctaagaactgaccagataattaggtgcctactgagccattgtaatgtttttgattttgaggtaggaaaactgcatcaggctatggcagatggctgacatgatctgacttactatttttaaacatcactttgccttttgtgctgatagtggactacaggtacacaaggtcccaaaaagcgagacctgccatgacaccattgctgtgattcacatgggaggtaataggattggatcggggtgacagtgatggaggtgatgagatgttgttgcatttgggtttatttttaaggcagaacaagatttgctgaagaatgagattttggtgtgaaagacagggattaaggatgactccaagtttctgggcctgagcagttgaaagtaaggaatggccattaactgagatgagaagactataggaagaatggggtttggttcatggaggaaggtcatgtttggtttggaatatattgaatttgagatacccattatctgtacaagtggtgatgtggaggaagtgtttggataagggagttgggagttcaaaggaaaggtctgcagcttgagatatgttttgtgagttttcaaggtgcagaatgtatagtggatgaggtcactggcaactggggttctcaaccctggcctctggatatttggagaaagatctttagggcaaagggattaggaaataaaatacaaatcagcgattatgattcatttggaatggagtgggtccaag

SEQ ID NO: 127094 - DNA, 1092 bp, Homo sapiens
acactctagcccgatcacaacactaaaagggtgaaggtcaccagtgacttctacgtgacaatttcaatggtcacttctcattcatcttactggatttctcagttgcttttgacacatgatcactccctctgttttaaaatacttccttcatttggtttccaagctgcccctctttatcccttctccattactagctactcttcctcacttttttgatagtttctcttcattttctacagtggcataatggcccagggcttagtttttggagtacttttgcactttatctatgttctgggcaagagttcttaatcctgcattcaaattagaatcatatagggagcttctaaaggatgctgataccttggacccactccattccaaatgaatcataatcgctgatttgtattttatttcctaatccctttgccctaaagatctttctccaaatatccagaggccagggttgagaaccccagttgccagtgacctcatccactatacattctgcaccttgaaaactcacaaaacatatctcaagctgcagacctttcctttgaactcccaactcccttatccaaacacttcctccacatcaccacttgtacagataatgggtatctcaaattcaatatattccaaaccaaacatgaccttcctccatgaaccaaaccccattcttcctatagtcttctcatctcagttaatggccattccttactttcaactgctcaggcccagaaacttggagtcatccttaatccctgtctttcacaccaaaatctcattcttcagcaaatcttgttctgccttaaaaataaacccaaatgcaacaacatctcatcacctccatcactgtcaccccgatccaatcctattacctcccatgtgaatcacagcaatggtgtcatggcaggtctcgctttttgggaccttgtgtacctgtagtccactatcagcacaaaaggcaaagtgatgtttaaaaatagtaagtcagatcatgtcagccatctgccatagcctgatgcagttttcctacctcaaaatcaaaaacattacaatggctcagtaggcacctaattatctggtcag

SEQ ID NO: 127095 - DNA, 1734 bp, Homo sapiens
tgggcagattgcctgagctcaggagttcgagaccagccagggcaacatggtgaaaccccatctctactaaaatacaaaaagttagctgggcttggcggtgtgcgcctgtagtcccagctactcaggaggctgaggcaggagaattgcttgaacccgagaggcggaagttgcagtgagccgagattgtgccactgaactccaacctgcactccagcctgggcaacagagcgagactccatctctaaataaataaataaataaataaataaataaataaataaataaacaaaccagtctttattttaaaagaaactttaggaaacaaacccacataatagttgggaaccagtgttgatctctctcccttaccttctccacttgttcaacagactctgaatgccgactgtgtggactctcttcctcagactgtggggacagatacaattccactcctgtccacaggaacatgagatttagcagactaaggagatctgtaaagaatgaaccataccacaaggcatactgaagtgaggattataagagaaataaactcaaaatgctgttggaatatgcagagaattgctaccagaatattcagtaaggtttcagggagaatgtggcatttgaggactctcttagaatgagtgattcacctgctatttaaatgaattatttagatttttgacaaagatttaggtggacaccctaaactgtgtgtgcctttaaccagttaaaagaacagtgccttcagcatacttttttattagttgtaggaatacagctttttgaaaaagctataaagtttaaattaactaaaaatatgcattttcttacacataatttaaatgttatcatacttttttgatgaaaacataatgccttagtaaaatagctctatttaataaagaagattgagtactctgacacatttcatttaaattaggaaatttttaatattaaaatcccagtgttctgagttattgaaaggctttcttttattttgagagctttaggtctttttgggatgagaacattttagttgtttagtttgtttcttaagcagtgctattttttgtaaacacagataaatggaaaccattcttttcaatgcagaagaaatctagatatcccctactgtgaccaaatttctgtattacgattttatgttaaattaaactaatatggcaggttataatgatccttaagtgtaaagaaatcagtcaattacaagagtaattgtatagttattgagacctatagtgtgtggcttagatgaaagggagagtaaattttcataccatgctctctcctactcagtttgatctctctaaaattgtagtttggtttgatttaatataattcttagtagaaattttgaaagtatgctttgggattaataattatttttaatttttctggctgaatatcaaattgatagtaacaacagaagcataattttaggaaggctttcgcaaacctagccttttaagagaggtttttaacctgaagcatgagaatatatcacctgtggtttttcctttgagatgaaacgtagtttctagttatatcattacttaaagggcttaaaaagaaaaaacttagcaaacttttgaatctttcttttattgctatttacacatacatacacacatacaaaacctttaaattttgggatctgaatataattctggtaaacagctgtcttcatttttctcctctaaagaacttaattca

SEQ ID NO: 127096 - DNA, 1146 bp, Homo sapiens
aagtgtatattgtagctattataataatatttatcataataaaaataatatttcagttgtaattcctaaaatctttaattccttgtttgatgtaaaatatgttattcaggatgagacttgctttttaaggtatagttttctgagtgttgtacctattgtgctatggggctgtactatggggcaagtagtggccaaagacataaattcatgagtttttgttatttgcaatatttgtagttttctatacagttatattctgatgcttttcttttcatgataaaaagcaatcagaatataaaatatgttatgtatgtacttggaactgccatgtacatacctgggtatcatcattgactaaatataagatttgtttgaaagttatctcaacacaagtggtaagtggaattaaaagtgcaatttattgaatttttagatttgtaaagaatctaataacagattcatgatgttttctttttaacagatgggcttaggtcacgagcaaggatttggagccccttgtttaaaatgcaaagaaaaatgtgaaggattcgaactgcacttctggaggtattgttttgaaaactgcaaccacattagtaatttatactttttgcaatacttcctcagacagtggagatatcttcgagttctccagcatggttgctaagttgcagacctgttactgtcttttctgagaaatgaatacaacataaaaagtgttctgtcttactgtcattaagtttgacttagtgaattggaccataataactatttagagttgttggatttgcttgctgtctttaagatttccttcgagcctgaaatactgaatatatcatctttctggtggtaaataagtttgtggtaatcctccaggactgtttaataatttatttgttactttttttttgagacgaagtctcattctgtcacctagactggagtgcagtggtgtgatctcagctcactgcaacctccgcttcctggttcaagcgattctcttgccttagcctcctgaatagctgagattacaggcttgtgccacgacacctggctaatttttcttttttgtattcttagtagagatggggtttcgccatgttggcaaggctggtctcaaactcctgacctcaagtgatcagccca

SEQ ID NO: 127097 - DNA, 1034 bp, Homo sapiens
ctctttgtaagttggtgacttgcatctgtggccttgaatattttattatcacatgtggcataacagtatccacactttttagttctttatttttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaataatcattgtatctttttattcatatccttttttgagtgaaaaatgcttctgcaactaagcatgtgttacagcagggggcgatgtctccaaggataaaaattacccaaacgaaaataaaagtctgcctctgacaggacagcacagaatctagatgtttcattatggagaaaagataaggtttatgaaactttcaaatcaggacttttaagtttggtcatgcaagagtttttttctttttcaaagaaagggaaagtaattttaattaaaatttgggagagcttattttctattcagttggatctaacaagccttttatacttgggtttcaactctggtttctttatatgtaaa

SEQ ID NO: 127098 - DNA, 1038 bp, Homo sapiens
tcacgcggggcttgtgatccatcaattttccatcgtaccttatctctttctggggcttgtggtggacatctatcttattaggtgaaatagattataaccagaggctgagcgatgtggccagtcgtagtgctgacccgataattaaagcaccagtgaaagtactttccctgactattgtcaatgcagaatttactccgaagtacggtttcccattcatatctttcatgttttaaaagagccatttgctaatttggcagttggagagggctccaatggctcacgcatgaatagttgcccagtgtattttaccttatcacagttttatgttcaaaggagccctcgggcagaatgaaatattgtcaactctcttaggcaaaataatcaagatactttaattgctatgttaagatggtccatgaatgtgagaggattgtaagaactgacgttggaggcaatatagactatctggaccctctcttgaattttaagaagactgttcacattctgtagctttgggtgggggtttattctgtcgctttcatcagccagacacatgcacattgccatgcaaatggattcagaaaaacattatattcccttacagctaaactattatagctgactaatgaattttttctgcatgaagatgatctgaaaatgatgtacatcatgtttctctgtgctacagggacataaattgcatttttatgtaaacagtgtaagtggtgcttggattatttacaggtacatagctttccttccttgatctaagctaattgagctttgttttgaacgtgtaaacttccataatggaacataagtgaggtactttggttcctatcatttgcaagtctgtggtgtattcaatgttcattctttttgaactgctgaataacagagggaaaatttacatcattcataagaaattttggtagtacaaaaatgtgtctgatagcctataaaatgtactgctgttttaaaaattctattccgttttcaaacttaatggtgtataagctatagttattaacttaaata

SEQ ID NO: 127099 - DNA, 1133 bp, Homo sapiens
tatcaacctagtcattaaccacagttattaaaccacgttaaacaaccagcaaggggttaagaaagaaagttgctatgttttttctttcattgctgaatgagtctaacttagttactgtatcaaccttaatacagaacattgtttgcatctcaatggttctctaaaattattcgttcatggcttgagttctaaaattaaactatgtggagtcatgtccaaccgcacaatgcatctttatgtgaaacttgctagagtttttgttttccttctatgtaaaagtccagttgggaagctttatttctgatagattaaatggtataggtctttcagttttctcttcatttctgacaactgaactgctctcgccttgaacctgttttggcagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattctta

SEQ ID NO: 127100 - DNA, 1038 bp, Homo sapiens
atgaccaagagaaacataagaatctgagaacacacaaaataagctcttttgaaactatcaaaattataaacattaatagaattcaagggaatgtgatgctgaagtgatcccaagtcacattgtctttctgcctctgtgcactgtactctgcacaattgcatccatttttagaccatttccttctcatgagaatcatgtgcatggagggccaaaggagagacaagtgctcacaaggatatcatgagcacttatgaatgtacaaatgagtgctctccagtcagtgccatctttatattgttccggtttataggcaatgccttcatctttacctacagacacatgttgcctttctgtttcattttaatcctgttcatctatacatatttaatcacacaaatatctaaataagtttatgtcttgtagggaaggcactttgtcatgcttctttgtacctaagcatatgctttgcaaatcataaacaatagtgttgattttatttgatataaaaacttggattctcaaaagaaatctatgtgttcacacgataaacagagaccatctgaattgccaaagtatgactgaatcataagcagtattgttttagtcatctttacagaccaggaagatttgaaatacaggtgtaaaaagatgtgtgaggcatcaaaagaaatattcacctttctttgtgttcattttttttatttttgcttggccgagaaagaaggggtgttttccaagggaataggaggcttcagggcttattcctgtgcctacaagtcagagaggtcactggcttgccccttcctgaaggctgtaattacaggcagaggactatttattttcccgtaaggcgaccagaatcttgagtgtaaaaaactgtttacaagagtacactgtgtataggggttacacacaacctcaggaaaaataataggaaagtgagactatttttcttcatgtattcaataatatgagaaggtccaagactctggaaatgttctaaagtacaataatagagatgaatatgaggtcaaatta

SEQ ID NO: 127101 - DNA, 1034 bp, Homo sapiens
ggtaaaaaaaatgcttattttatgaaaagtactggtatcactgattttttttaaaagtggcttttaatttatcaaataagtatcaagaactacctaactttgctttactatacaaacgaatgaagcaaaggaaacagtgacacagaacttacctttaagaaattaaattttagtaggaaagatacctgataataatagtacctacagacaaagggctattcgaaaccacagagaatctatttctctgacgcttgcctaagagaatttcattccattaaattttataaagaaacctaaagcatttgaaggatcaaacaatcaacatcactgaagtccatatatttacagtaaataatagtgcgggaggagtcaggagtggagcacagatatggcaacctcccactttaatctgtcagagcagtgacttcctacaaagttctgtaaatgttttgactgcaccacagtgttaaatgtatggctaggcctgagtttctacaactcgtgttttagtaaatacgatgaagtttctgttacaaaatagaatggacattttttttccccccaaagacagctgccctacacaaaagggaacagaaagatgattttacttccttcctaccctgaagcctaatggcaaagttgctttgcaaatttttttctcccaagagtttgcagctgtttctgtctttcctattgtgcttatgttcagctctggctgggaacacaagctacagccccagctgttgggtgcaaagtgaatcaggtatttcacagtggtcatttgattagaaagaattatattgtttagctaacaacattttgtgtatggcagggaagacatttttgacatgttcctaacatttaatgatgtgtaacttatcttgtacaggtgcagctatatctgaaaatactgatgcatacatatatttaagtctcaatatctgcagagccatgtcaatgtagatgaagatttaaaaataatttttatttgcatgatcactctcttgggatacttcgaagtaaaatagtaggat

SEQ ID NO: 127102 - DNA, 1111 bp, Homo sapiens
accgagagacaagcatcttcagttaccgtgaagatcccattgtctatgaaattcatccaaccaaatcttttattaggtaagtagaagcttctgatgggtataagaaaacaatgaatacaaggatgattttgctgtagaatagtcaagaggaattgcagttttatctctggctttgatgctgttatgttgcttttgaaggcttctttccaattcaggagagaaaactatattcaggttctgagtgtagtttgacttatcaatgctagttcattccaagaagtatcttatcctgttctattacatttaaacagagtatagcaaaatagtttaatgtggcattgtagtatacatgcacttacattatgtacatatcaattctatactaaccttagtgcccagaagtggaattaccttttttcttccattctctagatatgtttttgtcctgcctgctttacacacagcttttctttatgccagactctctttgaattgatatctcattggacccagttcaatctgccttgtttccgttaattctatcagtctagcaacaatagttaagttcggttttctttgtatttttttcagaggtgaaatatttattttgtgtaattcggtgaataaaatacaaatgcatttcttaagcttatgaaatatgcattttaaaaatattttcaagttaaataagttgtttccaaagaacagttacccatgaacttccatttgatgttgactgtgcctctgacctgtaatcagtgcaggtgattaaattgaatccctctcttacagtacttggtggaaagaacctctcaacattgtcagttttctattttgctttgccagtggtgggagcacaataacaggtgttgggaaaaacctgaattcagttagtgtcccgagaatggtcataaatgtgcatgaagcaggaaggaactttacagtggtaagtcctttgagcaatggttctactcagagctctgcatctttgcctctaaccatgtggctttcatggtacctgagacatctcagtttcgcctttaaggtttgctagttaatttccttgcagtgtagccaagtagtattttttatttaataactgaaattatct

SEQ ID NO: 127103 - DNA, 1085 bp, Homo sapiens
cagttcctgttttttgtacatctttttatccctaatacctagttacaaatacaaacagctaagtaccacataagtacttaagggatcagtgtcccctaattatttgaacactggagcataattgaggaatctcttattatcctgaaggcagttatgccatttgtagaatggtaataaccagttggtatttgggacccaaagtgctacaacctgtgtagtacaaatatctatcatggctaaatgctgacttttctttatttgtcatttttagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaaggtgcatttttgttactgttcatttttagaagttaccttaagaacacagtcattacagtttaagattgtcgtcgattcttgtgtgctgtcttatatgtagtccataaaacccatgagttctgggcactgggtcaaagtctcctggggcccatgatagccgtctttaacaagctctttctttctctctgttttaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaaggtatatttcagtttattgttctgagaaatacctatacatatacctcagtgggttgtgacattgttgtttatttttggttttgcatttatatttttataaaaacctaaaggaagtatttacctctgccaagtaagtatttgacacaaaattacatggctcttaattttaaaagaacccatgtatatattacattatgattttagagtccataagctctcatttcacaaaaaggttaatttgagcaaaagtaatttgtttatcatctaagtgcaatagtaagaaattgcgaagctctcttttacaatccaggaagagttaagtt

SEQ ID NO: 127104 - DNA, 1067 bp, Homo sapiens
aagataatgacattaattcacccatgagagtagagcctcatgacctaattacctcttaaagatccctcctctgaacactgttgcattgggaggggattaagtgtccaacacatgaactttgggggacacattcaaaccatagcaaaggcaatattactcaatttttttaagtaagcagaagatttgaatagacattttaccaaagagacgtaagaatagctagctaatgagcacatgaaatgaaacatatgcccacatgaagatttgtacatgaatgatcacagtagttttcttcataatagccaaaaaccagaagcaatcttaatgtccatcaacgggtgaatggataaaaaaaaaatgtggtgtgtccatacaatggactaaaccattcatcaacataaaggaattactgatgcctactacagcatgataaacctcagaaacattatgttaagtgaaaaaaaggcagataaaaaaattacatgttgaatggttccatttatatgaaatttctagaaagaggcagaactacagagtcagaaaacaaatcagtggttgcctggggccaagagaaggagtgaagataaaccacaaatggacatgagggaattttctggaatgttgagatgatctaaaactggactgtgatgatatgatagctgcacgtctatataaatttactaaacatcatttaatcactttaatttactaaacatcaccaatcacttaaaattggtgagttttatgatctataaattatacctcaacaaagctgatttataaaaaaagagcctgatgaaattttggatgtttagggcaagtgttgggattctaagcttcttgacagccacatacatgcaacaatacccccacctccccaacaaacacacacagacagcacagaggccaaggcttccaccatagccacagtcactcagatacttgactggaaatgtacatagatttctgcagataggatggtgctatttctttctcactctcatcgaaagacactattttgtgctacataaaggctgaacctgaataatctgtacataatgctgctt

SEQ ID NO: 127105 - DNA, 1584 bp, Homo sapiens
cacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttgctactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatg

SEQ ID NO: 127106 - DNA, 1032 bp, Homo sapiens
actttgggaggctgaggcaggtggatcacctgaggtccggagtttgagaccagcctggccaacatggtgaaaccctgtctgtactaaaagtacaaaaaattagctgggcgtggtgtcgtgcacctgtagtcccagctactcgggaggccgaggcaggagaatcgcttggacccgggaggtggatgttgcagtgagcggtgatcgcaccactgcattccagcctgggcaatagagcaagactccatctcaaaaagtttaaaaaaaaattcttattattgagaaggtaaactcaagcaaaaagctattaatgtggacaatattcattcctaattctattctatagataaattatgttatttcaccaataaagtgtaaaaacttctgttgcagacaggaacttgatagcagctgtagcattagtggagtttttcagactttgtacattaaagtaaatttgtagtaaattttcagtgcatttgggagccatttttgcatgagtagttgaatagatagaataattgcatgttagtgtgagaatacagatatgaaaacacttagagcagagaatctaaaataatttttaaggttgaaaagcaggatggcaaaacttggatctgtggttccaagctatgacctaaaagcctaatcagtcacctgaagcaaaaatttgttaaagttattatagcaataatttgttaaataggagattcatgcatatcaaagaaaatggggtctttgtcttctgaaaaccactctctgacaggttccatgaaaatacccatggctgtttcaaaaaagaatttcataaattttattttgaggattaagtatagtttttgcattcttgctcttatgacatatttacatgtttcactatgcatctaatgactgagaacttttcttatacattctaattcgcagtgtttctactggaaatgacttttgaaatccatttacctccatcttcattcatttactaaatataccacatttcactgatttcagtactgatacttttttatattttaagat

SEQ ID NO: 127107 - DNA, 1018 bp, Homo sapiens
tgaaaacacataaaaaaatttattttttcaattagcatatagtgagtactcttttttgatgacttttagcacatgtatagatcaatgtaatcactaccaaaatctagatacatactagtacagttccatccaccccagaactctgtttctttttcctcgtctcatttctctgtttgtagtcaaactcttccccttccccacccctcagcttctagcaaccattcatcttttcgtcattgctctaatattgtttatttgagaatgtcatatatagggaatactgtagagttactatgtaaccttttgagattgacttatttcattcagcataatgcttttgaggttcatttcagttgtcacatatattaatggtttgttcgtttttattgctgagtgatatttcattgtgtagatataccatggtttatttgtctgttcacccatttatggacatttgggtggtagattatttccagttttgagcaattatgtataagtttttatatgaaaataagtttgcatttctgaagggtagatacctaggagtgggattgctgtgtcctgtggtgtgtgcttgcttaattttataagaaatggccaaactgttttccatactggttgaatgattttgcatttccacagaaatgtatgagagttcctgttctgcatcctcaccagcactgggtgttatgtcctttttattttagccatactattaggtatgtagtagtatttcgtgatttcaatattcatttctctactgactaatgatattaagcatctttttgtgcatttatctgtcttatatatactctttggcggcgaagtgtctattcaagtcctctgcttactgttttcttacttttggagtcttgtgggtactttatatattctgaataaaaatcctttgttgaatatgccatttgataatattttctccagtttgtaaacttgtcttttcattctcttaacagaagtcttccacagagcaggttttacattttgaataagtccagct

SEQ ID NO: 127108 - DNA, 1053 bp, Homo sapiens
cttggagatacattacatatagcaggggtgtccaatcttttggacacattggaagaagaagaattgtcttgggccacacataaaatacactaacaatagctgatgagcttaaaaaaaaaaaactcacgatgttttagagtttacaaatttgtgttggattgcgttcagagctatcctaggccatgggttggacaagcttggattttagtctgcctgcattgactgttaagggtgtaaacaagtatgtatttctatttcattccccttcatatttactaaccaaaaccttttttttttttttaatactatgttgtgtgtttggttattttggtcatgagtgatattttgatcttgcttgtgtttggggtgggaggtgttaatacatcaccaaaacaatctgcgttcattacattcttgaaacatataacaataataatgtagataacataattgttttgcagatgttcggttactgcttaataatgacaatcttctcagggaaggagcagcccagtaagtattatttatcatactaacctaactaaaatgacatgggaaaacgagagatgctttaaaagtgtgtgggggttttttgtgggtttttttgttttgttttgagatggagtctcactctgtcgtccaggctggagttcagtggtgcgatctcggctcactgcaacctctgcctcccgggtacaagcgattcttctgcctcagcctcccgagtagctgggactacaggcgcgcaccaccacgcctggctaatttttgtatttttagtagagatggggttttaccttattggccaggctggtcttgaattcctgacctcgtgatccacctgcctcagcctcccagagctctgggattacaggcgtgagccaccacatccggcctaaaagtgtttttaaagcactaatctctgacatagatatttgcacatcaagttcaaatgtgtatgattttatatatcctagccagggtaggagaaaaatattttttatcacagaaggacttagaggtacaactatgacatgaaattattcactgtgt

SEQ ID NO: 127109 - DNA, 1082 bp, Homo sapiens
atatttatataaatagcatgaaatagttatacatttgactcaagatacgtgaaagtatgggacttttatttgtccaaagaattattgatctgttaatgattgttagatttaatttaaataaattatatttgttgtaagagaaatttgaagatgagcttcatttctcttttattataaaccaaatttctggaacagctgtgatccacacttcatgtgcattgtaacaggaaatacatgatattctgatcttttaagtaaacgagtatttgaggacatcggtaattgtgataaaatatgatgcttatagtatgaccctcagaaaaaactcatcaaaacctttactagaaacttcagattttctttgcatgtagttataatctcagtgaatgtttgcttactagtaaaaaaaaaaaaatagtttgattgacttcagtagtatgcaatttctcaaaactctccatttgagttcatgttgtagacatctctgggtgtctgtgaagtacagaatatatactgtaagtcactgattgacttgactttagaatgctattactctggttcacagtgtcctctctgtgaaataatttctgagcaaaagtagtgttaccctgttcttcatcccacttagttctgaattacttttgtcctcaaaagataataatttgttacctatcattgaggccatccaaaactacgtaacaaaagcttagaaggcattataaaaacatttagaatgtgttccagtggcagtttcactagggtaagtgtatagctatagactgtttctttttcacttgcactttttgatgttgaatttcttttatacaaatacatctttcccacatatatgtatgtttcctcctttcctccacctttgccttgttgctttatctcctttttttttctttgccctttaccgtttttgtagtggggaaaacatgacaattattctttagagtggttgtaatgggacatctttacaaaaagctaccaactcagtatgtttcagagcaaaattagccatactgaagagttggtattgtcaagtcaagaacactttgaaacatccagaaatagctttt

SEQ ID NO: 127110 - DNA, 1088 bp, Homo sapiens
gttttatgacctgaagacacttgaatttatctggtccaaactactgtttttgtatctataaagtaagtgaggtggcctgtactggttaatgatatggttgaagcaaaatttggatattatcactcctagatgagtaccttttccactgtactgtgtaattgtcaccatttaacttattttgagcctttaagataaaattttaacctatttcatattacttgtctccttttcagatttcctatttttcctttatcccctcctcccaagttagaggtggatggcgttttatattacgggcaataaaaggctttcagtccagcctgggcccaatttactgtttaaacttatttaaatatgaccttactggaaaatgaatccaaaattctaattgacttggttttaaacatacttttgggataaatcatttaaggattaataatgccctggctgtattgagtttattcttaggaaaattacagttttcgtgaattaggaaaatgagaagtgaatagcttcttttttctttctcacccttgtacacttctgtattcaatgtcatcttttttgagcatgtagtatcaagaatttgacagctaataatttaattctactttgctatttttacatttactagtctcctattaactcatcagtaatgctttgttcaaccaggctttcctttctagaggagactcaggagctaatacctgaaaattcagtggacgcctggccatcccgaataatctggaagtttccaagtagattagagatgtatttctgagtttggaaattctcagtatcctttctgttaagtgacagtgatttcccagattttagatttaatttaaaaatacaatttttagataatattttatactcttgagaattttttctatacatatatatggtaatgtattattctttactcttatggagtagatagagagtagctttattcttggatccatctcgtcaccatttcctacctcacactctgcggtttttaaccttagcaactgcctaactgctttttctggctctcgttgctccactgcccaattcatcatctacactgctgccaaattaat

SEQ ID NO: 127111 - DNA, 2512 bp, Homo sapiens
tgtgtacgtacacacacacattttcattgcattcttataaaataatgaccagtcgcttctcggccttttggctaagatcaagtgtagtaaaataatgaccaaaaaattctgtgtgtatgcaagtatagacatgtgtatatctttatctgtaagattttatgactatgaaaaaaaatttagaaaggtatatcctgtgttgttagcatgatatatatcagagggatggataagtcccgacatagctaaggagtcaaagactggaagaattacaagagaaggaaaaggggaaattttttaaataaagcacaaaatatcagattatacattatgcattgtggatgtattatttaaatttatggaaatgaagtatgtttttaaatacttggaagtcaattaaaatcagttgtcaatgtagtttttaagaagcaagaaacagatacgtcaaagtaggtaagactgtgggcccagaggcaaggtgggggacacaccaaagaggatttgcaccagaccaaagccattcaggtaaccaccctgattggaggttctcacaagttctgtagttttgaggaactggagtctgataccagacattgtaaactgttagagttctcaaagcagaaaacccaccaaacccacttgaacagtgtttttagaggttgcattttttttcaccagtagctggaagttatattgggagaaaatctgatctgcactggatgagagtaatgtcattgtctgtatagtcaactcatttgaagtattaatagttgtaccatatggttaaaatatatgcttggagtaggattgttttatagttttaaggaagaagcttaaatgagtgtaattatgatgtatcaatattgaaatgctgtttttttattttttttctaaattcattccatcatcaaaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtaagtcatcagtagcagctttgtgtgtgtgttttgtgtaaatgtgagtctttagcgtctcttaaaatttacagtaacttacagaattgacattgtataatttgtcatttttttccttaaatatttctaagaatgtttactattttttcaagaaattctggataataaatagatatactaggatggcttaaaatagagaaatggttgtaccttgatttaaatccatgtagaaattctaatacattgattaaaggagcaggatatggtgagattctgtaatcttatgttcatgactcgtctcagtttagatcaaagttatttttattaagtcacagaaatcttagaacaaataaaattacttggaagtaaaattatgtgtttctgtattttacagttacatttcttgtgttttttgtgtggttctttcgtaggttcaacctatttttatattttcaagaaatatatggctgggcacagtggctcacgcctgtaatcccagcactttgggaggccgaggcaggtggatcacctgagatcaggagttcgagacctgcctggccagcatggtgaaaccctgtctctacttaaaaaaaaaaaaaaaaaaaacaattagccgggcgtggtagcacgtgcctgtagtcccagctactcgggaggctgaggcagaattgcttgaacccaggaggcagaggttgcagtgagccgagattgcgccactccactccagcccagtcaacagagtgagactctgtctcaaaaaaaaaaaaaagaaaagaaaaaaaagaaatacaaaatatggtagtaggaatacatttcttttttaaaaatttcataatattatttgtaccctgacaggcttttttagcacccccagtttgtgcttcagtggccttttccattgccagagtgatcttttgaaatgcaaatcaggtcattaaaattccctgcttgaaatccttcagagatttcccgttgcctggacttaagagtccaggcttttgaaggtggcttaaaggccctgtgaccacgtggcctctgcttacccctccaacctaactctaccatatatcctagtttatacctgctttctcaatgtaattattaatatcaccagtagcgtaccccatttctttcttggaagtttcctggttaggacaaaaattcatatggtctgcttaagtatctagctctctgattatttgagaaatattgcaacataacctcaaatatcttatgtattacttgaattataacttgttcatcaggattattttggaggaataacgagagttaagggagtacttgttagagagtcctcatttattctagaggattgaaaggcacaaattaattattatttttaaagcagtaggcaagaggtgaaatagcattgtg

SEQ ID NO: 127112 - DNA, 1077 bp, Homo sapiens
agttaatacaaagaactatacttcaagccaggcatctgtaatcccagcacttttggagaccaaggtaggaggatggccagaggccaggagttcaagaaacctgggcaacatagtacgaccccatctctaggaaaaaaaaaaaaaaattagccaggcatggtggtgcgtgcctatagtcctagctacttgggaggctgaggcaagaggatctcttgagcccaagagttcaagcctgcagtgagctataatcacgccactgcacttcagtctgggtgacaaagcaagaccctatctctagaagaaaaaaaaaagaaatatacttcagttcatctaaaatataggtagagtaaaaatcagaagcaactagtcttagatgtttcttagatttcagtagagaccttctcttctttgtctctaccatttctccaggatctagcagtattaggggcttaatataaatgtttgttgagtgaatacatatttgtaattacagagttaataaacgagaggggcagaatataattaaaggctaggacatattggccatttactctactaataaaagagtactatctactcagtgtcatttactgttactgtagtaattaatgcctttggaagaatcttttgaaatagttctcaaattggtaccactacttggtttggaattatttttttttcttttcataatcaatggttatataaatgtatattgtcctagtcagtattttatatatgctaaggactcactagctggcttggcactaatacctcaataaaaggaatacttcttttggaatcatgaaacaaaagtgaataaacctccaagttatttttccaaccaaccttctttgaaaaatcttggatgagtcactcaaatcaagacatgttataaaattatctgttattttgtagaacatatacattgttctaataataattttcaaatattcagtgtaactgtaagtatgagaatacaggttgaatatctcttatccaaaatgcttgggaccagaagtcttttggatttcaaatttttaaatatttacatcatacttaccagtttaacatccctaa

SEQ ID NO: 127113 - DNA, 1050 bp, Homo sapiens
aaaactcatgttaataagtatagtcctttatttccagatatcaaaacctctttaagagtgttgtataacatttactagtcattctttttaaattgtatggtactttgtatcattcagtagatgttaaactacactgagtgtattcataaaagcccctgttaatctaaacatttattccatttattttggaaatataagtgatttgattgaagaagtagcttaaaatttatctccacagtagcttatgacttagttttgtattggtttttgttttgttttgttttttttaaggctagtcaagtggagatggaacaaagaaacctgtaactgattgtgatcaattagtggcaaacagcactgcacacacaccagcctgaattgtattttaagccttagctttagaattctggcattaaatccattatgtaagttctttcttatcagtagggtgaaaattaaatatgtatcataactggacttaaccttttgattatttttgactatttcagtgattaaaaatttaatgtccagtattcatcccccacactctctcatactgtagcatgaaatataatctgaaacttaaaattgattcaaattattttccctaccttatttacagctgctgtttttatttttaaggaatggtcgttggaggtcagaatggaagtttacaatcactccttcaaccactcaagtggttggcatcttgaaaattcaggtatgaaaaataatttgtttactgatctttagatgattctgaacagagaaacaactaattcctaagtttacattttcatagtatatcatacacatttctttttcaggtctttgttttggggtaatgggaaaaacaatagtgctgttttaaatcttttaaataacctggcagtttattccctagtcatcaaaaatctgcaaggatagctgacagattataaaacacagctaaaattagatgctgccatttggtctgctcttcagatacaatttgttcatgcaggcgtcttctgagtttgagttgtgtacttctctcctctgaattgggtg

SEQ ID NO: 127114 - DNA, 1085 bp, Homo sapiens
caggtcaatagaaggcttgcctgaataactacaggaatatctctaactagtctcctcactaggctgagggcaggaagagtcttgctggagttcaaaagttttggggctcagcagagaagtctagactagagctgaaatatgtagtcagtctgcattgatatgcttgttgacgcaataaggttcttgatgattcctgtaatgtggtttctgtaatttctttttctaataggttcattattatgaagatggtaatgttcagctagtgagtcataaagatatacaagattccctaacagtgtctgtaagtaattaattccacaataaaatttaacctaatacttctgtaaaaccagaacagttttggaatgaacattttaagtaatatttctgcttcagattaccgtgttttctgatagattaaagataagtaattgcaaacctgtacctaacttttttgcagctttgagatataatttgtataccattcagttcattcatttaaaatataagcttcaaatttttctcttttttttttgtatattactaacagggttggacagcagtcaccacaatctaattttagaacattttcatgctccttaaaagaaacactgtaccattagcaatcattctccattctacccagcccttcccccagaaccctcccagccctaggcagtggctaatctactttctggctctgtggatttgcttgtgctggacatttgatataaatgtaatcataatatatagtcttttctgactggcttttttcatttaacatgttcaacattcatcctttttggagcatgtattagtacgttgttcctttttattgccaaataatactctgttttatggacataccacattttatccattcttcagttaatggacatttctgtgttctactttttgctgctgtgaacatttgtgtactattttttgtgtagctttttaaatttatttttggtatatacataggagtggaattgctgggtcatttggtaactatgtttaaccttttgaagaactgccagactgttttccatcttatagtttcaccagcagtgtataagagtttc

SEQ ID NO: 127115 - DNA, 1695 bp, Homo sapiens
aagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttattttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgacattttgtctaaatcatcttttctttagttttaaaatacaagttttggcacattgggattcctaaagaaaatgaattggtaacattaattatctgttcctttttaaaatatatatatttgaaagtttgatgatggtgaactaaatactagatctaattgacaagcttagttgtatcagttaggccatcatgagtttctatcccatgaaagtcatcaatttcctatctctgttctagtctggaatgcattactgaaaatgtatgcaactgtttttaaggtgatttgcttgtgagacggaagatttatcaaaaataatttagaacaggctgggcgcggtggctcacatctgtaatcccagca

SEQ ID NO: 127116 - DNA, 1751 bp, Homo sapiens
tgtctcagcctgccacctcagtcttagtagctgagactacaggtgcacaccacagtgcgtggctaattttttttttttttttttttttttgtagagacagggtcccctgtgttcttgaactcctgggctcaagcagtcctactgcctccacctcccaaagtgctgggattccaggtgtgagccaccgtgcctggtcaagttatttagaagacttttttttgtgttaattaagctcatgaatacagatgtaaaactcttatattgttgacgtgatatagaacttaggctgcagctcagttttggcattttttcatgttgagaatttttgctctaaatttacttaacatttagattttaatttacttaaaatttacataaaattggatttcccttctagagggtctggttgcagtttacataggtcttttgcccctgttgtgcctgttgtctaaaatgttcttccctatctgtaaatcccacccatctatcaaggaccagctggcatgctgccttctgatcctttcagctgcagaaaagacaggcttaccttggagatattgcaagtttggttcccggccactgcaataaagtgagtcccatgaaatttttggtttcccagtgcatataaaagttatagtcacactatattgtattatattaagagtgcagtagcattatatctaaaagaccaatgtatataccttaatttaaaaatcctttattgctaaaaaaaaaaatgctatctgagcctcaggaagtcataatctttttgctggtagagagtcttgccttgatgtttatggctgctgactgatcagggtgctggttgttaaaggttggggtagctgtggcaatttcttcaaataagacaaccgtaaagtttgccacatggattggttttcctttccagagaaagatttctctgtatcatgtgatgctgtctgatagcattttacccacagtaggactttcagaattggagtcaattttatcaccctgccacggctttatcaatgaagtttatgtaatattctaaatcctttgttgtcatttcagcaatgttcacagcatcttcaccaggagtagattctatctcaaaacactttctttgctcatcaaaagaaacagctctttatccgttcaagttttacaaggaattacaacaattcagtcacatcttaaagcttcagttctaattctagttattttgctgtttatggcatgcctgcagttactttatcttatatgaattatggtatatgtgtgtgatatatgtgggtcagtgtttgtgtatatatgcatctttttttgtatatgtatgttttattacttcttctagattctagttcttcatcttccagtgttaattccttgtacaaagtaggtccttatcattcactggatgaatgaatatccaagttacggtgtatttagtgagctgggattggaacaatacaattgatcaaatgcattactgagtatgtgccccatctaagtttgcagctttagattgtggtcagaggctgttacaagatcttatatattctatgatgggccatatgcatctaaagcatggtggttcagtttatgaatatataaaaggacaattttttgattaatgtcagctttgagtttagaatgtatcccagacatcttagttgcccttaattatttttggagatatttttctcagccattaataaagcaatccgaatgatgcatttttctctgagcttgagtttttgtatatg

SEQ ID NO: 127117 - DNA, 1108 bp, Homo sapiens
atgttgaccgtgctggactcgaattcctgggctcaagcaatccttctgcctcaaccttctgattatttcgactacgggtgtgcgccaccatgcctggcttagaaaaggactttatgttgaacctcttttctcttacaatcaaataataaattcattgagtcatactattagcgagtcgcagtgcttggtgcgggtgtagaggaatggaatgatgaccaagacatggtccctgtcttcagtatcttgagatattgagcactcagggaaagaaaaatgggcacaaaactataatgcaaagtaaaatgtgtagagcacaaaggagaaataaataccaaaacaaggggatgagagaaagctttcaaatcatagtggtagttactggaataactttaggaattcccaggctgcttggagaatatgagaatgtgcatctgcttggtcccttcagaaaactgtcagtgtgacagatgggagggtgaaaaagagggaaaagctagaatctgttggggttaaattggagttcattttgaagcattaaaaataattgaaattctgatatattttacctgtatagaaagggacaggaaataatatgagaaataataatagtggggtgacccatcatccatatttaacgtttgttaacatttcgccacaagtgttcatattgctttctctctctttttcaaaaaaactattttttagaacccttttagatgtggcagtttttcagactttccttgtttttgataactttacaattttgaggagtatcatatctccctacaatcctcttgcatgtggcagtttttcagactttccttgtttttgataactttacaattttgaggagtatcatatctccctagaatcctcttggatgtggcagtttttcagactttccttgtttttgataaccttaacaattttgaggagtaccagtcaagaattttttagactatcgcttaattgagatttgtttgatattcttcttatgattttctgggattttgagtttttgggaggaagaccacagaggtcaagtgccatttttgtcatgacataataccaacttatcactgttgatattgaccttgatcccctggca

SEQ ID NO: 127118 - DNA, 1272 bp, Homo sapiens
gaacaaaacatttatgatgctttaatctgtatttgtatgaataaaatttgattcaagtggaattaggagtaatgggaacttagcatgttttatgtggaaacttagcatgttttatgttttcgttttgttagctatttttaaaatatggctgtgtttaaatatattgctactgcataatgcctagaagtccacaggcctctgtattttgttccttatgatatcatctgttctcaatgcactacttttttttaaagaaagatatacacattcctagaatcttttacattcccagtgaaatgccaagacaggtctgtcaaatctaattttacagaagtggaatgtatttgtcaatattttataatattgacaaaaataacttaatttttttttcttcattttatgtatcacttcttgtgacttgtgagaacaaatttttgatgttaacaagtcacatgtaagtttaaaatctaatattattttaacattgtacagaacaggaatatctaaaggctgttgttcctaaggctagcccagtttcagtccacttcacttacagccatctcctgtgatggtaagccacaaatgtcccctgttttcctctctgccttcatattgattattactaatgtaaaaatatttccaatttttacaaatagttatgtgtgtcaggttttaatgaaatgctaaaggacattactaatagaccccaagagattccgtttcttcttcgcctgtcacacttcctgcccaagtgctgatggactgtggaaacaatgactaccatggaccactgtttgaagatgtagtatgctgaattcccagacatcaacttaaaaataaattctgctcatgaaaagtatgcagggcatgtttctgcttaaaaaaatgtcctgggaaaaaatctaaattgaattcagaagatagagtaccatgtaaaagagtggccaagttataggaagtatttattttttatctttaattaggtattttaacattcaaaaagctaatgcattttgtttcttagacataaataaatacgtagatcataaatagaaatgtttcagagatgttttatttaagagagtcaacaatagtaattaaattaatactaataaataatgctagctcctgacactttaccattgacactttcaccagtatcttacatgaacctcatagcaactcatagctcatgtctgtgaaaactgaggcacagagttgcctaaagaaggctccaaagtggattttgctttaattccagtactttttcca

SEQ ID NO: 127119 - DNA, 1096 bp, Homo sapiens
ttgtgtgggtagatcaaaaagaaatgggttggtcacaaatgcttactcatacagaggtatacacaggtgtgtgcacacagccttaaaatgactgagttgctctggaaaatgacagaaattcatgtaaggcacgatgaagaaataggagaaatacatgtatgtaaatatattcctagagcagcgtttttcacatttgaacaatagttgcaaaatagctagtaatggaattgcctgcatttgagtactcactgtgtgccaagcagtgttctaagtacttaagattactattttactgttacatttgtatgtatttatgtgcctagaatatatgtgtaatagtatacatattttcacatacttgtgattgagtgtacaatccttgatctgtcaatctaccataagctttgagaagataacaatgaactcttctgtaattacttctaaagacagataatgtttctcatttctgatattcttaattcccttgaaaagttctttctatatgctgcgcaaaaccaagaagactgatatgcatgatgtctttgtggttaattgctataaagccaatatttaaatttctttgagtcctcttttactgcctggtatcatgggatgaagagctgcgcaggaggggagtgtatacgtggctctcggtcttgtgcattttgtgacaaaggaattcccctttcaatcacgctgctctcctggagcccctggagcctctggctcaagcagcgcagtcggtctgtgcagtgtccctgacgtcatccagcgtatgcataagccctgctattgtcttactgctacagcagggctggggattgcagtatccgctgttgctgctgctcccagtcctgcccctgctgctacctagtccagcctcaccgcatcccagaagaggcacgtcggccttcatttgcctagtggattttcaaaagcagctcttcggtttttggtgctgttaagagaccttgcatttcaatcacaccgggagaaaactgaagctcgtaacaggagaatctggcagctggacacagcttggactgcattgtctggcttcatgacccctgctgtgtagccggctcatctcttcact

SEQ ID NO: 127120 - DNA, 1049 bp, Homo sapiens
atacttgtttaactatctattctgtatacagtactgtggtagatcctggtaagggttaatttttttctaacttattctgatttcgtgattcttacccttgattatggttgcagtgccttacttgtataggatgcttttactttttaaattgaggtatgatttacatgcagtaaaatgcttaagtctaggtgtgcagctcagtgaatttttgcccatgtttatacccatagaactctactcagctcaaaatacagaacatttccatttcccctggaagttctcttgtggcctttcccagtcaatattatttcccctcttcatgaaaaggtaaccactattctgacttctgatgccatagattcatgttgtaagtggctcttttaaactttctttatctcccccttgctctttgcctgtaagagaaggaaatgtcttcattttcaaatattgtattgattaagttgattttatgtttcagacctttgaggtcagaaatttgcagtagcctggatatcacattataatacattctgtcttactgaaataatattgttttaaatacttgcacccttcctcaccaaaaaaaacagacaaaaaaagcctttaaaataccaaaaaaattatgtggaagagtaaacgctagttcttcaaagttaaagacttacacagctatggcaatagaattaataaatgctcttttatgcctgacactgctttcatcaatatctccaatgatactagtctcatctctttgacttagtgaatctgaatctcccacagttgtgcagattggccacagtcagtctattttgggctcactttgaaatgggtgttctatagtatgtgtagactaatcatcacaaagcaggaagtatagcttctgtaactccgtttattaccatcttgatgtatttcactgagcttttcctttactaaagtttcccatgtctaaaaatgggagtagcgtgtctgctctttaactgctttgaagatatacagttttagtttctgtggtcagaatactttaggtgtaagaagaaagtactatc

SEQ ID NO: 127121 - DNA, 1049 bp, Homo sapiens
tttgggaggccgaggcatgaggattgtttgagcccaggagttgaagacaagcctcggtaacaaagcaagaccctgtctctaaaatgaatgaatgatataaaataaacacaccagtctgtgtcacattatggttctcagtaatgtcaatgtgttaatgattcagagccaccactgggctcttctgaatgaaattcctatcagttgacaataaatccccagagtgtagcagggtacctagcatatatcaagtgctcatgttctttaaaatttgaatctgctgtggagtaaggtaatatcattgaaaatatgatgtgtgggcttgtagggtgttaatattgagtttaataaaattttctaggccaaggagtttatcacacataatgggtacatgtcagaaacatgccagtaatcagctcttgtcatccttcagagcaggaacaaatgacccaaacaaaataatagcatatggacttttattactaagcccaaatttgttagtgggtaaactaccatatactgataatttgccatgtactggtaagttgactatgtctaatctaagtttgcttaccattcttaaaggttaagtaaaaataatgagttactaataatcatcagtttatgtacagcatgaaaattgagaattgtttgcttgcaatactgatataatttcaggaactagaaaaattattttacttttttttgtgagcatttcagactgttaagattgaggcttttggcatattttgggcagtagcaagcccgattgtaaagcgtatagattaggaaatcacagtgactccattggggtattctttactacctcctccacctctggcttcttctagaacacctagttttcagggggaggctttggtagggtctggcctggtggtacgcatggatggtccaagcccggacttgtctcagaagtctgaatttctcatctgaaactttcctaggtcttgtgttggtataatgatgtttcagttacccattgctacacaacaaactacctcaaaacatactggtttaaaacaattatgtat

SEQ ID NO: 127122 - DNA, 1069 bp, Homo sapiens
aatgaaattataattcatgcatgtctgctttatattgatttgtattactgtttgtatacatgcttttttttttttttctttttggagacagagccttgctctgttgcccaggctggagtgtcgtagtgcaatcttggctcactgcaacctctgcctcctgggttcaggtgattctcctgcctcagcctcctaaatagctaggattacaggtgcccgccaccatgcccagctaatttttgtatttttagtagagactgggttttactgtgttggccagtctggtctcgaacctttgacctcagttgatccacctgcctcaggcttccaaagtgctgggattacaggcgtgagccagcacgccgagcctcatcctgtattttttaatgttctgttgtactttataatggagggagcatctcttctggtttacatgctctggagtcagtcaatagactgaaatgctcattctactagctgcacgaccttgagtagattaacttctctggcttcagtttcttaccctgtaaagtaggcttatactgtgtcatggagctgctatgaggtcgtttttattgttgttgttcttcttcctttttttgtttagagacagggcctcactctgcacccaggcttgagagcagtgacacaatcacagctcattgcagcctcaacctctgggctcttggtgatcctcctacctcagcatctcaagtagataggaccacaggtgcacaccactatgccctgctaatattttattttttgtagaggcagtcttgctctattgcccaggctggtcttgaactcctgggctcaagcaatcctcctgcctcggcctcccaaagtgctgagattacaggtgtgagccactgtgcctggcctgctgtgagttttaaatgccttaaaatatttgttgcctagtaaaggctcaatgaatgctacctactgttattaggtattattatattagtcatttatgttattgcttatccttccaattgcattcaatatgcccatttaaacatttgctgtatgaaaatctatgatgtgggaggggttaaaagttatt

SEQ ID NO: 127123 - DNA, 1075 bp, Homo sapiens
cagttagaggtttttttcctttaagggaaaattcatgcaattaaatattaaaatgagatttgacataatctctaggtcctttatgttaactgtataatatattttagcatagtggttccactctatatatattctttcatcatgattgtaattcatacataatttttttacttgaagtttttaatataattgtttaggaatggattaagtaatgttttgaacctcattgcaacacataaaacaattcacctttttgttttagaactaatgtaatccataaaggattaaatagacatgtaataatgagttttcattgaatcatcacaaaacacatgctattaataatctttggatattttctagctctctacttcctcacgtctgattacagcaatttgggggaggaaaatgtattcagtcttagtaattttttattttgacttaaagcctcccagtggaggaataaagatgaattatttttgcttatagtcttagagttgttgttagaaattggtgttgatgaaaataatgactaatgaagcaagcattggtatgtgttgctgggacctttgagactattccttttcagtttttccattgtggcctaagaatattctgtctgctatttgaagaagtcatgtttgagccaaattaaattttcaggtcaagaaatatttacttgattaaacataaattacttttgtgacaactgcctcatattcccaagtcaacaagccttctcagaagaggtcagggagtttcctatattgtttaattgcctttaaccaatggaagcttgtcataaatggggtctaaagggagcctgacctcatctcccaaggtgaagaagtgattgtctacaccatcataagacaaagatgttgctattcattgcaatccctcagattatttcataaacgttacttcagttcctcagattttattattagtgctatcaatttttaagtccaaacttgcaaaataacatcaccacacccctgtgagatagcaagtattatttccattctcagttgcagattccagttgagtattaatgcctgttttgcctgaagat

SEQ ID NO: 127124 - DNA, 1002 bp, Homo sapiens
ttatcttttgtacttactgtcattttcccctttaaacaactttttttggccttagtctttactgtcttttctgagaatcctattagagtttaagatttaaaactagatgtagaaatacatccttgcttagtgtcagggagccactgtgaaatcccattgacaacctattctgggctttagagccagaagtttaattaccacctattgagcgagtttgatttgtcacttcttgggttctggccaggcagagctaattcctcctagcagagcaaggtcggtgggcaggagccagaattgagaaagtgacgcagtcacttcagcttgtccagcttcaggcgtagatgaagggagttaagtgtgccagattaagtccaaagtggcacacaagcatgaggggcaataagggcacctggtaaaccacagcaagagggagtctgcaactaagaaagggggagtgtggtgactagcaaggagcaagcgcttgcaattttcagaagtccaggcaagctgtgctggcaccagacaggaaacattgcggctgcgcttcagtcagaggctggcttcagcctttgaaggagactgacagggggtattaagtagttactggaatgagacctgtaaaaaaggcagaataaaatcagtaataacaactgaataataacaactgaagaaatcaatagactatttaaccacatctgtaggcctctacacaatctagtactgtggagtattaaatgaatgagatagatttagaaataaaaaaccattcatggtatattaaggaaaattcaaatcatagtatattacataatatgttagtgaaaggaactttgggacatggtagtgtagaactctgttcagatgaatgacacaaacaccttaggcatactttatagggacagatatactttgtttgccttttgttttcatccatctatcctgaggaaggtccacaattattgaataataactgcctaaagtggtaacatgtctctggtactc

SEQ ID NO: 127125 - DNA, 1800 bp, Homo sapiens
agtagagacggggtttcaccgttttagccaggatggtctcgatctcctgacctcgtgatccgcttgtcattccatttttcagtgatacatgttacagaaactgtccttatgtttgtgtacctatacagatagctaacgtatcatctatacactttaaacaaaagatgtcaaactacacacacttatataatttgctttctaaactaaaatggagtgatcattttcctgtcatttataacttgatttttaatggctgcatactattctatcatatagatatttaatatttaaccatttttcttgttgtatatttagtttttaggtttttttgcttttgcaaataatatatttatagatatatttttgctgaatatccttgaagataaatatttttacatgcctattattatctccttaggctaaattcccacgtgtgtagtgatttttaaagaacaacaaaaatatgctcaattcacatgtatgaacttatgggattgatgagtggatgagaaagaacccatcagattttcagaatgacttcagcaagtaaatttgaagattccaaatttcaggcttttaatttaaatagataatctagctttaaacattctgcatttaggtacttaaatattttggttgaatatatattaataatcaccatatttgtgcagaggaagcctattgtgcatattttaataccaaccttatttatgccattgagttttctatccattgattttttggaactgtgtatatcacaccaaaatccaaatccaaagtgaaaaagatagtcaaacacaggtgttgtgggatacacaaaaacaagcaaaactagattttcttggagaaaaagggtatgatgacttcccaggatgctttaaatttctttcttgtttttagctgacctcactctaggaagagaaaataaattatattagttattttatttccaaataaaagcaaaaattataacttgaaaatataaaagggtattacctcaaatgttgattaaaacaatagttatatgactagaataaaatttggactttaacatgtagaaactgtaatagctactgtttagtgtgctcatagtaggtacctaacatggccctaagaacttcttctcattcttattaatctttattaaggccaggataataatatatgcatggcaggtctgaatgcttcaattttaaatgcttctcaaattattcatctttttgatgttttagatccaggaaacctttggatgcctccccacaatttattaaattttttcaatgtgttaatcatttcctttattatttttatagaaattattttaagtgtgatttggcacgacctgtagcagaaattttaatcatttcattcatctttttactatcatagtttatctgagacataatgatttttatgacttcaatgacacctgaaatgaaaccagtactctaaagtagtttttgtttaacatgatttgattcttttagaatttatgttttgccagagtgaatgaggaattcagatataatagtgactgtacagtaatgagtttcatttctagctagctatttttatccaaggaattggtattctctaaaatgacaattgtaaaagatgactaaaattatttttgaaacatttttagacttgatataccagggttccactagagaaacagaatcagtaggctacacacacatacactgagacagacagagagaaatagagattgagagagagagagagagagaggcaatgagttgggttccaggattttgggggctggctaggcaagtctga

SEQ ID NO: 127126 - DNA, 1086 bp, Homo sapiens
gatttttacactttttattaatctacttgctttgttttgaaaccctctactaactgaaaactaaatagtttgccttaaaggaagataatatattgagtcagagaagcagctacaggccatggggtagtaaaattcaaatctgatccaaagttaggtttttcttttcattatattctctaacagttcaatgactaatgtacttctcttctgaggaaaatctgccccgcaaaagaaggcctgctgcaagctgcattaagaaggctgtcttcccctgggtgagggtgtgtaacccacggagataagaagccacaggggaaaccaccacacaggccactattttagtattcagctgctccagctgcatggttgtccaaaataagcccttggctttattattttcaattccaataactacgtttggctttgcatttgtacctaaggaccagttatttttccagaaagtacctaaaattatctcctcaggtcctgggctgtgaactccggttaaatcacaaatgcatctggctttacgtaatgtctacgggtaacagtcggtggaaactggagcactgatattttcaaatattggcaagccagtttaaaaaaaaaatctattaaaagatgcatctaaattccaggtgctttttgttaccaaacaaatctcaagctaaattcatccctaataaaaatgctcctagcccatgtaaatggcattttcccctcttaaacatctattcttattatctcaaatagtgtccaaaatggtcatccctcatggtgaataatctattcatctgtaatgcagaaggaaaaagaaagaaatttcatgtttttaattagcaattgtctaacgcctagatccttagaatgcagacaatgtttcttgaggtggatcagtaattggttaaaactcaaggttaatgaagctacagtcctaggtttgaatgagtcagtcaacctcactctaagaaatcctgtgccatgaactcagaaggtacctctggcccagttgtattacaaatgagtattaccactggaaggccaaccatcatgttactatagaaacaaacaaatgtgtatccccaa

SEQ ID NO: 127127 - DNA, 1138 bp, Homo sapiens
ctgttggggcttccccatctttgagttaaaaaggaaaacaaccattaggcctagctcaccagagtgaaaggaaacaacccacacggaggtaattaatttatagcctgtgaatctacaccacgctactgctagaataaagtccagacctaccatttgtacagcaggctagaaaaacagctgaccacagaggcagtgaaatgagtgacagagtgcaggctgcctgcacaagatggcctgggttccaaccctgctcctccattgctagctgtgtgactgaaggcaggttactaactggcctattctacctattgagcctacctgtaagtaaaaaggaaacaaccattagcaatgaccctgttgtacggtggggaagagtaaatgagttagcatgcaaagtgctttagatcagtgcctggcatcatctaagtaggtaacagtcttcagtgaccctcctctgagaggaggaatgtataaacaaaagacaaaagcctacctttcagcatcagagtgaattactggtttcagtatgaaattgtatccagaaaagttctttttttctatttgcttacttaaaaatatttccaagatgttttgaatgaaaatgttaaaatactattgtaaatgtaaatgataatcatcagagggagacttgtaatgccttcccttctccctcccacaaaacatatatgctaaaagattgccatgtttggggcatatatttagtaagaatttaccaagcattttcccagtctgaagttgcctctatttaggaatattaaggtaggtttttaatcataaaggggtgctggattttgtcaaatgttttttctgcatctattgaaatgatcatgtgattttcatttttaattctgtttatatggtgtatcacatttatttacttgcatatgttaaaccatccctgcatccctggtatgaaacccacttgttcatggtgaattatctttttggacatgctgttggattcagttagctaatattttactgagaatttttgtatctacgttcatcagagatattgatctgtagttttatttttttgttatattgtttcctggtttgggcattagggtgatactggcttcacagaataatttagggaggattccttctttatttt

SEQ ID NO: 127128 - DNA, 1019 bp, Homo sapiens
acactcaaaaatgcctccagatttccacacagcaaaagcttagtaattccacaccaacaccattaaacccatgggaaatagaaagatgtcaaagcttgaaactggctaagtgcttcttaagaattaaagtagacaatgatgtcacaggaggatagatacagtgatggcagagactgaagaaggaatacgaaactttatggcagtctactcctagatagaaagattgccaaatcaacacctgctccaagtcttcaaaaatatatctggtggtaaacagtttttttttttttggcaaaagggattatctgggcttaagaagataaacccaggcagttggcatgtgttacagtaatacctgtaacatttttagtttcttttttgatcctaaagtatattctttttaccatattgactctttcaaagtccttcctaattcctcatgacagatcaaacttttttttttttacattcttggtttctgtatattttgtttaggaatatggaatagcaactgagtgggtcttggcctcctgcttcctagatctcagccaatccctctgcagccacctgttcccctcaacagttgcgggggctatgtaaactggcactctgcccttccacccgcctttgtggccacctgttgccgagactttaagaaaacacagggaagtaaggctctcttcaaggtcaacagccaatggtccatccccacctcagtgtctctaagttcacaggatgagattttccaccgcagcattaactactatggcctaaaagggagggtaactctcctgaacaaagccctggagaccactgagaattgggaaaagccagcctgtgtcattcatcccaagccctgccagctgtcctctaggtccctcctctagagattctaattcagttggtctgggtggtgctcagaatctatcattttaaacaagctcccagataattctgatgcagtcagtttcattcattcattccttggatcttatgtgcatttgacaaatattttctaa

SEQ ID NO: 127129 - DNA, 1082 bp, Homo sapiens
ctgctgcagttggttttcaaaagtaatagcaaagctgccatttactatgttaatgatgcacatccctcccatgggcagcacacctcacatgctgccatgaggcaccccactttatgccagtctataattcaggttactacagcattttgcctgttactagacagttggtagaaagtactgtaaatcatcatgatgaagggtactgctcactgtacaatcctgaccactcaacaaggccctcaatagattcatggctttgcatttattagaagagaagactccaaaggacccagaaaattctgtgccccaagtcatttttctgctttctatattgtgctgctggagcacctgccagtccttagttcattgattccatcacacagcactacatgttccacaccaatcacaagcggtgctccaggattacagacttagcccctgccactacaagtctatgtcacagatccataatacctctcacaggctcctggcatgcctgtacccatcacacacacacaaaccctgggtttcttcagatttctcagttcttccagcagaatcataaagtgtcagcgctaaaaaggaccttaaaggactatgtagagtccacttacagatgcagaatgagaactacccatcaagttacaatgacctgaccaaagtcacagagctaattaaatagtcacttagcctaaagcccctactctctgtcactatcttaccaaggccctctatcaagactttatagctcccttgcttcgtataaacagacagatgtagcctatcattccttttttcaaatctttacttccaagtgccctctgacactgtccctctgtgctttcctagttataaaaaccaattcagaagtagtagtctatcaaatgggaccagattattcatcctaaggtaaaaaatgactcatattaactggacatttgctttgtaataggtgatagaccttctacccagtatttctaatgcagtaataatagacctcagtaaagactgggttattcatgcagctgcttggggaggaaaaggagggccttctcaggtctgtcatatcactgcaatagtac

SEQ ID NO: 127130 - DNA, 1463 bp, Homo sapiens
gaaggaaattccatacctgagacactttgcctattggaatctgagtccccgttactggaattagaattgttggaagagttgttgtcaacccctcccagaagggggcgcaagtggcttactgagacttgttcaatgaatgaagttccgtatttgcgaaaataccaccattcaaatatctagaacagaaaaataagcgtgtttatggtcactgttatcatttacgacttctgtacacatgcccataaaacatgttacatttactaattccaccttaagtatattttatttcaaaaactgtttattctaaaaattagattttagtaaatttaataataacatttaaaattctcagtgtggttttctctgcttaatactggtttcaaaaaactataacatcaatcatggataaaagaacactgttaagaactgctcaatataatttttctccaaatttatatataatattcaaataacaaaatcaccatagctgaaagacaattccagaaatgtatataaataagtcagtttttgaaatacggcttatgaaatattccagttctttgcactttatattctgataaaaaccatacctctgtaaaatgcttaagagcaaaatcggggtaggggcggggcaggaaggagtgggggtgcttggtaagacctccttaaggaaatactggttttacagaacaaaagaatgagctgtatcccgtttcccacatggatagcacccagccactgaggttcagcattattccacttgcagagaagtgctctataaacacaagcatctgttgtacaccattaatgtttcctagttcacaagcctactaattgttatgtactgtgaattacaaaagggaaaagaagtaactttcagtaatgaaagaacaatgatgcttacatgattagactgaagtcaggacctcctaagcactggaaaagcaagtgacctcccccaacccttcttacctgggatctctgcctctctacagtgaacacttcctaccactgctcaaagcggttctcccccacatctttttctctcctccctgactgggggtttccttaggcagtcacaaatcattccacagaagaaatttaagaatcaatcatatcccagagtctcataggatagctacatttttataacataaaatgtgcaattaacatagaattacctttacccttacttattccataaaaacaagattatctaccctggaatggactttgggatataattttaaaactgatgttttccctgttttgttctattaaagatttctaaaaagatataaggaacatttatgaatgaccagaaggaagtattaatcaaacgaaatgtttccaatcctataacaggacaccttgatttaatcccaggtagttactctttttgactataggttgagtatcccttacatgaaatgcttggaaccagaaatgttttggattttgaa

SEQ ID NO: 127131 - DNA, 1005 bp, Homo sapiens
agcttcattgctgtttatattcacattctctttcctgcccatagattcctaaccgcagaaataaatggcagtaacctttaatagtaaccttttttcctcctgagttcttacatatttctgttcatcagttgcttctgctcacaactttaaaacccagatgggaaacaggatttaaattagccatagtgttagcaaaggttttatcttatagatcttctacaacatggattgaaataggacaattaagaatataagttattggtgattgtatcagcatttatctcttacataagaaacattggtattggcttccagagagaaagagccatgagctcctagttatttatcttttttatattaaaataatgcctttttaaactccccaaaaaacgcctttttaaatttaagataactctttaaaatctgagacctttcacttcagtatactaaactgaaagccaatgacatttcgtgggggaacagtatagaaacaaaacaacgaaatcatttctggaattccctgagcccctcgactcatcagtttgtttgttgttgaagcagaaatttagcagtccttgtggtaagagagttaagtatttccatggtccaaccaaaatttgagagtatttccatggtccaaccaaaattcacaaagttattttgtttctcacttagtttctccctcctgaaacttagagagtagggatgtatctccttcatatttgagattataaaattaaatgttaacgttaaacttgggtttggtgtagaaactgactgcattagtccccataactaaggtgccagcaaaatctttgcattatagcctgcatatacatgagtatgtcctcacatgtaccacatcaattcctaagtttttatttttattctgcagcatatatatgctaataaagtctctaatcaccatctatgtctcactttttaataaaaaagtattttagtgtaatgcagtgcattttgaagacatgtagtaaatgtgtattt

SEQ ID NO: 127132 - DNA, 1038 bp, Homo sapiens
ctttttttgaacctggttaactttcttttaagataagattttaccttctttttttaatcttcttccttttttttttttttttgagacggagtctcactctgttgcccagactggaatgcagtggcatgatctcagctcactgcaacctccacctcctgggttcaagtgattctcctgcctcggcctcctaagtagctgggactacaggtgcgtgtcaccatgcctgactaatttttgtatttttagtagagatggggttttgccatgttggacaggctggtgtcaaactcctgacctcaggtgatccacctgcctcggcctctcaaagtgctgggattatagtcatgagccactatgcctggccagattttacctttcttgaagataaaaactttgctctgaaattcttggtctttcttctttctctttgcttcccagtgaagttcaatattatatattttaacttcctttgggcctctcttcatcctcatccagtgtggaacccgtggaccattcctttaatcattcgttcaccatcatagtccagtctcttgctccttgaattttattgaacctaattcagtctgcccaggctcaacctaatcatttgacatcttgctactgtacctgggctgctggccaccgctaggtaaaacttgacaaccatggcagttataacctctaaaattcatggtctccatttgttaggccctcaagacagccttagcaatcctttttttttttttttttttgtcctgagtagttctccactgtgtggctgtttttcactttcaccccatctttaagcttcttccctgccacctattctcttagtctcagaagatgatcgtggcccctgttttatgtaggccaccaggcagaaactcataaaccttcctctttactaccacccccatcactacctacaaattttcttttaacccgtgtcactttctagttatttttctactttttctccttaactttgccactaggctgcttgaaagggtaatgcccccttgtttacccttctacagt

SEQ ID NO: 127133 - DNA, 1068 bp, Homo sapiens
actgtaatcctttctaagttgaaaacagccttgcaaagaaactcgcagggcattccaggggcaaagagttcctctaacctagaatgaattttgcagcatctgggaatggcatatttttacctgttctgaattaaggtatttctgtgtcatagtgtaaatttggttgcaagtattaaatactaactcctattctggaaagaatgcaatcataatttaagaacacatttttcacccaaaggggtgccctctttgagtttatctactctcacttgtaccctgtgctttcactttcctgtaaactcattatctgaaccccacacccaccctggcccttctgaaatttttgtaaaattgaaaggaactgtttttcctgatgacaagtgaggcttcatatgaaaggagatttatgataggttttcatgagcaaaaattgtgtagttttctaaagatttcatacatataccctttaaaagttatatatgtttatttatatattagacatatatataacttggacttttacatttttaacaagcactattaaaaattgaatgtaaacttgaaatttaatgcaaaggaaatttagtttaaatctgtccactaaagaatcattcatttggctaagtcttcttttaatctagatttttttcttcaattagcatttcatatacctgttgagaaatttttgtaagtgacaaagacactttcatgtctttcacatcaaggatattcatgtgatatctaaatgtatatatttatagctatactctgcttaaactcaacatatgaaaattcatattttaaaatagaaggtgattgcttaagagtcagcctgttggacatgaattattcacaaaaatacaaactacccttagtttcacataccacgttgatacagtaaggaatagctgaaattcttgtgtaatgtctgtattaaaatattcttcatttatgctttattgcacttaaacgtgattaaaatgctagtgtattgaaaatgattgctctttgttacctgcaaacttatgtgttcctactttctttttctccaacagatataagcttacc

SEQ ID NO: 127134 - DNA, 1021 bp, Homo sapiens
atcatagcctcttagagttgaaagggacctgaagcaaattgcctttaatagcaaccctgagtggaggtcacctagactcatcttgaatactttcagtgatggggcactcacatatttataaacatcaaagcccatttgattattggatgactcagaacttttccttgtactgtaaaaatctgcctccctttggtttccacttattcctattctatattgagggtacaccaagcagccctccttcctcttgcaaattcttaggacagctcactcattcatggccacctctaaccaactacctgctttttcctccaggtagaatatcttacatttccttaagtcttctgtgcatgacatgatttctacacccattatcacccatattgctgccttggatgttccttagtttatgggcctacactacttgttattttcttctactccctagccaatctctgagtaaaagtagttgccaaaactctgagtagagtgtgacttagtaaaatttaaaataagaatatatttacattaaacaattattgctcttttatgttttctgtttttctgttaaacatttttagagcatatttgtaaaaatatgtcattagtccagtattcttcattaaactaactgtaatagcacttggtgggagttttgaatcagtagagattcccagcctccagtctatatattcacctggccgcaccaccagaaatccaaaatcttgagtattagcaggaggtatctgtatttttcacaaagcccccagcatattctgaggatggagattgatggcattctcccgtctccttccagggacactgcttggaaagctgaaccttcgagcagccacttgcagctgcatggtgtgccatcacagctgttcaggtggaagcttttcaggaatcagtggtttccctggctctaccttggaatcatcgaaaaacttaaaagttactgaggcctgtccccacaaccggaactttcttggtctggggtccgcatgggcaactcagttgt

SEQ ID NO: 127135 - DNA, 1017 bp, Homo sapiens
taaaagagctataactcctctgaaaaatgcccttcacttatgtctggagagcaaaagacaatatagaccagaaaccaaaaaaaataccagcgactgaagatacggaaatcggattccttattttctactctctgacttttgcaattttaccaaagtattttatttatttattcctctcagaacttctgaattacttttggtagaataaccagtttctatgtcatttgcttagaagatgtggcttattaagggagaacggaggcactggaggccttgagtcattcagcaagtgtttactgagcacctagactgggaaatggaagtgtgattacacttacacaatgggggtgtacgactctacaactcaagtataaatgtagttcagctgatctttccaaataagatagaggatttcaactctgttttgcatttagattgcccctattttcgccactgtgaccattgcaactaagaaacaccagagctgcctccaccctgcttactaacctgtctgtgcctggttgagcttgtgcctctccaggtcatgagccctttgaaggggattaaccttccaaacagccactgattccattgtgattgcccaaagcaaggcacagggacaacacacatctgtcaaatacctggcaggtgtctcttccaatttcagtgatcaaacaagcactgaactaagtatagtaaggcaggattagtccatttctgcccctttctaagtatcaccctagagagctaattccctctgagccattagctttttcatttaaaaacaaaagcattgctggctgcagtaatcatacctgtaatccaagcacattgggaggccgaggcaggaggatcacttgtgcccaggcgttcaagaccagccggggcaaaatggcaaaatcccatctttacaaaaaatataaaaattagctgggcatggtagtgtgtgcctgtggtcccagctactcaggaggctgaagtgggaagatcacttgaattcgggaagtcaaggctaca

SEQ ID NO: 127136 - DNA, 1083 bp, Homo sapiens
gttttcaattcccaattttacccctcaaaatgtggatgacaaagttctgttgacactttgaagaagtctctcctaccatgggatcttagtggttggtggagattgttggttcaaatgggagagaacttttataattacaggaaggtttgaacagttgttatatttaatactttgaggggagagagagaaaagcaaatagcatcatatttgctaattatcaggtgatgacagcagtacactaggatttatttgtccaattataagctatcaacttgaaattaaggtctttgagaggctttatccatattttgaggggcgaaatagggaattggaagcagcatggacttggaagttagatctatgttgaaatctagtctctgccatttacaattgtgcatttttggtgacttcttttgctactcatatgggggagggtggctgttaggaggattggatcctataacctgtcagcttggtattgagcttagaatagcatgagtaatcaataaatagaggtgatattactgcttcaatgatattgttgcttacagtatttttgagaatttgctatggaattgactttagtattattttgagatgtctttacaggcattcagcattctatatttttgatccaaaatggtattactgagttgaacagcttttctcgtggcctaaaataattttggctgtttcttacaaattaaatccaccctcagagaggaattttgctactcaggagaatagagaatgtactataagatctttgggcagtcacaaaacacaagttccagaaatgtgtggagcagtggcagtgctattgccataaatgcatagactgtaaagtagaaaacacttcctaggatatagaagttttgtcacttaaaaaaaatacaaagccatctttactttgagaccttgaggctttgccacttgttgccttagtcattactgtggtcctgggtttagctgcatgtgccctttggtttcggcagagaagctttaaaaccaggatctatgactgaggaacattttgtcaacaggattgaaaagttaacggattaaaatctgttaacttttaaa

SEQ ID NO: 127137 - DNA, 1055 bp, Homo sapiens
aaattttctagcttttaacctgagccaatcacgtcaaaaatgatttgttagataccaaagtacttgttcctactattatttttgtatatgaagaactggctttggatttaactgaaaacttaggaaaacaatctaatcgctgttgtctatatcattgatttaattcatcaaagttactcaaatgattgatatttttacttgctaattattttaggagtgattttgtgaaatttatttttaatacagtcctagaattgaattgaaatatggtttggaagtttgagggttttttactgtgtctatccttgtgtgtctgtttcctttaaagattcatgatacaatcactgtgtacaatgtgtcctttaatattggttcctgtaataatgtgccttcaaattatttcttgagttttgtgacttaaatatgcagttcactgactcacgccaatgttgtttgctttttaccttaattctttttactgtgctctctcagttttattttttggaagaatggtactcagtgctttgatttgattagtaagatttttgaaacacatgtaatttatttcagaaatgtgattgttttaactctgacttttttagtgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgagtgtgtcactggattttgactccttattgattcattgtaatatgtaaattaaaatatttctacattttattgaaaaaaaaacctttttttttgcctaaatataagtttggtagcttggtttcttttttttattaaatagtgtgaaaatataatgggcattttgaaaacttttagaaaaaagtagtactttttgatactttagtatttatggaaactagtggaaaagagaaattagtgtgctatataaatcaggcattcaagtaacagtaatacaggatata

SEQ ID NO: 127138 - DNA, 1033 bp, Homo sapiens
cctgcaacgttaacaatctggttttgaaaataaataaaaacagaaagaggaaatgcacttaaaaattccgcgtcggagctttgcgggtcttgccttccagtcgcccccagaagacaaccaattcctgcgcattccgctccgctcaccctccttcccagcttctctcgctctctttccccccattttcccacgctcgccttgaaccgggactcgagaggcagaagcaaggcacgggtcccctttctcctctcctccaccaaaccaccgcagcccagcacgtgaagcttccctttgttcatccgaggctcgcttttctccccagcagatccacctggatgctctccctcggtgacattttgcgccggggttggtgggtggctggggtggagcgagaggagcccgagggggcgggggcggagaaaggtcaagccgagggaaaggcaggagacgcctttcctaacctgcgtggcggggcgtgcgcgcggttatttatttattttctccttatttattgatcgcactagcagagcagcgcggggagcccggggagatgcaggaccacccactggcggggaagcagctagcagccctcccgcgcccccgcgctgccgagcgccttctgcctccgcgctcggacgagagcccgtgccggccccggccccggccccaccgcgccaacgccgcccgcccggccgccccgcagccccgccgccccgcagccccgcaccgcgctggccaggctcccgcgacagtggccccgcagtaagttggcaggagcgagtcccctccgttctcgcctcccccgcaccttttgaacttgttgctgctgctctgctcgcctgcgcctggcttttggaaggtgaaaaggaggagggaggcacggagggatgggggaagggaaagaagagctcgcttgagctttatttatgctctctcggcgcatcggattcggctgctcgcgagctgctttctctcctcttccctttccgggtgcacggcgaggagaaagtctctatgcaactaagccccggcg

SEQ ID NO: 127139 - DNA, 1039 bp, Homo sapiens
ggcttctttaaatgacattgtggttaaagtcaacttaattttattagacatattgtgttgtacagaatttctcatgtcatgtggccagctaatggaatagtttatatatgaagaattttaggctaggttaaacaagaaattggggtaaagaaaaatacaatgatttatgatttttatttagtctcatttttttaaagacctactggtacatttaaaaaatgaattagtgaaaatccatgttctacttcttatatttcctttttatcttgttggcaaatttgtgacagtttataaggataaggatgatgcagaatgccttcgcagtgtaggtgctgattctttatcaaagaggtttgtttttgttgtcttgtcattttgtagcaggagatccttattaaggacaaatgggtagtgcaaatcaccatcatgacgtcaaattagaagtacacttgaataaaaaagattctgttttaataggaagggagaactattaaaatgaaatacactttaaaaatttggtatatatggctgtgtttcttgaggtatcagtgaatcattttaatgctatatagtgtctatatgattgaatataggtataaaaagaatgttgatgagaattctaatttcatatagctaatagttctatactagacttgagaagttagcattattttaaaacttgtttctggaaatgactttccaatttttattttattttgaagcttatttttgtttcaaggaaaatatgagacaacattaaacattagtgacaattttttattatgtaaataaaatacttaaaagcacccatttttgaaaatatttaagaaattgaattatattgcctgagtaaaatctatgcagtggatttagttcacatgtttcataggtaagtaagtggattagaagcattgaatacacacgctttctcagaacttggaagctaagtggaagttactttaaagacttagcttcactgaatttgaacattttaattttcaggaaattaagctaattaatgatcctgatggaatagagc

SEQ ID NO: 127140 - DNA, 1039 bp, Homo sapiens
ttaacgatataaattatatgctgatttcagaacaaatttgggaaagtaaaaatttaatttgtattatatatttatctaaaacaaatacggtggcgttacatctttgctgccagaaaacttagcataattgccatatttcaatttttgtgcgtttggtgaattactattttaaggaacaacaaaaaagcagaaaagttttcacttaaattttcatagcgatgtatcagggaaattccttttttagaatggcatactttgaaataatttatcatatgcatatatatgatcatatctatgatatacgataacattatgttataattatatattattaaagagaaggataaacttttaaatactattctcctgatacctgtcagtattctgattatatagctttgggtaatgatgggagtatatcttgcagaatcatttatgtagagacttaaagtttacccagctgttactgaaatgggtgaaattatcttcccttgtgccaacatctatacataactattgctagtgcattaatataaaactctttaaaaggtaggaagtaccaaaatttatctttctggtgaagtgccataatatgagtaacatctatttttattttgacatactatgacatatttgtgtaaagttctttatagaaaatgttagttgatggaagttgaaaatgaacttttaaagaaatgtagagaaatgtggtatgtattcctcttttagccttacaagtaaccaaatcttatgtgtcttcattttgttttagccatcacttgaattagagacaatatttgatgtggaatttaaaaatatgtatgttaatccagcctgtagtacttcagcatttacttggttgccagacagaggtatttcagaaaaggtttaatatgtgttatttcaacatagtaccctagagaaaacgctatttttaaattttcagtgggtctgttatgctattcttttttatttttaattttcctttagactactgataaactgtcttattttatttttatatttacatcatttactt

SEQ ID NO: 127141 - DNA, 1332 bp, Homo sapiens
tttctctatgaaactccatgtttatgtgtgtatatagagctttttcaaatattgacttctataccgttatcatatttctcttgagcattctctaactgcatttaatacaattgaatattttttttaaaattcaagagaatattattagttcataaatgatattcagtatcaaaattagtgaaacacagatatagtgactatccacagagtattggactatggtctgtcatacagattgtgaacccaagcagctcttctgccctgactctggcaaaagataagatatttattctttgaggaaattaaactgcattttaaattgtaaaaaagaaagattattcaggcctaaatagccttaggtcactctaaggttttgattaatgtaaaagtttattcatacgtttgcttttaaaatttatgctgtgttagattacaagtagattttcatgtctaatataatattttccccaatctacaatttttttccaaactctgatgtcatttttttctatctaatagacacaaacccctttgtttaacttcatttttatgtagagaaaaaaaaaccttcacatcaaataaggggaataataactagtatttttctagtatttatttattttttcagtgaggggaattttcagcataaagtgaaattttttagaaaatagcaaatgagagcttttttgatgctgttttacaaggtggtaaaagtatacaaatttggggacagtgatatacctacctgtgactagcttacaggttttctgaaacttgtacaaaatattttgaacatagtgtattcacagtgttgtgaaaattggttaagaactacagcaagcaagatgcctttctcttcttgaaaataattccaagaactggaagttccatatccatctcatttctgaaatgagaccgtcttctcagtaatagaacagtgttcaacaagtaaagtgtttagatgtgcctgtgtggtcagatgtatgttgtatcacagcatgcattactcatgttgcatattctattcagaaagcatgcctcagccatctgagtggaacatatcaacgtgtaaaattggaattactctttagaactgaagcaagctttaatagttgctgcacaagcttctgagactagacaccgtgaatattctctgggctatttcattaacaaattgtatctctgcagcctgcatttctctacatatttattgaacagataataggaaataactgcttttttgtgaagtcgtaaataatatggcagaaggatattaaacccactgagatgtgacagaagaactaaagcttgtgggttttagaattttatgat

SEQ ID NO: 127142 - DNA, 1021 bp, Homo sapiens
taaaatattcacttataattttgttctattatcatcactacaattcaacagatttgctcagttttcctttcacctattacttctcactcctctccttccctatcatagttttactacatggaagcatcagagcgtttaattttatattttctaagctgcgtttccttcccattaagctagctaatagagatgactctattatctttcttcctgaatgaactctaagtttgctatttggtttttttcttatttcctctaaagccttctaaaataatctcaggcatccctccagaatcattgtggagtaacaagggcatagctatggaggtactttttatttttaatagacaagtagaaaaaattacacattttcaaacaaatatcaagtaaaaaatgggacacataccttgcatttactcttctatcacatatactttctatattagaatagacattcttattaacattaggcacaggctctgggaattgaaatttattcatacagtagataatcttttagacatattggttatgaaaaggaaggagaattggatacagtaacccagaagcaagttctttttctgcttctaaaggcaggtcaaaataaataacactcttgccgatatatctaaaacataccatgtttttacctcttcttcatttaagccattgaaacaacacagtaatttcaaacatttcggaatcatttcaaaaatattgttaagataattagatagccaagaagataagttgtgtcaagaaactaaagatacaatttaatgtaattatggtattttttccattcttaatataaacattttgccatccatttaacatagtagaagccatataatcaatattatattttatgtttttaatctatatattctaattagtatcatgctgcttttaaagccatgcagttttttgttttttgttcttctttaacatgcagagtttagttggttagcattgaatggtagagaacgtatattagtttaggcctatgaaaatgcaaaag

SEQ ID NO: 127143 - DNA, 1082 bp, Homo sapiens
tgattctttgttctttcttaatcattgtgtaagatttcaaaactattattttcttaggttttgatatattacattctgaaagttaatcagtcataatagtataaaacatttgagaatatgtttttccaaacttgtattttaaccatatgttccattcctttttcactctcataattagaaagatagtcatgttgcccagaacttaaattaaaagaaagaaaaagaaaatcattttgaagcaaattaataacttttggttaaaattaattatctttgtgattttaatttgtaacagaaaaggatcaaggtaaaggccctttgcttttcctttcttccttatctcttttttttgaaaaacaaattctttttaattttgatgtttgtacatttttacctaggtagtttttaaaattattttatccttatcctgggatcccagagatgcattttaattacaaaaaaaggaaaaaagacaaagagtgagagagagagaaaagaacttgtgcatgcattatgtttgagggaggtatgagaaaagtaaattttgctggcatataccatattagcagaaacgatgagatgattgattttgtttgtgttagttttcataaccccacaagtaagtgaagaaattaacagtgattataaactaatatctatacttttaatttatcttctagaacaatatatgaaaagttgtcatattaaaggaaaaatgtcatcataatgaattactttgtggctaacttgaaatttcaagtgaaaatctccaaagaactctcaaaaatcaccctgatgtttgctgcatattgtgtcatatcctaagactttaaaataccttcattttatcccattatttctagtcataggctccccactctccttttctgtttctcttttaaaaattttatttgtattttattctcctgttcgactttcaatttattcactccattatcaccacctctttggagaaggggatgttgtaaaagccttcttctacattttcctcttccctagactttcggttggctttaaaaatatcagtatctgttctcccctgcaacctcattcaattgaaa

SEQ ID NO: 127144 - DNA, 1057 bp, Homo sapiens
tatgctatcttgtacaaatctctggatatttcatacaagtaagttatgttttcacaactatatgcaaatattttctttttttactacctacattgcttagcattgcattgtgcacaaaatgcatacattgtaaacttaatattgactctaacagcagaagctgttctgtggcataggtcagatactttaaaatagagagaaagagaaacccttacaggccacaggtggcattcgttgatctttatagtgtgacccttcctattgtgctttattttggattgatattaatggtattttacaaactggaataagtcaggttagcatgttcagtgcttcatataaggaaaaagattgagctctgtatgaagcctaccttttaaatggccatttttggaaagattttgtgctctgtgcacaatttttttcttcattctcttgccaaagaaggcacccttcctctcttcataacaaaacttattctgtatatgtaataaagataatacatgtgaggaaggaaattgttataaatttgcctctctgatggcctttgaccttttcattatagcatgacttggaccaccaccgatatgggttgcaaaatgggtgacatctccaaacatttaagataagactttataatatggtaagatcttatgtgtccttgcaatgtttaatacatgtacaatttgaaaaaatctcatgttacatctattttgtataaatggtaatgtaaatgtagttcctcgttattcccttatcttttccgaaagaggaattaccaactataaattaagaaggtagactgtaagaacttcttttgataataaaaaatacttaatatgggaaaagtttctgcatcaaaaagcttttgagcaggggatctgatatagttgggctctgtgtccccacccaaatttcattttgaattgtaatccccataatccccatgtcgaaggagggaccagaagggaggtgattggatcatgggggtggttccctgatgctgttctcgtgatagtgagtgagttctcatgagatctgagggttttataaggca

SEQ ID NO: 127145 - DNA, 1076 bp, Homo sapiens
ccataagagaaaggtcactcagttattctgaacgcttggccttcaaagccaataacttatgtagataaacagaaacaaaaataaaaccatatacagtttcaaaggacatgatgttttcatttgcagactcattaatgctttataaatagccaaactatgaatgtctagttcaagacaacattaaaggttttgaggaaagaaaaatgttcttgatatacagagttttctctgccatataccggtatttttgtaggatcctccttcactgtacaactgtagctcagttggcttatgcattggtttccagccgttcttcattgagctcttttcattccagcccatagttattttcaggctcaactggaaatgagtgcagtgatcacctgatgatactaattccatctagacttctttgtattctgagactgaacacacattatttttggcttgacacttttttgtattgatcctaagaattctgtgcaaggctcaccttttctgtctagcctcaggagtctgtcaggatgatacagccattgaaatgcaggtttgatgatagggcagacaaaagtcagaagcatttgtatagtgcattatttacctcaggagtcattgtacttggatttcaacttgaaagaacacactagaatatttcaggatatggaaacattttgctataataaaaatcatatttatttttatttttctcccacaccattttatgaggttcactcttaagtggtctgctttatataattatgtaggagtgatgcatcccaggttaatcatttatcttgcccatgcatttctcctctctgcccttcttgcctcttccccctcaatggtgcttcggagcacaggattatcttggaactcaacagacattttttttgtctgtctgacaaccacaggtgtccatgaacaggccccaaaaaggacccaacaacaaagagtaaatacaattacaaatattctttggtactcaattagcaatgcttcttaaaaagccaaaagaattagaattatgacatccctttcttttatatttagaaaaccagaaatatttgtgagatcca

SEQ ID NO: 127146 - DNA, 1048 bp, Homo sapiens
ttcaatgtaaaaatcttgagtgttttaataatttatctctatacatttcatgtttttagatgctaccataagtggtgttttttaatttaaattttcagttgtccactatccttaaagatcatttatatagaccccatgaggaaatgtcattttttttttcatttttactttgtttgatacctggtcactagttcaacctattcttttgtcatgactttttttctagaactttacttcagatccagattttggtggcctcaatacatttcagttcacatttaacaatgatacaaaagtttaaaagaagaaatatttcctttataactatagttttctatcaaattaggaaaattaattggaaaatagataatgagagcctgatatcagggcactcagatctacgctttgagtgactatgtgtatatgtgggggaaatataaggaaatacataatttaaaaactttgtaagaagaggaaggatgagtaccaatatgcagaaagtatatgaaaatatactagaaagaacataacaactaatatttgttttttactccaaaactttcacagtacattcttgagcatcatgtaatctgtcagctatgttacttattattttacagatgaagaaattgggtattggaaatatagtacattttttaatattatggaaatagtaatcagtgcctaggccttgtgagtcttagctcttttgactagatgggtttcctctcagtttacctagataggacttttgcaactcatgtacctaattgcatctttcaagatgtatatgtggatgtatttatccctggctaagcaccatctagcaaccagatggtcagataggtaagctttcattaatatatattcacttcaaacaatattgtactaccttttattttttacttttgttccatctgctccaaaagtatcttaaaaagaaggcttccctagcattgttcaattttctcataaacaataaagggactgatttataatagcttaattggattatagctaaactttataactgagtcactgagaagtt

SEQ ID NO: 127147 - DNA, 1021 bp, Homo sapiens
tgtgtgtccagcatgataatttttgttaagaacattggttgtgaatgcctttaaatgaggcatgctctgcctagttttacggcagtcttcactgaaacagattatcttaagtttgtgaatttgagattgcaactcctgatataaaataacttttctttaattgaggaagaaaactagaagtagagactttacagaattctataaaatacaaaatggcatgcaaaagtaagtggtgacctaaaagtcaacagactgaaaaaaaaaggaaaataacaaattatatttgaagcaatatataaataaagtattgaacatcatgatttatgtagttagaaattatttgctgggtgcatttaacataacacataaaatgatatttacagacacccatctaagaagtcacacaaaaacattttccagaacataaaatggttttgtgattaggtccaacagcatgtgaaatgtaagccatcaaagccctttgtacaaaggtggccagtgtggttggcatggtgtggccatcatttccagcccttgctttaaagcaaacaggaaggaacaattagtttcaagctatttggactttaaactattaataaaagtaaattaaatttaaagaagaaatttaagatctacatatgttctcataatcactaatggctacttcactttacttcgttctaggagatagagtgcaagagtttgcatgcaggtatgtgcttgaatttgtctgtgtatgtttgtcttactcattccatcactttcaagtgtttctgggctggtgccttctagtcatgaacaacctaagaaatggagtggtgtcgactttgatagagaacctggggtgtgttctccactaatcaggatgagctgtgctactcaacttgcatttgtggcacttgctttcccactctgtccctcaaggcaaagttactgtgacagaataaagagtgagatagaagaataaattctggctttgaaatattagatatggtttcctccccttttctggtttcaaacc

SEQ ID NO: 127148 - DNA, 1078 bp, Homo sapiens
attaatgctgttatcatgggagtgggctagttatcttgggagtgggcccctcagaaaaagagagctctcatgcgcttgcttcttcctctcaccttccaccacaggatgacccttgacagatgctggcaccatgctcttggatctctcagcttccataactgtgagcctaataagtgtttgtactttgtaaattacctagtctgtggcattctgttatagcagcaaaaaaaacaggctaaaacaacactttaagaattttttttctaataataattgttgctagcactatgttctgaaaacaataataaattgcttatgattaattgcgtcacttattactcatgaccctactattgaccctgactactcatgacccttattattatcttcatagtgcaggtgagaaaaccaaggcttggcaaggtgaggggacttgagaaacttcacaaaatttctaaaaggtattgttgggaatcaaacccagggaagcctgacatgaaagcataggttcttaatcaatgtcctatagggcttttccagataaaggttttatgctttatcgattatggactgaacttcaaaaacactcaattagcctttcttcctgacactatcagagtctttaaaaataatgtgttatttgtaccagatcgtgaaaggtatatggctttcaacaaagggaatgttgaagaaagaaacacacaaaaagggaaacatggtgatttagagtttgtacatatcaagtttgagatgccagaatgacatccaggaagaaaagctcaataggcaactgaatgggaatctgggtccctcatcaatttaaaaggtcagagctagacatatagatctgtgagttgtttgcatggaagtgataggtaaaacaatagaaatatctgaaatagtctgcaaagagaaatcagaagctaaaaaacaaggctggtgaaggattcctgaaaatatctgcatttggagaaagatggaaataaagaactcagcaatggtgactgggatgattcatcgaagtgagaggaggaaaatcagaaacatgaagcgtcaaagtaaccaagagtaggaacag

SEQ ID NO: 127149 - DNA, 1037 bp, Homo sapiens
tcttattaaaacatcttctaatttgtttaaaaatctctaacagcttatctagcaggatgaaaccatctccctttaatttaattattttctcattcactcacctaacctatattaggcaccactactgagcctggtacttttctgtgtgatggggagataggccatgttctgtgccctctactgggatgagatggagggacagaaacaagaacaataggataactgctttatgaggtatttgcaaagagcattaagagggaaaagatctgtaggtaaggcgggagttgggagagaatctttacactggacttgatgttcaagctgggcttgaaggaaaagtagatgttgctcagcacatgagaacaggaaagctggggcaggatggtattccaggcagaaggcactgcaggagtgaagatgtataggcactgggaggtgtgcatggtgcattttggagatgtgcaagcagttttgttgttttccatatatagaatgtgtctaggaaagagctggcaggaagcacggtttaagaaaaagtttaaggggtagctgaagagggcctggtgtgccctgctcaagagtttaaactttgttctctcagaggcagttgagggaagacgaaataaatggtagttgaagaagaaccataaagggtagctataagcagaagaacttgatctatgttctataaaagtaaccgaagggtgaattggaggtgaaatctgtgagctgaagagttctattataaagtaattatagttggatagcaaaagaggatgaaggcctgaactagccagttgtggcagaaaagggggaggaattcacccgacgccttgccagaacaatttgaaggacttgagactaattagatatagagctgaggaaaagggagaggttcagcttccctgccaagtctctagtttacatgattgaaggattgattataccatttacaggaaaaacagtgggagggacatacaggttttggaggaatggaggtaagtttagtgttagagatgttgaaattgaccgtgata

SEQ ID NO: 127150 - DNA, 1068 bp, Homo sapiens
cccgccccgccgccccagtcccttgcattcacacccgagctgcgggacggggtagaggggtgcggagttggagtgcccaggaactgtcctaactagaagggcgctcattctctcgggcttgccggtggcgcctctgacgtgtccggggtagggggcagtgtggtttctcaccttcaggacagtgccgagcacagctgtcctcgaggaggggcgtggagtgagggaggttttcaagagcgtctcatcagaatgcacagggctccgccgcgtgtcccctgagaacgcgagtttactgtgcgacttcattcatccggatagttgctcttttcttttcccagcaggtgttatctgaagccggtttggaacttttgggagtttagttaccattatgattttaacaaatgatttttgatgaggcgatgtctcgaatgcactgggcctcgggaccctctggaccctgctgagggcgggtggaggagggacgggcaggctgtgggaagcgtgatggtgagatgtcccgtgttctctctcccccgccccctgcagatcgctgccgttttgcccttgggagtaggatgtggtgaaaggatggggcttctcccttacggggctcacaatggccagagaagattccgtgaagtgtctgcgctgcctgctctacgccctcaatctgctcttttgggtaagtaagtttcactgcaccaacaggtgggaacggctggctctggttttctgcagccaccggataatgcgccaaagggcatggctaagcattaattaattacatgggataacaccctttatttttcagagaagtaaaatttgaccttcttaaaatgcctttgatctagctcaagttccatttgtaattagaacaaagaaatccacccctggatactactggcagtaaaattagacttgaagttaatctagggatataaataaatgcacgtgcttctactcatagataagaaaattatgacatactacttagggaactgcttgtttgcgggaattttagataattgtgcaagccataaattgtttctttacatctctgtcgcctgt

SEQ ID NO: 127151 - DNA, 1067 bp, Homo sapiens
tctcgctctgttgtccaagctggagtgcagtggcccaatctcggctcactgcaacctctggctcccggttcaagcacttcttgtgcctcaacctcctgagtagctgggattacaggcgcccactaccatgcccggctaatttttgtatttttagtagagatgaggttttgtcatgttggccaggctggtcccaaactcctgacctcaagtcatccgtcctccttggcctccaaaagggattacaggcgtgagccactgcccctggcctctaacaggttttttattactaaggtaggatgactgtgataacaagatatgataatgaaaatgcagttgtatgtcctgcatatgaatattttaaaatgattaatttatttttgaaatgaaaatgttttcattcaggactactataaagctttggaagatgcagatgagaaggttcagttggcaaaccagatatatgacttggtaagtaaaagtaatgtgcatactgtgccataagtacttgaataacagattatatcttaaattgtattggcttaaatgtagtaggaagaagcaactaaaactgaagtattgctctcttgatcacatctaatttgacatttcagtgtccattttatggtttctttgtggaaaagtcagagtggttagttaatgtggtgagaactgtacattttagcaagtctatacggcggtaaggtggtttctgatgttagatattttttaaacaagaattaatgtttaactttattttactaatccttgtcttcttaaggtagtgtgtttacttgccttatacatcattttgagattgtttctgtggtaaaatacacctaagaagactgctttgacaagagttcttggtagtctgattaaaatgaagaagaatcatttgaatcagtgtttatgtgagtgatgttaaaagatcgtatgtaacagctgtgtcagttgtttaagcaatacaagatgacaaactttaaacaagattctttttttgcagcagcacttctaaaagattgaaaacaccaagaagatagatagaatattcactatttctcatattg

SEQ ID NO: 127152 - DNA, 1041 bp, Homo sapiens
ctgtaaccgttcagaatcatgtaggttgagggaatgcacatgatggatttcaggcaagttcacagctcttattatggctgtttaatattgtttaaatatcctagtgctttatagcttaagttaattcttgtggtcaatgggactttccaacttctaatttgatttagtacagcagtagtaaatagaagaaaaataatgctcattgcctaataattgcttataatattaatcaggtcataatctcttttacatatgaggaagtaagaatgattggaagccgtcttataaagatgcctaccacaagtggttaaggcttttctgtctttgtttattttaactatgaatttggtttttagagttattaaccctttaggttctagtgccttttctgagctatctagtattgaaagtcttgtcattatttttaacattttcatatgtagtgaactttatcaataatatatttaataaaatgaaacaatccttaaatgcagaggtgaagtgagttagggcaaggtgtatggtatgaaaaagaaaggtctttatctcaccctaacactaccccctcaacctaacattcttgctcactgtgctttatatacatattacacgctacatcatactttgtttttctctaagcatactgtttgtctttctgtctctacattttttattgtgattccttttttccttctatttgaatacaatccatcttcaccgtcttaattcgtacctccttcgtgtctaccagtgttacttttttatgtacaacttctgactctttttgaactgttgcttatttgtgacatctagactatatttttatcccttattatattaaaaatcatatataaatcttgatttgtcagctaaattctaattcctatgaaggcaatgattctcttccattcttcatatatcctccatttaatccagcaccaagcacgtaatagctcaatatttattattagtataattgtaggtacaaaaagcaatggagtgttttcgttgcattagtggtcttggaacttaaatatgaat

SEQ ID NO: 127153 - DNA, 1074 bp, Homo sapiens
aacatcttctatccacacacaaacagtataatttcttcagttaaaatactgagagaataaatgagattcatgttaatgtctccttattgctataagaggtgtcttttaaaaatgactaatgttcacccaccattattgagtcctgtaactaagttccatattcaaggatcttatcctgagtatggcaggcctcctggcataagggatctttcctgttatttcttgcttaggaaacagattatcttccttgtatgtcaatatatattccccaaatcatcaaaaggtgaatataaaccttttcaacattagaatcccaagaaatccacatgattgatgggttgatcagataaaggaaaatatgtcgatcaggtaagggaaactctcaggtccaaggttctagggattccactgcaagagtcaactttactagcgctgcacagggatgggcacctctctggttgcaatgccattgtatattgctgaggcatcttgcccaaggctggatggagtggttacttgcaagtgtggacatcagtcatgctttcacacctcctgcaacggacatagcagcaccagatgaacttacactcacacctctccacgtgcctgaccacatgggtgttgtaacctcggccacagcagaggaggttgcagccatctgcaccctctgatgtacggttgcattctctgccttgtgtccctgggattcccagtttcttatcttctacacagtagttgggagacttattaacatagagcagatcatccttatggattggtattttcctctgatctttttctctcctgcgcattttcctctttgttttgtctgatatctggatactgttttcatatttatccttcaacaaatggccaatcttttcaaaagaagacatggttttccagcatgttttcacagcacaggagccggaaactccgtggcagcggcagtctactgacatcaacttggcgacagcctgaaaccaacagtaattgtgttcaactatcaatcataaagtgttttactcaacaacagaagcacagttaatctaatcaattaactttctgggtcta

SEQ ID NO: 127154 - DNA, 1606 bp, Homo sapiens
tagtaaaatttaaattaatttcaaaaaggagacatcttagccaactttctttaagaaaggcttgtcttgaggagtatttgaggtttctgaagataggattcaaatttttcttccctcaaatcacctaaggtaatcagtgttccagatcacttcctgcctctaaatagtgagtcgaatttctcaatctttgatgacctttgggaggtgatgcaaaaaggatgagcaactcactaaattgcctagaaataagtattttgatgagacgcttttctgtttctactacgtatttaaacttagtacaaataaacttagtacaaatatttaaactaagtacaaatatcatattagtactaacagtcctggagaaaattaaaatgtgttttaaaatacttactgtgcatatcacatagttttaaagctgccaaaacataaggtcacagcatctaatgtgtaaaattaaaattttgttgttatttttaatataattatcatagtctcttaaaatagaaaacaaaatgactatcatccgaattgtgaataaagaaataatgcagttgtttatactaaaaagaattaacatgttgttaatgttgtgtaaagtaccattatcaggaaaatgccttaattattcaacttcctaatccagatgttacagataatatcatttaatatgtttttcttgactttgtttcaggatgaatcattgcctcttaccattgcctttattaggcagttccaaatttacaaagaatttgaactcctaaattgaaaaataatccactggagcacctcccttcgccctttaacattatgcaaggtatttaaacaaatcaaagcactttgaacccacattcataatccacagtgcttagggcttgctttgtctgttgtgagctccatgtaatatcaaaagctgtttcctaaacagctcactagaactaaggcatataatgtctttgctgcccagcgtccaggtactccttaccagtaacataacaccctggttttcctttagggaaaccacccccgtctctgttctcacgctgtgtaattttagttccagggaatcccacttccacttccagggtcatgatggccttaagatggttcaatgtacctatggctcacccaaaactcccaatggtcatggtgattttttcagagagaggcacatttaatcaattagaaccactgagactcagaagacctttgctgaatcctctgagaaagaaaaggttttctttccatctgtgtgagcaaaccaggagagaacctctctttcttgaggatgggacccctctttccttagaatgagtggcaggtaggagaatgtgaggtctggaagcatggcagccatgttgctaagaaaagtagagatcccagagatgctaggggtgggagactttgaaagaggttaggacacagcactgcatgaaccctgaagtagaagacttggccagtagccagcctaaagtaatagagagacctgagcccagggaacatggtgtgagcttgtggatcaagcttcccctgaaccagtcacaagtttgaagtttttagttactgagtcaacatatttaatgtttaaatcagtctgggttgagtt

SEQ ID NO: 127155 - DNA, 2459 bp, Homo sapiens
aatgtattctttcagctgttatttgaaggtctgccatgtatgtgatacagcctgagggtcactcatttaatatcttgaccagtaatttaaatgaacttattgttgacatgagtattactgaaatgagaagtgtgtaaaatgttacggcaaatcagcagtttacaacggttttttaaactgtatattattactgtgttccaatagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctatgaaaatatcatggaataatagggattttagggtggatactttattttcttttatgtttctatatgttgcgttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaatgttgcagttttttaaaataatgaaaataaatactcttggttttgctttgtgaatttttttttttttttgtattatctggcaaagtaatatacctacagaacttcacaaaaactcacacaaggtttttcaagcatttattatactgcctaacttggaaaaaaaattgttgctgtggttaaaaatagtaatatcctagatgtgtcttaacatgtaagaagctaagtatctagatggcggaaaaagcccttttattaagactgtaaaaggatagcttttccagatatataaaatgttaaaagaagacaaagattggttatgttaactggtgtggtttccttttgtctcagttcaatcttgtatagattgtgccaacttaactttgaaagcaataactttatactacattttcagatacctctttaaaatcggttttagacatgaaacagtgctcatttaatattaagaatgttctttattaaaatcaaattaacattgacatagtatttgaaatggtgcttatgggcttatcgatgcatattttttatttgtaatccgatgctgtcccagaataagtgtattgtaatgtgaatgttaaaattgaacaagag

SEQ ID NO: 127156 - DNA, 1042 bp, Homo sapiens
tcacacttagtagcaaaagctgtttctgtggcttttaataattttatgagtttcatctcattctgagcactacaggtcttcctggttagtagtattaaaaattttgtcattagtaatgtggtttgctttgtatttttgcacacttcctttcttaagtttgagtccatcataaaacatccctatgatagcactaatttagaaactatgctccatttttttctggaagtgttagcaattatatagtgaaaattatagagtttttctgtttgtttgtaaagagtcgtattccctcataaaaatttctaatccgaactttgtataatatgttctctttaaagtctaggctgggtcgtcatttatgccttatatagttagcatttcttactcttcaacgccctgaggtaatatggcgattttcttccagactttctccttcccagcttgttcttccctattaatcagaattgagccattaatattgtccgtcttgctttctgtgcttccagaaaggcagcattggcttggtttgatggtgcaactgtaggactatccgatgtgcctcctttcccagcaaggattgaggcagaacccacagattcctgtgtccagttcccacttcctccctttctagtttagattgcctctgggcagcattagattgtcttctagcaaaacctgataccgttctctgtctatcctggtttatcacaggataattttctgttcattttgaagaaaattattcactaaaataatatatttgacataaatttttaactcagctagttaagaccattagtaaggattaaaatatatgtaacaaactcagagtgccctatgtggaataaaaagcttgtatctccaacctttatgctatataaaaatatatttgctgccctggcttttttaaaaaaggggcattttgacatttcctgtatattcaattaaatactggctatgttacatgattttaaacttttgaaatataaagattttttttacttagttacacagaagatatctaaaaataataataaaataa

SEQ ID NO: 127157 - DNA, 1029 bp, Homo sapiens
tgagattggatttttttcacaagtggtttttttttcttttgcctttttatgtaaattgtcttttgaccattcgagttggcctatcttgacttgtaagaccccttcacgttttaaggatattaaccatttctaatgtaaaaagaaatgtatttattgtacattatttgcttttaattttgttagtgtagggtgctttttgaattttagaattttagactaatgcctatatagtctatgtatttttctatcactctccttgtatacttgagaagtatttttccacctccaggttagatatttagtagattttctcttccagtgatttcactgttgtcatgtatttttaaaaacccatttgtaatttccccatgacacacaatgcctatgttcttatgtagatttggctttatctctggaatttctgttctgttccattcacttgacctgtttatctctgttccaaaaagacactatttcaattattttaaaattgttttataaaagtaattgtacttcatgcctctctggttgagattaaatcccctttaatgttcttctttctagaaaaaaataattttttctctgacttttcttcagatgacttatcaaggataaaaaacatcctttatagattttaattgacagagctttaatactacaagatttatagattttatagattttaattgacagagccttaatactacaagatttatacagaaatttgtatttttatgtattgatttttataaatgtattattttatagctacattatcacagatttacatgaaaacagtgatactttataaatggttgtaagctgaagtaatttcattgacattgtgcgttttatctggttcaactaagaatatattaaatccataaattgaaggttaacataaaactcgcctattcaagcattttcatctacctaaatagaatgaaacaggatgtaattaggctctcatcaaaaaacaggtaacttgctatttgcttttgctgagagaataggctattacgtgtaaaa

SEQ ID NO: 127158 - DNA, 1515 bp, Homo sapiens
gatgtgagtcactgtgctcagcccatacaattttacatacacttaaggagtccacacacctcccatgcctccttaagcttatgcatggaccccagaataaggttttcaggatcccaattattcaaatctgagagatctctgaatttcttacttcgtaagtcatgctttactttgctatgatttttttcacttagccccaggaatatcaatacgaaagacacaggataaatcaggaatgggaaattgtaagttgatagtgggattatgttaagggacaaatttaacagtttttaaactctttatgagatttgtctgtcttttggattactttacattggaaattattgctttacagatacttcatgttttataatactactttcagagattatcgtgatgcttattcagtcattttttaaaaccctaaaccctttctttttcttcagatgtggcaccatttattgagtttctgaaggccatacaagatggaacaatagttttaatgggaacatacgatgatggagcaaccaagtatgtaaactttacagaactttttggaactataatttgtaattataaaagcaatacattttcattaaaaaaaaatctgtaacatagagcaaagtaatcaaactaccaggtaaacacaactaacaatttttgtttttactttgcctccttcctggttttatatgtaaatgtttatcacacatatattgtcatgaaattagaatcacatcatatgtaacattttttatacttttatgttttgttttttaacattctgaaattgtttttcctagcattaatattcttcaatagcatttttatggttcatcagcagttatgggctcacctttaaagtttccctattattatgtcattagggtaaatttcaagaaatggagttaattgtcaaagatacaggtgtgctatattttaaataattttaatatatagtagttttataactttttcttaaaatagtatatgttgtaaaaatttggaaaattatagaaaagcgcaaagagaccaagttccagtccatctcactacccagtgtaaacattgatgatattttagtttctattccagatgacttaagacacattttttggcattaaatatttagaatgctagtatttatagcatatctcttcacttacgtggtgaatatttccccttattattaaatattctttataaaaaattgtttatgcctgcctagtctggtttttaaaatgtcatgatttataacctgtttaatgggttgcctattgctggacccagactagttccaatttgcatacttagcacaatagactatcttagaaatgtttgaacagtccatgtctatgtctttaagatagacttcttttttttaaagtggaaatgattaattaaaggatgtgcatgtttttaaaaatggattttaaaaatttttttaccaattttatatttttctcagaagttccatggcaccaattgttaatttttttaagtttcaattttaag

SEQ ID NO: 127159 - DNA, 1407 bp, Homo sapiens
aacttctatttatccttcggcttaaaagattaatgagaaagttctattaagaaattaccctttaaaaatatatttcaggtgcatatgattcagattttaagttctcaaagtaattctttgagatgaattcacatctctctaatgctaatgaattcacatcttctctgctaatgaattcacatcaatcattggatgagattattggtcttacagtgtatgatatatttcagatgcataatttgatatgaatttaatctcttttaggaaaaacaggagaagtattagacactaaatattttgacatgtggggaggaggtaagcataaataacatgactgtgttcttttgctggcactgacttaatcacctcaatacaatgtagcccattaatgagagaatgatgatgctatttgcgttagttcattttgtttcccttactttctgttcactaaatgtccagctgtatttaagttatcattcatgttttatatactttcttcttcttagaaaaaaatttttgtggtgtataattgaagatagtaatatcaaaattgagatttttttaaaaaaagtcatcttgttttctacaggacaaccaattcaaaagttttgggctcctttaagtgtgtctaaaatttaaaaaaaaaaagtaatttgaagaccagaataaccaatgtaagcattcctaagtgataggaattgatttttttttaaatgtgattttttagtctcaaaaataaatcattaggagcattaggagcattagaaagacaagataaactatcagttttagaacagcagtcctattattcatcacagttctaccctctgacttgcagctaattttttaggtagatgaatatttgagggaagaaatagaattttctttcttgtaaagcaatccacagatattttccccttccatatttggaagtcccacaaggagtgggaagaagttaccagcacgcagaggcaagggactggcaccccaaagaagaacgctgcccggaagaatgggtttttttcctccagtttgaagggaggccaacactggtttatcttttgattctttaatttgggagattgatcagtatgaggatctcccctgcacctccccattccatttatatattccctagaagccaacagctattaggcttcctgaaattcatgttaagagttctcagataatttagcttttccaacatatcttcagcttgtaataagatggtatgtagccggacgtggtggctcacgcctgtaatcccagcacttcgggaggccgaggcaggcagatcacgacgtcaggagatggagaccatcctggctaacacagcgaaaccccgtctctactaaaaatacaaaaattagccgggcatggtggcatgcacctttagttccagctact

SEQ ID NO: 127160 - DNA, 1063 bp, Homo sapiens
ttaaatctcagtggattttttatttgttagagattttctgtttgaatttcagtttttaaaaattgataagctgctgccctcttgtgggaagcctatgtcattgtgcttctttgttacctttatttctttgctttatgatagatttcagtctgtaaaatgccacatcatactccttgatgatctttacttggaaaagtcactctggcacttaacccgttaatcacagcagttacttcttaatgatggagtttacttattgaatgtatttctgaaagaaacagaacagtacattttgaaacttccttctctttgatgcagctgagccaatggttaagtagtaaagcatagaaccttttaaatgtatatgctccaagctagtacttttaaacagctttgagatataattcacatgccgtccattttgctcatttatattatacagtcagtggtttattatattcacagatatatgcaatctctgccacagtcaattttagaaaatttttatacctcaaaaagaaaccctgtaccccttagctaatatccttctatgcctttcttgtcctgccccacttccccacccccaaaccctaagttaaccattagtttcctttctgtctttatagatttgcctattttggacagttcatataagtggtatataatatttggtcttttgtgattggcttcttaccataatgttttcaggcttcctccatgttatatcatgtatcagaacttcattccttttatgtctgaacgatattccattgtatggatataccacattttgtttactcattcattagttggtagacatttgagttgtttccactttttaactataatgagtaacatttacagaaacatttatgtacacattttatgtggacatatgttttgatttctttatactcccagggagtggattttgttttaggtggtaactctgtttaattatttgaggaactgccagatagttttccaaagtggctgcatctgtttgcatttccgccagcagtgtatgaaggttccaatttctccacatccttgccaacacttg

SEQ ID NO: 127161 - DNA, 1844 bp, Homo sapiens
agtcaatggaacattaggccttttttaattatcctggaggtgacgattttttgtgcatatatggactagaagtgcaaagtaacattcagaaccccccacatcctaaaatttaaaaataaactcatagttagataaaatatatttgccctaatgcagatcatattacttgactcatttgcatccattattagtttgtttcctaggaagatctggtgtctgttgtgggtttctttgttgctgtttttttttaaaaaaattttttgaggttctttgaaaccctcaggggaacaaattagcttgtattttaagatacgtgtatcttgatgtttttcttaatgctctttgtggtttgagatttgaagtaaagtgaggtaaagtctgttaacttgttttctaaaaaaagacatcatgttttctcccccaaagctacaaagcctcccagatataagtgtgggatctcaaaagcttgccctgagaagcattttgcttttaaaatggcaagtggagcagccaacgtggtgggacccaaaatctgcctggaagataatgtgtaagtctttgttgacttgagacgataaggtgtgctattaaattgcagccaattgaacctgagtttaatggatattttgaaaatgtgttcggtatactttattaatggaaagtgatttccatttttgttatgtagtttttttctcatgaattcaagggaccttaaagttcttaaattttatattagagagtgactaagaacgtaacacttattcggctttatagagataagagatttcctctgagtaaattctctagatctgcactgtcccatttgctagcaacagaacacatgtggctatttaattttgatccttaaatattaggaagaaagttaattcacttaaattaactaaaaagttcagttccttggtatctgtcaccgcagttcaggtgttcagtggccacatgtggttcatggtcaccaaatggaacagcagagagagcattttcatcgtggcagaaatcctatttgcaacattgccctggacaatgaatgtgttctctttattttaaatgaaatccaacgtctttcatttaaaatatttgagtgctacttgttgaagtgtgaaatgatccagtgataacctcagttccattgcagcacaaactgcttgcctctaagctgaatggtttcctatgttgagatgctttctaaaggatggtttttaggatttttgatatcctacctcagtgtcaactgttgctcgcaagttcctgctgctgaaattgcaaatcctacttttagttggttgcttttaatatgctattgcctagaaaactagacatgggggcttatttaaatttaatataaaataataaatttgtcacgaattatatagaataaagagataattttatagcaaagaggagacctaggcagcttttcctagctgtttatgtgcctcttctttttaatattgaagctcttaaatttttatcctagcctcttttgcaggcagttagctgtaagaagtttattgagcttcatgggacaacacttttcttgtaaaattaagggcttgagctagatgatcattaaggtctgtactgatttcctttattttcccgtattctaatgatgatttattgttaatccatttgtcttctgatttctcattagaatagtcctgttttactgatgcataataaggcacttgcattttagaagtttgtaggtttttgaaaacattctcatttccactctttatcttgtttggttaaatagaccccaaatttgattctaaatcacaggaacaaagttcttttagaatacctaacccatggatgatttt

SEQ ID NO: 127162 - DNA, 1751 bp, Homo sapiens
tgcacatctttctcattttttagaactttgcataaattccccttctttggaagaaattgtgtttgaacctccctctttaagaatgtattgctcctttttctgaacatttgttctgattgcatagtacttatatttcaatttggcactgattttaatctgccttgcattatataattttttttctttttttcctctttttcctgtgtctgtcccccttcacccaagagtgagtcttaaaggcgctattttggtgcttcacccagcatctagcactgggtgctgcaatcagtaaatgctgattgagtgaaaacaaatgtaggtaacagagaattaggatttctacatggaaaggaagagtatttccaaagtgggattcacataaagctgtattagttggaatatcactggtagtcagctatgaacaaacgttgagttactttattctcctactttttatttcttgatttttcctgatgttaagaacctgcaaagtgtttttgtgtgcattttagctatttgatttagacattatgagggcagatggttattttgatgtcaaaactgaagtgtagtactttgtaaccttactggttgccaatctgttgaattggccaaaatttaattgtgtggttttattttaattctcatttcagactatcttaacgaagatggatatatggttatcttcgtcatttgtttaacatcttagtatatgaaaggttaacatatttaatccagtaggaggattcttgctataatcactatcttaaggacccataagattaaatagttcttttggtgattcgttttccattttttaaacttacttgacaatttctataaattatgtagctttatatttattatatggtattattttagaaaaataaaacacatttctagaaaggaagaatgaaaattttgcctacaattagtagttgaaattaccaatgtcgattatgaatttttaaaaacaattttttataaaactttattttgagataattgtattgttttttacaaatccatttgaatatacagagagatggtgcatactgtttactcagtttctcccattggtaatatcttgcaaaactataatacactatcacaatcaggacatcaacatggatacaattcaccaatcttattcagcattgtggtgtaatgtagtgttgttttcagtttgaatacttagctagtaagtgaactgaacacagtccaaattatttttgtctatattgctgcaataagtacttaatgttctttttttttttcttttttttttttgagacggagtcttgctctgtcgcccaggctggagagcagtggcacaatctcggctcaccacaagctccacctcgcgggttcacgccattctccctgcccaccaccacgcccggctaattttttttttttgtatttgtagtagagatggggtttcaccgtgttagccaggatggtctcgatctcctgacctcatgatccacccgcctcagcctctcaaagtgctgggattacaggcgtgagccactgcacccggccataaatacttaatgttctattgaatttatttatttttaccttttcagatttaaaccattggtatatagtatatacataaattacttgagacattattaacaactaaagtgcaaaatagttctgattcattagcccgacttactgaaggacattcattgatgaaatgcaataacaaatgtttattattgttccatgaaatgaagtgt

SEQ ID NO: 127163 - DNA, 1755 bp, Homo sapiens
tttttaagactttattattttaaagcagttttaggttcacagctaatttgagaggaagatgcagagattttctacatactccctgtcccgctccccatgtagttatcagtagagtgtttctatacagaaatgagtaggctgtgagaagcagtagctctctgagcatcatcagttcattgaagagtctgcgcacttggagctttccatgtaactgtgttatgaagcatatgtgataggtaccaaattatatcctgcaggaatggagaaggcctgtcttaaggtactaaggtattaagtatgaagaggaaggctttgttgatcgccacaccaggagggcttatgtagctccaggagatgtgttggttagtgataggacaataaatctgtaacatgtcacttgagaattcctcgcttagtggacattgtggccttagcatccccagaagttccactgtttttgaaaaatcctatctagtattgctccttatatttatgaaggataaggaatctgccattcaacaaacttggtggtggtgttccattagtcatgacacttttttgttgtcagcaactaataggtaatttttttgcatataaaactaggcagatggttcaagcagtcctttggatagctagataatctgagaattctttgatcaggaaaattctttatcttgatgaattgtttgtataatttttatgtatctcatgtaaaattaagatctaatagatacaaagtagaaatgtattgatcttaaaaaatttataaacatttttcatagaaatgcaaaataaaagttctgtgggcttacaaagttatgctgaaatacttctgccttttaggtgctgcaaagttggtggtagctgtggcagtgtttttactgacattttatgttatttctcaagtatttgaaataaaaatggatgcaagtttaggaaatctatttggtaagttttatttttttcctttcttaaatcttatttttgatgtggcctaaagttttatcagttatcagcactgagtcactcagtgctagaaaacgaaatgtgattattatatatccataaatatgatttgttagaatattttacagtatataattagatattttggaattaatttagtataaaacatgaatcttctattcaacattttgaacatatgtaatgagtctattttatacatttttaggggcattaatcatggcattctaagtgcacattctaaaacataaaatacctccaggcttaaattgttttcctgtttaagttggctgctagaaaacttgaagccaaatctagccctcagttagccatatgattaggagtcacggtaatgcattttagataccagccatagaaatccgtcttgcagctggctgtggtggcttgcacctgtaattccagctactcaggaggccgaggtgggaggatcactggagcccaggagttccaggctgtggtgagctgtgatcatgccatactgcactccagcctgggtgacagtaaaacctcatctcttaaaaaaaaagaaagaaatccatggtgctttcttatccttattttccctctgtggcattttttttttctaacccactcatttaatgttgccatactgtaaatgtaccattataaggtaccttaacccagttttttaacagaatccttacgttcataaaataacatttgaaatgttttcatatgaaccagttatacatagtgctattgtagatgattgtatatgaatatcttatt

SEQ ID NO: 127164 - DNA, 1024 bp, Homo sapiens
tgctgtaaatgcttatggtagtggcacttgaattatgtcatatcaaaaatgaagtggcatcatgtactggagtgagccagctgacctcaattccagccccatgtctacaaataatttgttccacaactagataagcagcttaacctctttggacatcatctgcaaactgaaggtttggagctaaatatcaaaagtttcttatagatgcataatccatgagaataagaaggcattctcttctattcacaagcttgataacacacttttactctttggtcattcagttagctgaagacacagcagggtaagacagaccctccttgaggtcttatggtccagtggaagacaggcccattttttttttttttaatgccaatgttggcataatacttagaaatgtcataaaatttactagtttatatgccccatttcaaactcaatctaaggaggaatgtttgctctagagctaatgatatttgctttttgttttgattttttaggagcatattaatgaaaagtgccataaactgaaaaaccaaacatgagggtagcaggtaagatatttaatttagtagaagtaattgtactttttgtgtaacctgtttgttaaagaataactaaaggagaggttaaataatctttatattgagaaggttaaactgaaataaactaaatcattcagccctttgtttttaggtagttggcaaatcacaaattggacatttagtcagtatcacataaatttttttttttgttcaagtcttttgttgaaattacacattgagcttcttaaatctgaagatctgaaatgctccaaaatctaaaactttatgagcagcaacacatgatgctcaaaggaaatgctcatttgagtatttaggtttcagattttcagatttgggaagttcagctggtaagtatgatgcaaatattctaaaatctgaaaaaaaaaaaaaaaaaacctaaagactgtatataatgcccatataaagaatggtttgacaacctagggaggctgattttt

SEQ ID NO: 127165 - DNA, 1051 bp, Homo sapiens
acctttgattttactctgttgttcctgaagttaatttattctagaacaatgactccttattcacatagtagcttgatttctacctgagtaataaaacttcactaaattagatcagagtagatagtggggccaaaggaatgtttaaattgtcaaccatgtaaagaagtttagtacgtccatctgaggccctagttcaggcgctctttccagctgcagtgtttcattgtccagcgacattgtggtggctgtccttgctgttgaatctcaggtgattatgaaccttacatattagcaactggatttggttcagtgacatatatttatcaaaaacactaaaacaaattttggcctatgtaacactttttggagcaaatgtataaatgtactaagttgagttttggggttttttttccatcctaaaaatatccttctgtgactcattttctggttttggtaagtggctctaatatctatatttctaccttttaatgaacatacttatatataagccctttcgcctgttgcctctagatttagagttctgaatttctagcaaaggcctttttctccctttactattgtgctccttttctctggacctgttcaatccttgtttaattattgatggttttcagcctgaagtttccattaagtttttgcttccctcacccatacaagataattgtatgtaaatattttctttgcttttacatgccccctctaagaagacaaataggaatgatttagaattagcacattatcatcatacatagatgctccttgatttgctctcaaatatattcaatactcctatcctgatgtagattcttgaatcattaatttgcttcttaaggaaattaattgaggcatgttatggctgagatttaatttgatgagattttaatttagaaattttactaaatgtgaattctctgagacattttaatggaaaacagttgtattcagctagacaatcatcattgcttatattgtggtcttagggatgagtttagaaacaggtttgttgggagatacaaatgggtggcaggta

SEQ ID NO: 127166 - DNA, 1021 bp, Homo sapiens
acctgtcaaagccatgtggaagttgtatgtcctacacgtagcccagcaaaaaaagttggactgttagagcctggttgggaaagatgtttattcctttatttttaaattttatatttttatttctttttattaggggttgacaaagtacaacccctaggcctgtatggcccacaagccaaaactggttttcacatttttaagtgggttgaaaaaaaatcaaaagaataattttgtgacacatgaacattttatgaaatttaaatttcagtgtctataaagaaagctttattagaatataattagactcattcgttcacatgttggctatggttgctttctagctacaactgcagagtggcgtaattgcagtagagattgtatggtccataaagcctaaaaatatttaccatctggcccttttatagaaagagtttgccaacagttgccctgttttactcacataaaagtagttatttatagcaaacacagtattttttaaaaaataccatgcttttgtttgtaaatgcaacatcggagtaacctaccctagtgactctttgagttgtagcattcttttgattttagtattatctcatttttctcttttactttaaatgctctggggataaaaatttaattttttacattctgttcttgagggggtctgtattagtctgagttctatagaaaaacagaaccaattacatatatatatatatatatatgtgtgcgtgtgtgtgtgtatgtatagatatagctctagatatatagacatatattccttataatacatgtggagatagcttcatttatatacaggtatatgatttgtatgtgcgtgtttgtgtgtgtgtgtgtatatgtttattataagggattggctcatgagattatgaatgctgagaagtccaagatctgacaagttggcaagctctgacagtccaggagaatgaatggtatagtctggtctgagtctgaaggcattgtctcagtttaaagataggcaaagaaggcgaattct

SEQ ID NO: 127167 - DNA, 1035 bp, Homo sapiens
gatctgaccatctcagctatctcaagatatataagatgacctaactggcgcatctctaggatgggtgggtcatttaaaatgttctgcccttgaggctgggattttgtgcgtgtaaacggtggggagacggcggtgacacatttttctccctcccgtagtgccacccggcgcagggccgctgcggcggcggcagctcccacgtggcaagttcagattgtgcagcgcctggccgggggcggtgggcgggaccgcagacccctccctccgctctccggcccttccctctggccggcccgggcgcccgcttggtcctccaccgccagggggcgggcgcggcttcccggcggcgggggcccattggtcgcggccgggaagcgtgggaggaggcccagcggcgagctggctttctcctggccacttgccggggtgaggggcagccggaggagtccgagaggaagcggaggcgcgagctggaggcggcggctcccgtcggcctccggcaggactgagcgctgggaggccggaaggcgggcgcgcgcggcggagaggcgggcgggaggccggtgagacggctgggaggcggacggagccggggctcaggttcggggagggatggaggaggccggggaagccagacgcccacctacgacttcagcctccgcgcactgcggtcaccggccgggggcgggccccgggcccggccgcgttgtcacggcgtgtccggacgttggagagggcgcaggcgggactggggtcccggagagccgctggccggggttcccggccgccgccccggcgtgggcatccccgggctccgcggagacggggcggcgtctgcacctggcgctggcactcggcgccccggcctggggcgggcacctgggtcgcatcttccccaggttggctgtggctcgcgcccctgcagcgtgtaggctgagagctccgagaggtggggacggagttgggtgttgcattccaactccatagggggccgttttgactcacttgtaaagttttagtgtcgcctatactaga

SEQ ID NO: 127168 - DNA, 1094 bp, Homo sapiens
atggcgacaaaagtgacctctggtcatcctcactgctacactcccaccagcaccataacagtttacgaacgccacagcaatgtaaggaatttaccctatatggtctaaaaaggggatgcataaaaattccacccctggcttagcatataatcaagaaacaaccataaaaatgggcaacatgcagccctcctatgaaatagccattcttttattccattactttcttaacaaacttgctttcattttatggattcacctcaaattctttcttgcatgagaaccctctcttgagacgtggatctggacccctttctggtaacacaggtactcagggccccacttcttttctcggtttcagtgtggatgtcccacttcatagcctcaagctatggagccaatactgattgctctcctgggcagtagaaacacgggggttgtagttccacctggcttcaaacccccaggtccgctggatgtttatctaaatgcggtccttacaaacaaggttcttttaaatggaaatctagcagaaccttctcctttaggctaaaactgttccaccaggcagtctcctgatgccaggatctgatgactcactctctgcttcccggttcctgtgtccataaattccttgaattagctaaagaatgcagtccaggcaaattctagtttcttactcagacacttgactgaatatctcctttactctcatttcttctttctgcttcttttatcatttccctaaatttatattttctactcctacactttataagttgcttttctctctgtaaatacaaatttcacacattttcagaacctaccaagtattatacataggcttctgggggtgctacagcccattcgactctcacaattaagactgtggtgctgttcaaaccaaacaatgtcaggttgttaacatcacttacatggttaacacacttgattaggagtcagtgtcttaattgtggaaacaattcaaaattttcttgtatatgacacaaccagtgaggtattctttggaatttccatgaccatgtttcaggaagtacaaactttgctgctagcatattggtccacaaatcgctatg

SEQ ID NO: 127169 - DNA, 1026 bp, Homo sapiens
attttcatacagttatttcaagcagttagcatagtcgttcattttctaaatggaaaaatagcatagaaattaaaaaatactaccaaactttaaatatttgtattaaaaataaaaagtgataattcactttatagtgaataatccacgttaaaggtttggttttaatgtaatttgcttgggtgaaatacatttatttggataaagaatttcatttatttgttttctctttgatagtctagtaattcagacaaaataattatgtcatctcagttttgagctaaacgaagggttgtaaaatgtactcatctttagtttcttcctaggatcctcaaatattctaggaataattttccaaaccaatgggaagcactaatataaataaagcaattcactctttaaaaaactttggtaagcttccatcctcaccctgactctggaacatccctttttgagatctgccaccccacccccctacaacaaataccacgctttaatgagtctatccctttgatcactagactttcctgaaagaagctaaagccaataggccttaggttatgagcaagatgattcaacttgattttaaagcaaagaactacacattgtttcttcaaagacccatctgtcaaagcctagccactctataggtgctgtgtctatactcagcccattaaaaggagcagctctgtggttgcctcctaagataataagatattgcacaatggtatgtgctgttgctatcatatctgctgaaaccctggtaaaactgttgtcttctcctgaccttatgaggcacacccaagatgcatagggtccctgggctgctgggaaacacacaccaccatcactccattagtcaacatacatccacccttgcttggagctgagaactataattttcttattccctaggcagtaggtcctctgttttctaactctgggtttagggagagtggagggtgcattaaagtttgtttttcattttactcatacatacttggtaaatatctgagttctctgtttgaa

SEQ ID NO: 127170 - DNA, 1027 bp, Homo sapiens
agatctgtaggtgaaggagaaatcactgtgctccagcctctaccgcattcttcctgcttttggacagaaaattaggaatgtgatgagacaagcttcttggggcccactgaattaattcccatacacttaccctattgaaaattctggataacaagatttatgccatagtttgattggcaatggcttacattttaactgttgacttctttgcatttaagagatgttaggcatgattttacatcagcacactagttaggaaacgaaaggaaaagggactagtaaaagagtccaaaagagaggggtatgagaaaaggagctttacctactccaagaggggtacagcttcaagttgataggattaatcaacattgtcacacatagttctggggagttcatagtgagataaagactatggacttggatgtattttaatgaagcaggttgtagtggggattcttttgttagtttgtctgatgggaatacaagctccagagacagtcctactctttccttctaatctgggctccatcttacatgtcatcttttttgtcccaaagtttttcacctgtaaaaagaactaatgttagtaccaagctcagcaggtgctgcaatgattacatgtgtaagtatatacaaagcagttagaatagtgtctggtgcatataaagtgctcaataaaattattatttaaagtcagataaatcttctgtcatattcaggacttctgacaggtttatgtccatcacgcaattatctttcaatagtacagatataattatatgattctccccatcacctgccaaatgaaaaaaaaaaaagggctctttagcttggcatataatggctttaatgagctggcccacctatcctgtttcattcctcatgattaccttccccctgcctgctgctataccagccttttcaaaagcaggtctctccgattctgtttataatcctgcctgaatagcagactatgcaccttcttcaagtgaagccttctttcctgactcttcttttctgcaggcca

SEQ ID NO: 127171 - DNA, 1093 bp, Homo sapiens
ctatttaccttgatgcctgatgaacaaagaaatataaaaacaataaaataaatgccatgttaaataacactgtcaataaataactacagtgtgtcttccttttaaatatgtggtatctattcatttaaccacttctttccatagcattaaaataaaggcggccataaattaggtgttttcattacgtttaattactcccctgtagagcggatggtaaaggttgtaggttagaggtatgcattgtacagaatggtgttttatgaggatgagaagttcccaagataccacaagtgatgattggcagtgtaagatatgaagattttctttttctcttatttccttatgactcattaaatcttgtttgcttttcaaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcagg

SEQ ID NO: 127172 - DNA, 1828 bp, Homo sapiens
cctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgatgacagaggtagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcaggttagttacggatcagaaggacagattgaggtgtggtggtttgcttgctctaaaagtaaaatgaaaattatagaaagatagaaatttggtaaaatggtacatcatcatttttaaaatcaaaacattcaacaaatcagtctccagtttctgaagtataattttatttattatttcaaacaattatttaacacattttggtttttaatttaattctctccaaaatagacaaaacaatttttatttattgtcaatatttcatactctacaggatgtcttttatgggtgggggcaattctgtttgcataatacatttttagtacactgcttttaaagcaagatcagagtatgctattttagatgattttaattttcatacttttgttctaaaataagttgtaaactaattctatttaattataaaatgaattattaaatctgagagtaatgtgacataagcacttctctctgacacacccctgtagaaaggaattagttaatttccacattcatatcagcttggggagctttatttattatt

SEQ ID NO: 127173 - DNA, 1099 bp, Homo sapiens
gaatgttctgtgttccagtggaaagatcaagggttggcatttcatccctgagtggagaaggcacagactacatcaatgcctcctatatcatggtaagtcagagaagtcactgaggagactgccagcttgtgttacagggatcaaaaccagaatgggctgccagaagcaaagactacaggcatgggcaaatgagtggtaaatttaagttaaatctgttgactgcaagcccacagtccacagcaacagttgtaataatggcatgcttttatgtgtgctgggactgaagaaacctcaagcaagaccaattagcagatgcaggaacacaaactcaccatttagggctgatgagtagatataaaacttatacctgcttatctaaaaggctttatttccttcactaaggcagaacccctgagcaaacccgggattcactggcttcagcaaagcctaacctcactgacatcactacttcaggtttgcagcatgatttttagcctgcaaactgggctcattttaggacctggatttctaaagatacaatgcttttcttctgcatttacatcttttgtgtgagggatgagtgttttagtagctgttgtgtgaccttcattaacatttaaggtcaatcaatcacggagcttggcttctgatgaaaacctaattcttattccaaaacctctgttctatttatccagcaaagaaaatattaaggaatatctatgcaggaaacacagggatgtgtggtagtggcatctaaatacattcacatttcaaatgagccactgggtgataggaatgggatctgaaagcagaaggggctagaagagccaggactttagtaacagtataaatatcacagttaatacaatagctctagcttctaggtatctgtagcaaaatatgcaagatgtctccctggttcctctcttgtagaggcaaccaaggtgtctggacaccaaagtgggaaatgtaaactctcctgtagatttcccactctctgtggagtaagagacagtatccacaaagcagtttggtaagtctacagctagaggtgtgtttttaatgaaactgttcaagtttctctatcagcttagctgat

SEQ ID NO: 127174 - DNA, 1044 bp, Homo sapiens
gtttggagaacccaacaagtaaaataaatatttcatttaggctttacatgtttacttagctttgatattcagttcttatctataaagttattgtgtgaccattacacatgaggctggaaatttctgagctcttaaaatcacttgaatcttctgtactcagttgtcaattacagaagcaataagcttatcattgttgataagctaagagcataaaataataaagcaatagtttgggttcctaagtgtgatattttattcagcacatcaatctagttgaaggcacgagaaagatgttaagagtaaatattcagattcaaagaaaaattggagttgaaatttctgtgccaaccaattaactttatttcacaatctgacttattggtcattttattaaaatctagactcttctttcatttgcaattctgcaggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggtaaggatataagttaaatgacaaactttttatcttaaacacatgttaaacatattctgacctaaggatctgtcctagaaatgaaaagcatgattctgattttttccccattgagacaaatacacaaataatcaaattaccttgtcactttcattttcaaaatgatatagaatcattaaacaattagtcatcactacgtcattcctgaattttacacacacaggaaatcaaagctcatttactccagattagtggttgacagaacttaggtgaaaaataaacacagtaaaagaataaatttattaattttaattctcatgttttaatgtaatcccttaccttgtaagtaaaatgggaaaaatactacctacctaaactctcctaagtaaaatgggaaaaatactacctaccgaaacttactattctctaccaatgtagaaagttgatgagtgatagtgatgtagtaagt

SEQ ID NO: 127175 - DNA, 1054 bp, Homo sapiens
ttccatgtgatacccattgtcccaccattatttatgaattagcaatatcagttcagtcattcatatagtgtgtgtgtgtgtgtgtgtgtatatatatacatatatatatacatatatatatgtgtgcttgttctaggacatttattttattccattggtcactttgttcatccctcagccacaatggcagtgttttacttcttatagcttagagtaattcttgatatctgatgagttaatttcctctattgtttttcttatttaccagtatcttggctattttggccctttgcacttttatgtaaaatttaggttctgctacttgtttttaaaaaaggtatcatttttttaaaaaagtacacttttggaagctggaggcgagaagtttaagggatttatcaagtcacagtcttgttggtcacttaagtaagaatcagaattgggatccgagttgaacctagatctctacctccttgtcggcgttttctccactgtgtcatgcaatcttttacttaagcctgaggattactgataagtgaagaaagtgtatgctattttcaaaacagattttaacaccaatgatttccttttataaatttgaatttagccgtgcaaatacatctttgatacatagtttcatggtttgtaagcattggcatatttcacccacagatagagtttatttttagaataaaaaaagaaattatgttttttgattctactagtaaatctatgcatgttaaatgtggcatcacaactgtttcttccttctatgatgaagaatgtgctgcaactactgctgctcactcatgcctgccattgggttttattaccttactgtaattcctgattttcctcaatgattccactcctggtaaactgtcactaactaacattactttgtgttttcttgttataggatgattatgtacttgaagtgaggcactttcagtgtcctaaatggccaaatccagatagccccattagtaaaacttttgaacttataagtgttataaaagaagaagctgccaatagggatgggcctatgattgtt

SEQ ID NO: 127176 - DNA, 1034 bp, Homo sapiens
tttcacataaattacctccactgatcttcagaccattcttgtaaggtgggcgggatagctgtccttttccccactttactgagaagtacaatgaagagagagaagcaaaatgacttgacatttatctcgtagccagacagcggcagagctgcaacttgagccaagaagtaaattcatcaacaggctccctgcctctatcttgctttgtccctcagcaaattcatcaacaggcttcctgcctctatcttgctttgtccctcagcaaattcatcaacaggcttcctgcctctatcttgctttgtccctcagcaacacacatgtgtgtatgcacagactcactagcaagcaccaagaatcaggtgctgggctacagcctccatggttcaagctgtctagtaaccatagcaattgccgctgtcctcgtggcaaatgagatcacccagtacacacttgctccaagatttgagttacaagagatgaggcattttccacagagggccattaagtttggaattccctttccctggtctgacataaccctagagtattcatcttctgggtccttgcaaactacatcaagttgagttagccagtcatgattggtaagaaatcctaacaggcaggaagaaagtgctaaattaacttctacatgtgagcaattcgcaattttgtgggtggattttttttccctaggcatcctttaggatagctacccaagcatacgttattctcattctttaaaaatgcacttatagttcacagtcagtctgcatggttttgtttctgtgttcttacatcatgtcgcaaatgatgtgatggagaaacctatagggaagtttttgtttcttttgcataaactattttgtagtaattgatcagccataaagaaaagattatctcctatgcactcacagcgagttctctggtcaccagagaccaataagctgtgtccctagaactattatcactttgttgaagaagctgctatgtgaacaaaaaccagtcttcgttaatttcccttttcctattgaaaa

SEQ ID NO: 127177 - DNA, 1007 bp, Homo sapiens
tctctatgaatttttaaaataagtttattcacttttaattgacaaataattgtttatatatatggggtacaatgtaaatttttaaaacatcttgacattccttgctggagattttactgggaatgccttcaatctataggtcagtccttggaaaattttggaaaactgacttcttaatattgagtcttccaatctgtgaataccatgtatcacttcatttgtttaggtagtctttagtttctctttgggatgtttgtagttttcagtgaacagatctagcacatcttttgtcagatttatttctaggtatttcatctttgttgctttagtaaatggaattttttatttcagtccaattgttttgttatctttgtgattgctttagaatttaaagtataccctttaaatttattatatatcttcatgtatagtatgcacactttacaatagtaaacttctatttctcctctcttggcttttgcactattcttgtcatatattttacttctatatatgtggtaaatcccacaatacattgctattatgattattgccttagtcaatatcttttaaataaattaaaagtgaaagaaaaatgttatgtacatgtccattttgtacatgtccattatgtacatgttatgtacatgtacattaccatttccagtgcctttcatcatctaatatagatattttcacttcttggaggacctcctttgacttttcttgtagtgcagatctgctggtaatgaatacttttagcttctttatatacgaaaaaaagtatttattttaccctcattttgaagatatttttcttttagtactttaaggtgttgctccactttcttctagcttgcatttgtttttccaatgagaaatgtgctgctattttggttttttcctctataaataatgtccttttttcctctagctgctttaaagatttttctctttaacactgtttttgagcaatttgattatgatgtgccttggtatagttttct

SEQ ID NO: 127178 - DNA, 1086 bp, Homo sapiens
gattacaggcgtgagatctttttttactttgttaaaagtcttgatataagtatgcttgaaaatgtggtcccatgtttatgtaaatctaggactactcctaatcttactcttagagatttatagcctacgttagcatattaaaagctgtaagaaaccatgaagtgaaagaaggctatttatcttcttaataggctaatgatcccaaacgtatcaacatgaatacttatttatggtgcttctattaatatagaagcttgagcaccaaatcattgtcttggggaatgctggatcataggcatagaagacccaacaaatgcaagctgacaaacgaaaggtgcttgaatctctgagctaggttttgaaaaatgctaaaatttaataatttatgtgcaaattatgttatatttttaattgggaaaagagtattttgataaaaaaacgaaagttaaatttggtaaatttaatgtgactaatctgtaaactttttttttctcgagcaggttagccaatatacctttgctatgtgcagttatagagaaaagaagtctgaaccacaagaattaatgcagcttgaaggctatactgtggattataccgatccccacccaggtaaatcttaattgaatcacttttcctgccatgtatgtatgcatggaattcttataaatatcctttgtctgttctacaatttaaacccctctcgatgaatagggtgcatatttcacttatatacctgggcaagactttatgagattcaaattatctcttttggagggcttgtatttttagccatatttcatcatatttgttattattttagcgcaggattgaaatgtgtaaaattcactgtaatggaataattaggtgagatattacaatgttttcagaaacttctttgcgggaaagcaaaagttatagcagaaataggcaaagaaatggcaaatgaattattatattataactactaattttctccccaacaatacatgcttgtacttctctctctcccttcatattaatactggaaagagtattggacacctgatatttaaaaaattgaatgaatgaatattaatgacattaata

SEQ ID NO: 127179 - DNA, 1020 bp, Homo sapiens
cattttggggtcacccagctggacagtgacccttcaccctggattcttggctctgcagctggctgctcctcagggcgcactactcagctccagtcatctgagaactgaagcattgataaccatgtcctcaattaatagcctttgtctctcctaagaattgcatgtaagaataaaattcctactggttctttgattatcctttctaattcctactttgctcaatttgtggtaaggactgacaaattgataagtcacataaatcaattccctttcgagaacccagaataagctaactcattttgtatcacagaagctgcaggttgtctcactttccaaatgagctaaactttgcctttagcaggctggtctcaaaaataaatacctatggaagaaatgtgattacatggaagcacaacattattcatctgaagtattctttggcttttgtttttctttccagatatctgtatgcccttggacagaaggtttggaaaagatggaaaaaacgttactttgttctagttcaggttagtcattttttcctgttaaataatcactctaagatagcagttctcaaaatttgtttatgtgggttatatctatcaaaatttactgttttagaaattaaaatatgtttaagccactttaaataaaagcagtacattcattacatgctaacactaaagtttttatgtaaaataactgttttccaagccaaacaatttagtgaaataagtggcattgttttatgcttttggactctttaccctctggcttaatagaaggtaactgttttcttgcatcagcttctgcattcaattttttgcaatatcagataaaatgtaacctctggaaaactcacctttatactaatgggagaaaaagtgtgaaaaagacaaataacttctgaatattcttataaagacagttttgacctcgtagaccctctgaaaagatattggagatctctgggattccaagactataccttgagaaccactgcatcattctatattttat

SEQ ID NO: 127180 - DNA, 1028 bp, Homo sapiens
cagtttaaaaaatattcttaggtatatgaaagttaaaagtgctgctttttctatttcattctgaaccacagtatcacctatttggtgcacatatttttgtttctctgtgtgtatatctttgttatattaacatactcaatttacagtaattttagacattttctatttccaacactaacattttctgccagcattaagtactctctatgtatttatagtgttcagaccgtaaaagtcatattatgaataaatgggttaaaaattatttcttaattaaaatcattgctataacttacatttctataaaatcaattggtttttataagtcatataaaatgaaaactggaactttgtgatacagagcacaaattgcgttaatgattgataggtattatgagtgaaatgaaaaattactagacaaggagaagaaagaagaaagtgtttatcctgctaccaaatattcagtgaatggattataactacaatcttgtctttaatgtttcccatggtaattgtcaggaagaggtatgaagaattgtgggaccttaataatatgccttgccgttttaattgctgagagaagcaagagaattttaattgccaggagatacattactaattaaagtgtcattctacatttattctgaaataattagtttgaatatttgtaagagccgagatataaatttagttccaaattgaggagcatacccacaacagactttgttaaaatgatctatggttaagaaaggttaacaatcataaaactttaaatgtttctttaatttgataccatttaattttttattggattattcaacttgaaaaatggaattcacagtattttaaaacttagtattccttttaaattactataatactaagttaaagtcctaaattgctttcagatttctggggtatcggtattctaaattttttagttttagcatttattacagttcagggaaaatcttcttttgtaaatgatgccaacatgagtataatgtcatatatgaattataaattct

SEQ ID NO: 127181 - DNA, 1008 bp, Homo sapiens
tggcaattgttttctatttgtacttttgaaaaactagaaaagaaacataactttattcaaacagtctttgatttctttcctaacctttgcatttcaatccaccccttgtcttgtgtctttaactctgccttttgctggctgacatctacttcattactcttaagagtatatgcctttttgatacaataactgttactcagggccataataatttcattacatccctggatcctgactttcaggtgggtgctgaaagatgtcagtcaggtaaacaaacccaaacagacaagctccacagtattttggcaatggctgctaaaactatggactgtgattctccacttagagggaaaatggcaaaattttttgtcttactcaacttcatagaaatgtagtttcctgctctgaaactgaagatttttttggctcattatttttcctttaaggacctttaatttttttttttttcctgaaataagaaaatcctaggatgctatttttggtttgcgctaagtaaaaatttttcttctaaacaaacgtatgctttaattatgttaaccttggtgctttcatttatttattgatttttcctgtttttttcctcccctaaactctggtgatgaagattagtttaaaaacgttaatggtttgcagctatcactttggtttttaatccccaaggctttcatggtagaaaaataattgagtgaatgaacccagtactttctaattctgaaaggtagcttagcatctgctctgaggactgcttagggaaaggccagtaaatgtatgcaaatcacttcttccttggggcttttgaagcttttgctctatgtctttgtgtatctgatttcatattctaagaataatagagatgatttgatatgatgtgcctgtttaaaaagtgacaacagtttattttttaaaggtatagtattttgaatacagctcaaaaatattatttcacataatcatggtgctttacatcaaatataagaggcctttaaa

SEQ ID NO: 127182 - DNA, 1272 bp, Homo sapiens
atgaagcaaccacataaacaagtctgcaaaataaccagctaacatcatgaggataggatcaaattcacacgtatcaatactaaccttgaatgtaaatgggttaaatgtcccaattaaaagacacaccatgttaagctggataaaaaagcaagacccattgatatgctgtctttaagggacccatctcacatgcagtgacacacataagctcaaaataaaaggatggagaaaaatctaccaggcaaatggaaaacagaaataagcagggattgtgatcctagtttcagacaaaacagactttaaaccaacaaagatttaaaaagataaagaagggcattacataattgttacagggctcaattcagcaagaagctctcactatcttaaatgtatatgcacccagcatggaagcacccagattcataaagcaagttcttagaatttctcaagagacttagactcccacacagttgtaaacatttttgaagatattataatgaaaattggggtctgatcttcaaaaaaggaattatgttcaaaaataggggctggagggatgcaccaaggagtttcaatcaatggaaatgaaaaatgaagagaaacaacagtaaaggaggacctgaatggtccttttacacatttgatataacaaatcagtgtttcttttagaaaggcttttagtgcatgtaatgatatggctgaaaggtacagcattttaattttttcatttgcactcaggactctttgaacaaagatccaatatgaatgctttaatttgtacaaatatgtagttggtggtgaattaaattagagttgcacaaatcctattcagtatatattgaactagaagttgccagaagcatagtgctattaggtgagcagttagtctggagagaccagatgctttgctgttagctgtttcttggcctagggtgagcagtgtacctttctttgttcactgtattcatgtttaacagtgaatatcttataattggttaaatttctttgctttgctttataaagaaaatacactattggaaagatcagcaaatctaatgtacttgaaatctataatgacatactactaaataagtttgttaatcttataggtgtatctctaaagtctgttgcattttttaaaatagtgtcttagtctgttcaagctgcaacaacaagataccataaactgggtagcttataaacaacagaactttatttctaacagttctggaggctggaaggtccaaggtcaaggtactgaagatttcacct

SEQ ID NO: 127183 - DNA, 1045 bp, Homo sapiens
ttctaatagttttttaaaaagtgattctcacctgcgcagagtggctcacgcctgtaatcccagcactttgggaggctgagttggttggattgatagagcctggggtatatagtgagaccatgtctccagaaaaaaaaaataaataaaaattaaaaaaaaagattctcttggctttttcattttcatgtagttatataatttgttcaggaaagacaatttttacatttttttctttcctacatatgcttctttttggttaacattttcttttctcattgcatttactgaaagttccattatgtaactttatagtagcaatgataataggtatccttgtctttttcctgatctaatgggaacatgtgtaatatttcttcactattacatgtggtgatttgtgctagatattttttattaaatgaaggaccttgaatactgttccttgcttgctaatacattttgttagcaaagtgatgaattacttagatcaaaatctttcaagcacttactgatatgatcacatgggttttgtcctttaatctgttaatgtaacagatttctttaggagtttttttaatacatattggaccacttaagcatatctggtataaacattagtaggtttaggatttttgcagcatttcttataacgtacattggcttttggtgctgtctttgtctgattttggttagtggattatgttagtcttacagttgaacattctgttttggtctctatctctccctatatgtacatatttttgagtattgctttggcttatagcatttctagttttaaatgtgctttctttgcccagtttttatgtacaattttcattttaattttctctttagcccaaatagtgtttttcttaattaccccaaggtaagaagttcacttgaattttctttttttttttttttttgaggcagagtctcgctctgtcgcacaggctggagtacagtggcacaatcttggctcaccaaaaatctccacctcctgagtccaagtgattctcctgcctcagcctcccaagtagctggg

SEQ ID NO: 127184 - DNA, 1038 bp, Homo sapiens
ttaaagtattttggcaaaattacagttttcaagatcaaggtcttaggtaaaacagagaaaaaaaactggagatagacaaatacaaaaagtgtgtaaaaaaaaaaaaaacccacccatgtgtgcacacacacaatagtaagtaaaacttttaaaaagtgtgagcttagagacctggtcttctaagtgacccttttcttgtatcaactgtgcaagaaaaatgtggtgacattcaaaaagcctaagttaatcttacgcagccatctctgtccagcggtcatttggagatataagcgcatatttccctgggtctagtcttccatctgcattaaataatggtagaatacaactagacctcctctgcctgtgctaccagagacctaccagcatatctgtgggagtggatggcagtaatgttgtctggctttaccactgaaaggtaacaaaagtaaacatcacatatgttaaactgagcagatgttaaaatgctggttacaaatataaactgaagtaattcaaaaatgtgtctgacaaaactttaatagtggagaaatcacagtacaatatgggaactgccataagatagtaagatccatgcaagtatcacccaaattcccctttttctatgaaatgaagcaatttttatactgagaatgagagactgctggcttttttttaaaaaagacagcttaattataatgaaatagtgcatttctcttcacttttgtttcccttcccagattatgtgaatacatttctcgtctttaactgcagaacagcaatatggcattctaacatctatttcctatgaaaaattgtgagaaacaatcatctagggaggaaaaaagatagattcactatccatgcacaactactactaacatcttcatatttccttccagcctttgttctgtctgtaacatgtttgttttacctaattttgatcacatgagacactattttcatggcaacatgacaggtgattacagaattcaaaactttgtctaatctaatagatggaaatggtatttagttgtttgc

SEQ ID NO: 127185 - DNA, 1035 bp, Homo sapiens
tcctcttttcccttcgaattacaattcctcttgtcatctcttagaagtaactatcatactgactttcatggtagtcattttcttgatttttcttcatagttttaccacctctgtataaatctttaaataatatggtttagtgttgcttattcttgaattttatttgacagaattgtactgtatctgttattttgtaccttgagtattttgcttaaaattaatttgtaagatttaagtttttgttgtatatagtacaatactatatatacaacaaaactatatataccacaaaaaatgaactattagttttgccaatttatactcctattgacaatgtttcatttctttaggaatgtagattttggtttgttttggtggcaatttgaaagtgaacttagtgatttgtaaaattttataccatatatttttgtgttttatataggaacatgaatgtaaactaactcaggaaattctagaattgattgacagagaggttgaccttatgatgagaggagtcaaacatcataaccttgaaggactcagaaaaagaattgcgacactcttttttcattatatcaaaacacctctgtttaatcctgaagttgcaaaataccttaaggtattctacatttttctctatattcctgtttcaaaatcctaagatgtggtatagtaaattgaagtatattcaaattttgctttaacactttacttgggagtccatgtggaataccatcttattggtagtatctcctttgaatgatattttgttatgttggtaaattaaacttactcatttgacttatgtgtatttgcaaccttcaattatttcctaatctcttcaccaactttccaactgaatattgcattacgttgaatgtattatgatttctcacgcctccatggctttgtacataccgttggtttcccctggaatgctattcactatttacccagccaattcctgttcattttctaagactcaattctcatctcatctcttctccttcatgaggcctcacagggagttaaatt

SEQ ID NO: 127186 - DNA, 1046 bp, Homo sapiens
tggcggccacctgtaatcctagctactgtggaggcagaggcaggagaatcgcttgaacctgggaggtggaggttgcaatgagccaagatcatgccattgtactccagcctgggcaacaagtgaaacttcgtctcaaaagaaagaaagaaagaaaaatactgatttggtaaatgattcgatttcccaaaaggtccttagcaataagttagttttgtttctacttgttatcatacctttgacttatctagaacttgttatacacagaaaatacagaatgttcccatgtttatatacaggtttttcctaagttataaagggtgtagatagggcacagacataaagaagtcagagcaaagaagagttaaattaaaaaaaaaaagcaaaaaaaaaaaacagatgtgagttttgtttgttttgtctttgagacaagtgttccattaagtctttggtaatattttaacctatggaaatttgtatggtttgtcttttcagaggctaagaatattgtacacaaagattcttgatgttcttgaggaaatccctaaaaatgcagcatatagaaagtatacagaacagattacaaatgagaagctggctatggttaaagcggtaagtagctaagtcagttttgttgtcttgtgtaacatttaaccaaaaaagtttagttccttattttttatatattcgacacacttttcttctattctccttccttgaatgctcttttcccatcattcctcccttttattcagcaaactcttgtttattgagtgttttctatatgcaggcctctgttacatactggagtttgagactaggatcagatccttccttgaagtaacattgtagctgttccttttacctctcttcactatttagtcctttattgatcttttgctttttatcttggatatatcaatcttgatctcctttttctaatcttagagaacaataaaagcaaaacaaaaaagggcatttttttttcaaagaaacctgtcaaaaagactagactgttattaagtagcagttaataaaagtctagactg

SEQ ID NO: 127187 - DNA, 1783 bp, Homo sapiens
catgcgctttctttactgggcttcaggactcccccagtctcctgattttttccccctactctttggctttctctttttctggttatttctcttatgcccacttttaaaatttgagttagtcaggatttagttcttggaccttttcttttggacctgtactctgtcaccaagagagagcaaatccaaatagagaacggttttaaataccacctatacactgacaacagatttccatgtaaagcactgacctcttcctttataaaagtcctgaatatttaattgcttagtgggcatctctatttgtatgtgtcagacaggcaacccaaacttaacatgtccaaaatggggttcctgatcttctgcctaaaacctgctcttctctcagtcttgctcatctcaattaatggcagctcaattattttgactcaggtcagaaacttgaaatcatctttgattccttcctttctcttacactccacatttgttatttcagtaaaccctctaggttccaccttcaaaatatatcttgattttgacaacatctcactacctcctctgctactaccctcttcctcagtcaccatcatcactgatgtggataattgcattcacttcttaactgcctctcaatgcttgtcacagcctccatttggtctttttttccagccaggctactagagttagtctgttaaaatatgaggtaggtcagatctctcctttccttaaaactaatggctttccatttcactctaaataaagacaagtttcttactgtgaccctctggttcactattctactgatttattttgttatgtctctactagaatgtaggtttcatgaaggcagggatttgtaattgtttcactgctagaactctgtcacatagtatgtgctcagtaaatagtgttagttgaatgagtgtcttgcacttcctatgatttcataataactttattgtcattgatgtaaagaactgaactcatggtttttcccttctaaatatatttcttcctctgtgggctgtatttttcttgatagtttcagatctttctactccctaggctgggaatttggacatcatagttggtatttctcttatacttgtactctcatattcattccaatgatgatttttatttttattttttttgctgatccttttctataacagctctccagtctgacttctgtttactatttctattgttactaccatagttcaggtccttgttcttgtttagagaattgcaacaacctccttactggcctttctgccttgtttctccttcagtccttttaactcactacaatgaagctaattttcctaatctaatcatatgattttcctaaatcttttaattgtccacagaataaagcccgaatgctttaacttggaatgcagaaccacttataatgtgacattttctctaactttatctcctatgcatttccttatgtgtcctgtacagcagtatattccaaaatccccagtggatgtctgaaaaccacatatagtaccaaactgtatatatgctatgttttgtttcatacatacctataataaagtttaatttatgaattaggcacaataagagataagcaggctggacgtgctggctcacgcctgtaatcccagcactttgggaggctgaggcgggtggattgctttagcccaggagtttaagaccagcctggccaacatggcaaaaccccgtctctacaaaaaatgtggaaattaatcaggtgtggtggtgtgcacctagtcccagctactcgggaggc

SEQ ID NO: 127188 - DNA, 1063 bp, Homo sapiens
ttagaagagccctgtcttcatgcacacacaagggtcagaggaagggaaggcctgccttggctttctgttctaaattcacacacctgcacacataaatgccttttaaaaacgtacattttaccttttatttccttgaacaagaatgaatgtaattgtgaccatgaggtgaaaatagtgaagtctctaccaagggaaatgaagatctccactgttctaagaacagcaaaccttgggaggctaagtctgggtggaagaagagaggtgcagtgacacggaaggagcatgagctttacagtcagagacaccagccttaccctctctgtacctcggtttactcaactataaaattgcaatggcaccttttaatgttgttgtgaaaacatgagacaacttagttcagaaaatatcagtcacctcccttccctcacatggaatcagggcaccaactagctcatgggccactgggatcctttttaagtgattatgtcagttgttattctgtaaaagaatggctgaacagcagaaacagactcaaagagccaggccgaaggactatgggagagattttctagtgaaacacaatcctcttgattggagataatccaaagctctgtatatgaagcaaacaattacttattgggtgactcagagagtttgccaagatcactgttataatctgtaggacacaaaggatacatcgctaatcatagttaatacaaaggactttagagggatttataactttcataaattagagtggagcactagagtgaagtaaaggtaattcaatatgtctttctcttatttgaattcagacacttcttgagcgacaggagtagaaggatagctggaaaaaatgcatgtgctccatgtccccatgtctattttgtgaatgttagcatcatcgtgatttgtgtagagacccactagactaaggcttatccaaggagagctcaaagagagacttgaatggtccatccttagcatcagccaaaaggtagctttgaatttaggggtcttaccttccagcattcctctagcacttatttccttcctaccaaga

SEQ ID NO: 127189 - DNA, 1467 bp, Homo sapiens
cctctctacactacactaatctgcctaaaggtggttgtttcatatttataatgctaattatcatacctacctactttaaattttaggtagaaaattatctgatttaaatacaaacatatttttctcacattgagtaatatgcataatgtagttccaaatgtatttcattactatagtcacaatatccaactaaaaattacgctatctagaattgtaccaaccaaaatctcgtattggcagatcttgacaggctggacctgcaagatgtggcttgaattttaaccatttattacataatctctagtgatcatgcatctagttatcataagaaataatttaaaaggttttgttgctgaaagcagtaagtggtgcagtaaaatacttaagttattcaaagaatgttatctttcttgcaagagtaatttaagcacatgggaaagattctagactttttgtttcttgcaacaacagtgccctctgctgctagaaacctttttctacttactatcatttttattgtggcttgagctcagtcaatctggtgcagatgaggctggacaactactaaccaataaaatcaggagtttgtacaaaagttaaatggaacattataattattttaagtaatgttaattgaaaaaattttttctttttgacaatataaaaaacattttaaatttcctagaaatgtcttcagggtaatgccaatttaagatctctcttaacttgtggccaagaaattctagattttccagctgactttggtataatatatatttatcaggaacttctctcagcagagagtacccattcttcgagttcaaagcacaattttaaacatgtaaaatggatatataatttgccaaaggtaattaatttattctttttttcttaaagaagaaaaagacattggttgttgttacaaaaagtctaaattactgttggttgaaacacagcagctgtggagttcagtccaggcatgaagactaaatctgctttaccaagtaaggtgtaaggttgcatgtttcagtcctctaccatcctgcactgtgagcagcactatacctgtgcgttgtctgaaagccttccgtatattctccagctaaatggtcgtctggtagcctttgcatttaacaaactagcatgaggctttttatatctaaatgctacgtgatagacaatttcagctagccacatattgtatgtatgagattcataaagactttcaatcatttcattttcagacaactgaaattttgtttagtatgtgaattctttttttgaaatgtatagtgaataggatgttgcactggtggcaattcatcatggagcataataaaattaatttgacccaaatagaataaaataatgtgtttcatgtgtttattgttaagagagtaaaataggtttaaaatttttaaactgtatagtgaagggtacagagcgatcaatgataatggttgatgt

SEQ ID NO: 127190 - DNA, 2288 bp, Homo sapiens
taattatcgttttaaaagtaacaacttagtttagggctaagagaagataatgttgcttctcttgggcttctgttaattttcaagttctaatactagagctccagtacttcttcaaatactaccttcacacaatcaattttacatgagaaaaatagaagaaaaagattgttctgtgttctgtacatgtaacccacacgtatgtcacctagtcttactggctttttatcattatcaagtacaattactcagccactgtcccactttatatacttggccttcatgggtcctatatatatatttatatacatatttatatatatttatatatttatatataggtatatgtatttatatatttataggtgtatatatttatacatattttatatatagatatatgaagaggttaaatatggaaagtcagtataatatagaagtatgcttataaaatctgataactaaatattccttcaacaaatatttattgaatggctggtgtgtagtgctgttttggtgttgaggatacagtgagaaataagataggcaaggtccgtgctgtcatggagcttaatagataaagtacaataattttagatattagcaagtgatatgaggaaagtaaaatgggataggccgttactgattatggggaagagctatactttacatatgatggtcaggaaaggcctctctgaggaagtagtttatgaatggtttctaaatgatgaaaagattcagtttaacgaagaaatagctactgcagaagttctaaagccagaataagattggtgagtttaagggacagaaaggagaccatcttactagagagagtgacttgaagggagagtacatatgagagaagtttggggagagagagagacaataactggacaaatcatgtagggtcttatggagggaggtagcatcagatttcattcaaatagcagtggtagccacaggaggactttaagaagggtagcaacatattttttaaacttgaaatttaaataatatcactccatttgctctgagtcaaatagactctagagttgcaataatccaagcaggatgtgatggtggtgtggagagtagcagtgaaagaggtgaaaaagagcaggcttgataattggatcgtgaaaaaggaggaagtaataataatttctaggtttttggcctgattatgtgacaggatggtgatgccatttattgagatggagcagcagaccaggatggagcaggaaaagaagattggggaaggaaataaaagttagaagttttgagtttgagaatccatatgaagagtacaagaaggtagttggatttgtgacagaaaggtcaacccagatgattttatacattaacaggttgaaatttgtcacatagatattaaggaactagaaccattgtcttctaagccctgttttaatctttagtttactatcatactctatagatatatttctttagattcactttaaactgttttagtaactagattcttctgggagtcacattatctgtgtttcaggagttaaataattggagaaaccacccaagaattatgtaatgtcattttatttatgcatatgttttaattgtcttgattttcttgtagatgaagatgaagatgaagatgatgaagaagattttgaggatgatgatgagtgggaagactgatctatatattatatatatatatatatttttaaggtgaaatactaaacactactttctgtctgtggattctgtaaaattatcatgtaaatgttctaccaatttgctgtatatttttgttgccttttttgcttttttttaatctgtgcaatacctcatttaatctgtaaaggtttgtcgtaatcctctacaaagctactccctgttattgtgtgcaagtttacaccaggatgctcacttgatttgtgaatatttttcattccatcaacaagggagtttaaatactatatgtgagactgacaaaaaccttaatgtaatttacttataatgccagaaggaaaacactattttcataccctactttttctgtacctaaattttcttaaaaaaaaatctagtatagcactacattcttttttaagtgatgcagaccttagtttctttagcccctttattttgaatacaatgctacatatgaatgttgaagctgatacattgcacagttctgtagacatcactacaccgatgtagtttctcaaattttagcaatatgctctacataaaatcactacagagatactagtggggaagacgattaacacacctcttacagt

SEQ ID NO: 127191 - DNA, 1603 bp, Homo sapiens
agtatgttttcaaatcatatacgttataactgtatgtggaaatgtgttggcctattttagatttttttaaattcatttttgtggtttctagtatctgtttgaatgtgcttgtgttttatgtatgtatacaactgaggtttaaaaccatattattgttctgtcattcatggctaagtctctaaagacttagactaaggttttgtgtaccttggctttatacactgtataaataaaatccttgtgctttgaaagccaagagaagaaaatcatttctgccaagtgataatttcaggggagtgtataccaaattactagaaagtagtataatcaaattctgaatattcagttgttgaattctccagatcttttcattctcctgttctttttggcagttttgccgttgttttatagcactgtgaaactgctggcaaaaattaatcagcgtttggatgcattattttaaagagatattatttgtgattggagtaaaaaatatttttagttatttttgttatagctacaatgttaactcaacaaacatactgagcacctcttgtgctgggcattgtgcaaggtgcttgggattacaggaagatccttgctctcagattttcaaattaatttactttttttgtgtttattcctgatttttacatacttacttaggacaaggtagaataaatgagcattggagatgtctgaatcatgaataggctaatagaaatctaaatgagatgccctctttttgaaggcagggaacaaaaaagaagaataaaatagggaatatatctgttcagttttttttaataaaatattttagttagcacataagtaatataagcatgttaaaagtttaggcaaaataatttcagaaggacacagatgagacttaaaattatgttttttaaattgggatatatttttatagttagcagttactttcttttgtagctgaataatttggatccagaattgaagaatcttttcgatatgtgtggaatctcagaggcacaacttaaagacagagaaacatcaaaagttatatatgactttattgaaaaaacaggaggtgttgaagctgttaaaaatgaactgcggaggcaaggtaacttttatctctattcagcgttctgttttgttttaatcttttgaggtcagtttcatggaaaccagttaacattcatacatgtgaacccttccttgagcagaatgttgaagtctatggacaactaatgtggcccatcacactgtgtcttaacattatttcattataactaaaaaaactttacaaggttttgtttattctttattcataaaaatccatacaaaatcttcccagctattctattttaaagtaaaaacttatagttgcctaaatgttatacttaaggaatcctataaaccaccagattttattgtaattcagaagtaataatttaaatataatcactttctaattagtaatatacgcatttccagaatataaataatgtaaactttctattttgaaatacaaatcctttttcttggataaagtatgaaattttcttttgtacctgagagcacaatttataaccttttaagatttgatatttattttaaa

SEQ ID NO: 127192 - DNA, 1942 bp, Homo sapiens
ctgtcagctgggctgccacactagctctctgactggtcttcctgctgctactcaatcctttttactatctcttttctatacagtagccagagtaaacttttagaattgtagattaggttatatcactttctctatttaaaattctgtaagagcttcctatcatatacacataaaatctatagtccttaaccatggcctgtggaaccctacatgatctagtccctgactttccttcttgtctcctttcactgtgccatttgctcactgtagtccagtcttcatgatgttctttcatgttgcaccctccttggggcctttgaatgtattgttcccttacttattttatttagatctctacttaaatgtcgggtcttctgaaaaatcttccttagtcacacgtatgtcaatttaggaataagacagtttagtgaattaatttttttatgttgatgttgtcttacatatatttaataatattcttctaatttattttctaacagagaaaagacgagatcccccaaatggtaagctttttgacaattattaatcttttaagattttagatgacagtttaatccttgtggaaacatgtaccatacattagtaatatttagtatcttttacatgttaatccttgtggaaacatgtaccatacattagtaagtaatgtttagtatctatgatcaaattatacagtttattgtgttcctatttttaattaatgattgacagatgagacttaggaaacaatattctttgatatttttctaacatgaagaaagaatacatagggtgaagatcactaatacttattatattttaattctggattcacagttgactaagtatacaatcggaccttaacatttttcctagaggcagtacattttgtctagaatatttgttaatgtcctactttaagatttacctttcattcttatttcaaaatattatttcacattgcttatgtgttatatgaagcccctttcaaaatgaacacctactgttgtggtgtatttagaactaatttagctctgtataatgctctttaatttgataatgaccacttgaagtattatgaattcattttttaaaaaacattgaataccagagagtaaaagcagaataccaggatgtaaaagataaggtctcaggggtagaaattcttactctagacttcataaactccctgaaattgtgtgctaaatatgttcttttctctggagagagaggatccatggctttcatcgtatttaaatgaggttcctgactctatgaaggtaaagaatcattctccagcacactttgttatgatagagaaaatggctgctttttaaaagcatatctcaaatcctcttatcagaacctagaatgattattcaaggaaaacttacataatacagagttcttaatatatgacagctattggtgattgttggggtttcttttaaacagatacgttgccttttgattttgtccttaaatttctttttctgatacagaaacatgaaccaaatgttgctgtattaaattctgggttgtttaccttattattaattttttaaatgcctgactaccttcagtagtgcttaacaggtaccaaatattgtatagtttcactttttcttttgaatagaaatattaatactttttagggctgttacggggattgaagtaatcaaagcttagcatagtgcttaataaatattagttattctgatgaagatgatgacaacaataatagcaactactagttaatgatcttttactacctgccaggcactgtacagcaaccttctgaagtagctcctattatctcttttatagataaggaaaccgaagcacagataggtaacttgctcaaggtctcataactagtaagtagtgaagcaagattcagcatcagatgatttgaccctagagactggccctttaaccacta

SEQ ID NO: 127193 - DNA, 2588 bp, Homo sapiens
actcttgggcgctaatatgacctgatagataacagtgaagagatttttacacctctggtctcagctttatttgtaaaatcagataaccatcttggtttgttatgaggtatttcactgagattaaatgagatctcagttatggtatttggtaaattagtgcttcttttgttgttgttgttgttgttttgagacagggtcttgctcttgctctgtcacccagcctggagtgcacagcttactgcaaccttgatctccttggcccaagcaatcttcccacctcagccttctgagtagctgtgactacaggtgcatgccaccacacctggctaatttttgtattttcttatagagatgggttctgctgttttgcccagcctggattcaaactcctggactcaagtgatcctcctgcctcaggctcccaaagtgctgggattacaggcctgagccaccagtcccgggctaaattagtgcatcttaatgtctgcttccaagacagctgagagatatgacatgcttctgtcactagcagtggcttactagtaatcactagcagtggctaactatggcagtgattctggggggtggggaacacatacgtagtttgaaagaaacccccaagtgctttgacatatttctcataaccattgagaagcactatttagaaatggcatacacttactactccactaagaagaaagggattccattgcagtggttataatgtgtgaacagtgtattttacatatttttaaattgtggtctaggtagaaccttgcatttctgaatagggcaatgactatctttctctaaccacttatttccaattgctggacactcataattcgtcacctttggtattaagattaaacatattttttatactatggcaatagatatggcagccatcatggcactcttatccatagtttaaccttgatacattttaattatcagtctctttctgcatcatgattaatactacttatactagtatataattagaaaggtactctgcaaaagttaagaatttgaagatggttaattagcagtacaaggaaggtatatttgaccctcccacatctataaaattgaggaaaagaacataaagtattcctgcagtgtttgatagtacattgtctaaatattgctggtggaactgtgctttggtaatcagttcatgtacaaaagtatcctattccttctatgtaacattgatgacctagtaattattctggttattatgtatttgaccaagtagctgaatttggaaatggttggctagtgagattatatcttagctgaattaaactgacttgatatgtaggttttatgaaagatacgttatccagtgttttcagttttaagaaattactgattagattatgtgacactatttatatattataaatatgttacatgtgtgcattaaaagttatttttaatataaacagttttcttaatatgagtcatcttctttgttttattcctagagattatgttttggtagttcttattttaatttttaacttttttctaggatgggaaactattgtgggaacaagagctatacaataactttgtatataatagtcctagaggatattttcatacctttgctggagatgtaagtcatatttttctttattgccatctttacttttttcattgcttgccttttctaatccaaattatttatagaaccttattgaaagatcaaattcaatttgctattttatttttttgctgaagatgaaatattcaaattagtatatgtgtctgctgtgataggtaacttctctaatagtaatcttttacttgaacttcttcatgcttttgtgttaagttattcagatcataaaataatgtcttatctgctagtaaaattaacctttcgttctttagaaatatacttcttttcctcattgtttttatgatataaagctaaattcatacattctgttgtttcccctttgtgatgaaaatatttcagacttgtcaagttgctcttaattttgccaatgaagaagaagcaaaaaaatttcgaaaagcagttacagaccttttgggccgtcgacaaaggaaatctggtaacccttttttaattacttaaatcaggccagcaaactaatgctcatggggcaagtgtggtccatttcctgttttttgtaaataaaagtttactgaaacttaactgtattcattggtttacatgttgtctttggctattttttgtcacaacacagttaaatagtgatgacagtgatatatggtcctcaaagccaaaattattatctgaaatatttactatttacaaaaaaatttggtggtccttaccttaaaataaataatatttttgttgagaactattttttttagatttaccgaagggcccaatacaataaccttttttgttgataaaatttcatatatattgacttttaattttgcatttgtgatagcattttttgtaaagttttaaaagtattttatactttgtaaacaaagactttaggtaagcttagaagcaaataagcagagttgctaacaagatctgtaaacattgccttgtctttctattttgttcc

SEQ ID NO: 127194 - DNA, 1057 bp, Homo sapiens
gaaaaaaattattcaccatttattcgttctctaacaatattttttctgtatgtatgtgtattcaagtttctgacctctatcattttctctaaagaactttaaacattttttgctaggcgtatcagtaacaaatttcttcaattttcagttgaaaaattatttctctttcgaaaatgtttgaaggataattttgctggatacagaatgttaggttgttgtatttttttctttcaacactttaaatatttcactcaactctttcactatactctctccttgtttgcatgatttctgaagagaagtccaatataattcttaacttttttcttccactggagagaaaattcctccaataggaatttttaggtttattgaaggcacacagaatgaattcttaattttttgagccttgtttcatgctcctaattattatttttttcctatttttgagaaagacctaagaaagtttgagaagcttttaactttatttgattaaacatacaccggattatcacaatctcatattaagggagctcaaagtaatgctcatagaatagtcgtaactattgaatttaactgtcagaaattcactgttagaaaatctggaaattagaaattggcttcatgtgtacacccacatacgtatctgtaggaagacttattttagtgctacattgtagattgatttttatgttgttgtatctctttattccataactttacatcaacctgttcatttccaaaaacaagaatcttccatggaatgctaggaacagtttggagtaatctaaaacattatgtaatacacagctgcgagactttgaaaaaagctctgatagcagtcaggtgacttacttaaaaaatactgtgtcttactcattaaaaatatagtgctgattattaaagacttagtccttcactgtccagtatggtacttggtagccattagccacatgagctattgagcaattgaaatgtaattaattcaaattgagatgttgagtaagtgtgaaatacacactggatttctaagacttagtgcaaaaaaaaatgtaaa

SEQ ID NO: 127195 - DNA, 1062 bp, Homo sapiens
actttatgcctaggtagtcttctataatttttgtaacttctggctcccagatcagtgaatacttattgattgattgaataattataattactcgtttattttttaggagctcattctgcgtttcttattgcttgattaggttgttaagcccttcagtttctaatgcacatggtatctggactttagtcttcatttattaagcgaccgaaatggtttagttgtgctgctgaactaatataggtggtaacagttgtctaacagtagtttgtttgtgttctaaatcagacctgttgggtagggattcttacataggcatacagggaaggatatgcttagagggatcattgtattgatgatggcctgagtaaggcactgttggtggaaagtttagaccgggaatgtatttcaccttgagtagtaaggaaagataaaagttaaaattcactggatttggaatatacaaagatgagaagatacctttgtctagtatagaggaaaaagatgagcacaaaaatgtatgtgacgcagcgtagctgtaagcacaagaagagattcagaaaagtccaacagggttgggttatgaattttacttctggttattcttagctctatatatataatacagggacatttcttaactagtctcagccttcatgtctagatttgtaaaatgggcttagtcaaggatttcaaagagtaattcaatcattatggaaaatacttagagtccatgacacaaagtattctgggagtttggaggagcatatgaaagaaagttgttatgaatactattcagtgctcagtttagatttcctgttactggcagggaggatttagagtaaaattttcagctctatattgtatttgttttgacttaggtaaattaacaattttaaagtcagttaattataggtgtgtaaattaaaagttaaggagcagcttgaatgtatctctttggggagtgtctgggcagcctgagcctccctggctgctaattgaagaggaagaaaggggtcctgatgaaaaagttaggagttcctgaattttagtccatgctctgct

SEQ ID NO: 127196 - DNA, 1150 bp, Homo sapiens
ctaggcctggtttctactctccttcccactgattttttttttccccccattggtgggagggggtgctgctctccccgcagccatgcgcagggaaacctcaatctctggtagctcttggcttttggggccgagaatgattcttagtttggtgctgtgcggccaattccaaccccagatggccggttgggagcgagcagttctgctgtgggaaggggaatgtgtgttgttgacggaagcattcattacattggctgctggcaattctgggggtggggaggttctgctctgtggtgtaggccttgtcgggatcatactgcggtgactgggttgaagtgtggtttgttgaaatactggctggatccctttctctccactttgctagcacctgcagagtatgtgccactggaacccagaaaacacggaaatttcaacaaagcaataccattttataactcctttaagtaatattaggtatgccaaaccagatttcacctgcttctttaagaagttaggattagacaatttctggaaagttattggattcattgttaacttcataggagtccaccctttgtatcttgtgccatccggttggagattgaatcgttccattcaatttcagatgtgtttcatatttcggaatttagaccttagagaacattgagtttcctgattagaaggatgaaacaagaggagtggctcaaaacgagaattttgggtaacaactttaagcccctccccattcacacacacttttttcaacaaatgagaaaactgatccagtgagcccaagtcatacagcaatttaataatgtaaccagaactagaaaaccaggactcctcacacctagtcctatcccattgtactttgcactacatcatgttgttttagaagggtatttttttttcctgttactgatttatttctaaaagtggtgttaaagaaataaccactttgcctttttcaccaaaaactaattaaaatacaagattcttaaagcaccactaatgtttgcatatgctcagtttaggaaaatcttcagcactttgaatgttagttacctccaatgaaaaaaattcagttgctggtttagtagattagctatgtaacctgtatcaaaaaggaagtagttgtgctgtgttctacata

SEQ ID NO: 127197 - DNA, 1080 bp, Homo sapiens
aaaatgctgacagacacacagagagtataagtattttcaggccaagagagttgtttgcacaattccagtagagaccatgtaagcccatgttccatgctgctgggaacaggttagggtgatggggggcaaatataagtttaaaaaaaaattgggaaccaaacataaaatctgtttaaatatgatttaaggagaatgaagaaacgacctatgattttaatgactagactttatgtcattggtgagtacccttcaatattggacagccaactctttaaaagactgatgagaaaatttcactggcgtgttaaatgtctaccaaagaaataaaagtatgctaagttaccaccacataaaatagcttttggtcactccctttcaataaaataattgtcataaaatgtgtttgtaatctaatcttactattttagcaagaacttcctccagaaagtacttagtcactgtgtacatgcgtgtgtgttcatgtaacagcaacagagtatatgtgtaaaagagagtttaattctgttgtttgaatatccttcagtttcccatctgtatagtaaataattttcctggtattttaaagtacgtctagtcttgatttaaaaagaaactccttaatttcagtatatttgttaaaataaggtgttagataagtgagttcaaactatgtctaacaaacatattagtcagaaatttagcacagactttgtatactgcataatagcaatatcataattgtttttcaaaactcttgagatattgataatctagaactttacatttttcaccagttgagaagttgcttaatacaactagaaaatgtgacataagcctcacactgacctcacttaatgaccagccaaaggaaaacagaagtttagaggcttcacagctgctgacacagagtccttggaaagaattattttggaatattcttactgttgctaaagaaaggaatgagaaggtcagaaataggaaaccaggaagaaaacaagcttgtcagcattcaaaactgattaccagggaattactttctggttaaaaatccacagtgttgcagtaactttatttagcaat

SEQ ID NO: 127198 - DNA, 2009 bp, Homo sapiens
tctatgatcaacctttgatgaagagagtggcagggataaaatagttatgaatcataattcctgcagtcaaaagatttttaaaatatttttaaatataggaaagggagatagttttgatcacaagcacatttgacattgtcatgctacaagcattttagttgaaattagaccaaaagtgatgaattgttggcagtaaacattttctgtaacaaactccaattatccaatttaattcatggattaatttttttatttattgttaactagtttcagattttacaagcttttgttttaccaattttttgtgagctttgttttctgcataaacatttgattaataaaccagatcttcctcatttcaaattgtactgcttatacctgctgccactgaattttccttctgtgactatatttgtacttatgttgaaacttgcagatctaagtcatattaagacaattttgatttttctaacaattttttatcgtaggaaattttaccagctgcagatttagcagctggtttaatttttatatactatttttaatcaggctttactctccctggtcaatctttgcatcttataatagttacataatgataggaatttgtgttgatctctaaccaagtttaacttgaatacctttatttgttgtcagttttaatttgtgttaactgtttggattcttttggatagatttctagaagtaagtctttatatccaaaagcatgggcctggtagacccattgtaaccactattttagatttttaaaatatataccaaccattttgaaacccaagatgtactcactgttacctgcttgtggcaaaaaattcaaattagtcacaattgctccaaaacaataacatgaatctagtatgtattttgaagagagaataatgttaaatttggaagggacgtttacttacttttcaagccaaaataaatgttaatttttctagctcagtggtaagcttaggtacctatttcagagttatttattttgttttaatggttaaatcgctttttttgtttttgtttttgtagatgcatatccgtggttggaatgcttcatcaagtcatacaatgtcacaaatggaacagataatcaaatttgctatcagatttttgacaccacagttgcagaagatgtaatctaatattgccatccaatttagcatacataaaatgttgccactcaccttccctgtttgagcttcttttcctgacctgagttttgtatcagcaatgttgatgatgttagcatgggtatgggattagaaaatgtccttaccttaaatctcttggcttttactgggtgcaaggtaaataatggctatggattttgttttgctttctgttttgcttttgtacaaagagacctgcttaaacaagtactgctgagataagtgtctgatcaagctacagtgtactttaagtagaaatggcaaagttgctttgttggggtgctgatactgatgattttaggataaattcatttctttaaacttgtaatacatggttttattgcttgtttctctccaggatagtagagatttctctatttcacctcaacctaataaaagtggtcagatttataatgttaatgacttaatattatccttttctaatagtctcatgtaaaatatgccgctattacaacttacaactaattgaatgagatgttaacttagtaaaatagtttgatttttacctgacagtgtttgtcaaatttaaaatcatgaatattcaattttatacaaacatttatatatatatatatagatttgtgtatgttatttgccaaagacagatataaattacctggtttaatattagtgaagaataaataagtgcacacatttcaactgtttcatttatttgccctaagttgagctgaaaaatgatatgaggcaaagaatcgaaataggtgtggcaatgcagcagatgtttagggctgtctacatcccaggtactgtgctaagcactaaacatgtatttgatcctca

SEQ ID NO: 127199 - DNA, 1979 bp, Homo sapiens
taagttacttatttcttcccccaaattatccagcgtttatttagtacacatttgttgagtacctactgtgcctggcactatgctagtgggccttgggtatacatcagggaataaagacataacccttcctttcatggagtgacacttaatagagcttaaattaattagattttatagtatatatttggttcaggaggatgcatgtcataaatatgattcttgttattctgattgaatataaaaattctttacagtacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgtgagtattttccataataaaacaaacgttttcatattatttgtgtgtatatgtacacatatgtataattttgtgtcttaggaataagtaaattgttaatatatatattatattttgcaagaatggtaaattttttaggtaaagtgctaaattcttagagaataaattattctgatagtaataaaagtgggtgctattttcagatctaaaattcagcttagtcactctgataaaggcaaatgagaaataataaatgatgaatatatttgggcagactcatttgtcacagaagtatcttctgaaatataaacctttattaactgaaatttttgaaaggagttgtaattacttgaaatatctaattaagtgataaagagagccttgttggtaaacttctgtcctgcttaataactagaatataataaatataatttaaattttctttagtaattgagaatttctcagtgcctttactctgaacatcagtgattatataaatatgtaataaatgtatataactgttttgtaatccttttactacataatcggctcaagacatattctgaaaatcatttttaaaagctcctcatctttttgcaatttgcctacttttcctctgaatatctaaaatgatgttttggaaaatgtagataattgatggttatatgcatttggatgccctaaattgagtcttcactaaaatgtgctacaatgtgtaaatatctatgtacatcgccatgtatttgtgtgcttataaattgtgagtatctgtgttcattaatatacatatattttccaatccaaaatttgggtttgtttgaagaaattttttattttaaaatctctttaaataaaatgtgagggaactgtttttacccatttgagcttgaaatggtggttgggattaaaatgtatatataaggattttagataattcttcaaatattatcaaactttggtttattgaattttgtaaaatcatacagctttgtaaaataaaaccactctccgcgatcattttttaaacaaataaggatattatctcagaaattaacggaaactgtctaaagttacacagttaactggcaacagaaccagaagaaagccatacaccttttgattccaaatgatgccatttctgctacatggtacctaaccatatgacttcttaaaattattaattattaaacagaattggaaatattattagtttagaagtgcccttctccctaagtgtggtaagtggatatttaactggagtgaagacggggccactgcatttttttctcctactgggaaatttagcattctttacagaggagaaaaaaattgatgctagaaataattatgagtaactttgtatcacaaaaccaggcatagaaatcactggtagttaatgtaaatatgatttggatatacttacccacaaaatatcaaataattatctattgaaaaaaagttatttgttctgcaaagtgaattatctccataatttacataatttaagaaaaagtaactgactcatctacatgtaagaatgatactttttaatttgataacttgttaaa

SEQ ID NO: 127200 - DNA, 1048 bp, Homo sapiens
cctccttctgctacatcagctaagattaaaaaaaaattttcagaaaaatatttttaaccacaaatttattaaatgtgctattgtaaaaattttaatttctcaaattggagaaggaagataacaaatgtgaatggaagaaggattgatgaaatcttttaatgttgtgttgtaattggaggtaccattatgtactcatgttttctaggtaaatacagaagtcgatgtagctgtgtgtatgtatgatacgcatatattcacacgtgtacacatttgtttatattataggggtgtgtgtgtgtgtgtgtgtgtcagtatgaatgtgtgttcatatgtaccctatctctctctccatgaaaaagcatagaggcagcagcactccagttgccataagcacacctggtgctcagatcttggtttataaataatatttctctctaaaggaatcagagctccttggtgaaacagcagatttctgaactagaacaagggaattacaagattagtatggagtaaccttgtactagaaagtaagggggttctcagttaatgatgaaactcgtcaaatggcttaggatagaacatgtctaggaacatttgagcatcaaaacaaataatactaattgagtaaagcaggaatgcatgagcccatgttgatgatgataaaggaaaaataaaatatatggggttaagtggaaatatctttcttaaagtaaaataacaaatataaaagggataatgaaattagaaaaaaaaaagctaccattttgtaaccatgatagtcattgttgagttagttgtgaatctgtggattctaaactatcaggatatttgatgaaaaataagatatttacattttctctagtatattcttgttaaatacaagggggaaacagtaagtttttagtagagaagtgattggacactacctttaccagctgaataaagtttaggtctacagtaatagaaacactcactttgtatgccccttgatgtgatgcactgagaagcatacagtatcacttacgcattattcctgccaaaaatgcat

SEQ ID NO: 127201 - DNA, 1048 bp, Homo sapiens
gttattagatctacatgttaaatatagtatgactgatgcatttttaaaattttagtagtaataagatgtagacttgttttctattatttcatagtttgtagtcctatacatgaatatttctgtttccctgtcaaggtcaccttccctctcatttatttacttttttgtcccgttgatgttgggttctcttcttatgtctttcactgcctacttcatagtcataccatggacagttttgaagcattttgcattactgtgttttgcttttaaatcagcaagataaaaaaataacttaagacccatcaaatctctgtatatacctatcccagtttagagagtaacttctggagaagctggatgtttgatgtttttcttgcctggacatcctatggaggatacatttgaacaaatgcctcttcaggcctgctcctatggttatttctctctatactatctttggaataatagggcaagaaatggaatgcagtggcacttggacaagtcatggagtttagcattattatgatttacaccttgcccatattaaaaaacagagaagttagaaatcattgaataaaatacaaagttctagcagttgaaaatagcacactcatatacacatggaatattatgagaaagtcgtaaatacatgccctgcagaaagttaaataagtcaaatatgataaagctgaagctaaagcaatataaaatcaaacaaacttagagcgaatctaggtcaaccagtcatactctggcaaaagtgacattcttaacaaatgagcatttgctaacaactgaacacttcctatgacaaggactctactactatgcactgaggcatattctatcttttgactgtgtttttagaaaattcttaaattctaagataaaatgtgccaacttttagctgaaatagttgagtctacattttctctctgcagaaacacagcacatacctgcatcccattgtaacagataacttttttggacaagtgaaaaccactgtcacgtaactgttagtttaaaatacaatattgaaaagtcaaaa

SEQ ID NO: 127202 - DNA, 1050 bp, Homo sapiens
atttactgtatcatcctgatttttatgacagttttcataaattctttatgcagtatggatgcaactcttcatatctgctgtaaatatcttagcctttgttttcattctaaatttagttatgtttattttataaattgcatttttcttatttgactacatttatgtttcatgatttgtaaaccttgaagcaatagaaaaggttattttctctccagacaatttacactgaatgagatttttatttttgttttactaaactttctaaaattagtatttatagaacacttctgcaaaataattttgcagtgtgtattgaaagccaagaaaatgtctctgttttaatcctcttagaagacttaattaaaaggaagaataaggtttggtgttttgaagtaagcatattcttattttatcaaatgctttaaaatattgaaagtcaggtaaaatatttttgtgttttccagattattgctcagttgtaactattgtggaccagacaaatgtaaaactaacttgcctgctctttagtggaaactatgaagcccttccaataatttataaaaatggagatattgttcgctttcacaggctgaaggtataattcatattgtctagaacttatatttatttgaagagaactctgtattgttcactgaaactagttagcactaattatatagttgctttgttagaacatgacagcaagcttttcaggagataagaagtaatgtaaatattatcagacttcaaataatttacagtaagaaacatcttcatttgaacaaaccactgctttcattccccagaaatgtattacatgccatgattaaaactggttccattctgtcttctgtttctaaatacagactaatgctatagaagttttatctgtagattttgataaagaacatttattttttaatgttttaaaaaagagctttaggtcaacaagaaaaaatgtatacaaagattaggagattatattattctttcccatttcttgtgttaattcaagttcaatgaaaacattgagatactaagtataaaatc

SEQ ID NO: 127203 - DNA, 1003 bp, Homo sapiens
caccagaataacgtttatgaactcatgcaatgtctaacatctatctaatctgtgtcactgtatatatcataatatttattatatcataacatatattctttcttctttcatcttccatgctgtcatgctcttgcaatagaatgaaagcacaagtggaaattatgtaagctcacaccagaaaaataaagagtgctcttatttttgtattgtacagtaagtttccttgtaaaagaagtaagatgacagcacataatgtagcttgattcagtgatttgccttcataggtattacttgaatgttttaatgatatacttttctaccaatggaatagtgttgctcaaatactgattggtttaaaaacagcagtgttttagtagataaaaaggagatgaagcaactttcatggaagaactttttctggattgtgtaatttatgcatgcatgcttctttgattaaaaaccttgctaagatgaactaccagctctcccttataataaaactccaaggcaatttacacttaatcatactgagtcaattcgttgaattgctcaagattgcaaaatagaaaacttaatttatcatttgttatcttttccagatttatatcaagctatgtgaattattaccaaagtgttaaactagttaagtactttgtcagcagtttaaatatgaagtattactaaagcattaaagacaacactttatcaatggtttaaagatatacattataagtactgtgtactatttatttaaagtacgaatgctgatttattaaaggattttctactctttccactttccctgttaatgttagctaacaagaagatagacttctaaattacctttagctttgtaccttcgtttgggaaagagcaaaaaataaggcatggggaaaatatttttatttgtgaagtcattactgaaggatatttttgcgtgtgtatttggtaaaacacttcacttccttggagcagttaaataagacatattttagcagtttgc

SEQ ID NO: 127204 - DNA, 1416 bp, Homo sapiens
ctaatagacccattctaaagtcagaagattgtaagttgaaccatcataagtcagggactatatgtatatgctgtttgctatgtttttattgaagaagtataatgttttaattagattataggttatgcctttatgagctagtgtgcaaattgtaccatttataaacaaagttctaaggaaaactagttggataagctaagctgtgtgcattgccttatttcaggttataacttcttttagacacttaaaaggataaaatagttacatggatttgctgctaatatgattataacatgattctacaatgtaaatactttgtataaatgtattcactgtcttctctttctttaggttccagcaacaaattatatatatacacccctgaatcaacttaagggtggtacaattgtcaatgtctatggtgttgtgaagttctttaagcccccatatctaagcaaaggaactggtaggtattaaaactggtggagttttttggagtggaaatgcattattgatttaggaacacggttccatctgtaccctaagtcctagaatagaagctcagttctgacctataattgccaaacaacactgatgcatattctttggctagtttaatttgtaaaataaacgtgatctttagattctagagtctagttaaagacagtaaggacaaagaatgaagcaaaggatgccaaacagcaacgtgaaaccatatgaaaatataaaattcactggaaaaggtaaatatataaacaaatgcagaatactgcaattctgtaacattgatgcataaatcacgtttaattctgttatagaagttgaaaggcaaatatataaaagctataactatagaaatatgttaatggatacatagtataaaaagatgcaaattatgacgtcagtaacatgaagtgtggtggggggtagaagtaaaagtgtagagtttttgtatgcaattaaagttaaattgtcaggttaaagtagattgctataaatataaggtactttatgtaaaccccatggtaaccacaaagaaaatacctataaaagatacacaaaagaaaatgagaagggaatcaaagcatgtcattacaaaataatgaaacacaaaggaagatagcaagagaagaaaatagggaattgagtgtcacaagacagatagaaaacagtgaattaaatggcaatcgtaagaccttcctaatgaataactactattattataaatgaattaaattacctaataaaaaatcatagagtagctgagtgcattaaaaaaaacgagatacaactatatgctgtctacaaaaactcaccttagatttaaggacacacataggctaaatgaaagtgaaggaatggagaaagatacttcttgccaatggtaaccaaaagaggagaagtggccatacttac

SEQ ID NO: 127205 - DNA, 1087 bp, Homo sapiens
ccattgaactatgaagagttgtggtaatttggcattatcagcatacactcagttatgtttgcaatctcatgtgaagaaaaaaacgcaggaattgcagagctacaatacctggttagggcaagagatttttagaaaaggcaaaataaggtctttcgtttgattcatagacagtttgttttgggagggcctgctttgtgccaagtcctgtaaatacagagcagaattagaaatgaccactatcttcagtatgctctcagtccaattattaaatctgaatagaggattgtgagaattgacaccaggcccttgtatgtgcagagcacactgtggtaatgcagaagacttccacttgatagagttttaaattattgaaggaagatgaccaaaagcccagacattttggtgtatcttaaggtttcgttgttaaaattaagggagtaagacaatgaaaaatatatatgcagcaatgcaaaactcttttagtatttctgttttagtatttggaaaataagaaaaggaaatttaaagaatgagagaggaagggataaatggagaatggcttcttactactgttacaaacctaagtagaaagaaaatatctttgttcttattagtatataaatggaaatttcttattatgtccatgccctgtatttgtatgcacatatattagttttgtaatatgtggagtttttgcactgtcatgcctttctcaatgtagtttctcaactttgagatttagtttcatttaaattccatccttattactattggaacatctgagtttcactacataaaactttcttagtgatttagcattttcctggtccatgaagtgggacgttattgtcatctgtggctatattgtagctgtagatgttgaagatgttttagaggaagtggtagtctaaataatgtattcagcaagtgttaaacaagtttaggttaaccagttttctactttatagaggtaatttttattctaaacataataatataaataaggatttatatgacattccaaattatacgtattttggtgattgattcaaaaacttttttttttctatgtaggacaccattgcag

SEQ ID NO: 127206 - DNA, 1127 bp, Homo sapiens
cctctacccaacatgggagaactcacattctgataagtccataccatatatttctttattgtgccaagtcacaatctcctttatttgagcgtattaattctcatttgacctctttggatccttcagatgaagactattttcattccatagactacctaaaaaatatttaaagatagatgccatgtccttctttagttttcttttctgtagacgaaaaacatcatttaaaaaaatgttcccttcttctggtataagaaattgaatatccagtttgtctgtttctttaaggttcaacaccaaaatccatctgcagcatggaattaagttatctttggcaaggagagcaggcctataatctcacctctctgagaaaattttatttctattattacagaaatttcttgtttctattattgtacctaaaggtggtatagcttatgggtagtcataccatatggttggttcatattgaatttattgccaaccaaagtttctatgtttctgtctaggtagctgccaactattttttttttttagcattctgcacttgagaattattatttttgatcttatgattatctctgttaaattttgatttgttcaacttgacccatatctgtacactaccatatctattttggtttatacaacctatttattatcccactcagtgtttttgtcttaacatttttaggaccttgttttctatctaagccattgataatatttgagaacagaaagaggtccagaacagaatcctgtggctcaattctttttccaggttgaggttcttctcttattcactagccttttgggtacaaatgttcaacgagttactagttgcgctaacatccagtctacatttttccatcttttctgtttgggtatgttgttttctgttttctgtcagatgttttgctgtaatgcaatgcatattattgactgcattttataaccaaacagactaataaccccctcaaagaaagttatgaggttgatgtacataatatgatatattaagcagtttagtgggataaaataggtaccacaaataatttccaaagtcagtcattcacaggtagtaaagtcaactgtatttatttaaataagaataaggtctggatgga

SEQ ID NO: 127207 - DNA, 1113 bp, Homo sapiens
tagaaatagtgagttgagtctcaaagtacagcacagatgctgacatgtttttccagtgctgggtaagtttgtagctgagcttcggtaccaggatttgaaagatctgaataaaaaaatatatcccttcagtggaaagagagaagtctctgatctgtcacaacctactaaatttatgttttaaatatcttcacattttatgttataaaagttctgctggcttgtgctttataacacacagttgaatggtactattatggatactagcttccttccaggaggtagaatgaatacaacataatccattctgccataacgtgagctattagaagtgatgcttctggctattaggggtaaatcatatctgtggaatgaattaagagttagactattcgcagtgtattggatttgcctgtttcacaactgcattcattaagttcaaatttgatgagagctgttcatattaaatttgataaccccaattctagcaagttacacatattataaagctcctttgaaaattctgtgacattcatgttatttttgtcctttaataactaagccatttttaaattaggtgcccatatgtagccatgtgttagtgaaagtgcttcataattgatgacttttattgaattagttcagaattcagtgctcttgtctgattttatcttaatgctttggtattgaagaatctaagattactgaataatttcagtctttcaattgaatttgatgaacttctgtgggactcctacaatatccagagcattgtgcaagatgtagttggtttgaagaggaaaaataattctcaatttttagaaattactatctaatgaaataataatagttaagatctatttgccagaaatcaacaacctccttggagcaaaccaaatggagaaaatgacctatcttatcatatttaaatttttcttaggaataagaaaaacgattgtaggcgaatgtaaatataatctctctgcccaattgcatgtaacagtttcatgcccggtttatgaaaaaaattactcattaattctttttttttttttttttttttttttttttttgagacggagtctcgctctgtcgcccaggctggagtgcagtggc

SEQ ID NO: 127208 - DNA, 1017 bp, Homo sapiens
aatttgttgtctatatataattataattaaaaatatttttctctgtatctctggttattgcttctttctcatttctggtctttttagttacttttttcctttcttttattagacttgccagtctttttaaggaaccagcacttgagtatttcatcagttctattttttctatttgttataatattaatataacttttcatctttaattccttccttatttttaatgtttattttgttgctttatgaatgttttgtactaattgatggcttagttcatttattttcattttttaatttaataataggacacgtaagactataactttgcctttgggcacagctttgactgcatctcaaaagttttggtatgtagtctcttaattgttgctatttaaaaataatggattatattactgtttttattttatttttgatgtattatttaggatagtattgtgaggtttttgttatttgttaatcctactttctttttaataaagaataaacttattaatatttatgttgctactttaataaagagctgattttgtttggaaaaagtgaaattatatgtgaagtggtctcatctgaagttgtatacaagcaccatggagagttccttgtcacacgattctaccaatagcatcagctagtggcagctatactaattattgacagcagggacttggtatatcactaatgccaataatttacaggaattctgattttataaagtcctatttttccatatgaaagttaagaaagaactttaaaaatgtttattggaccagaaatcctaaagtatgataaaacttaaaaggtcatctgctaactagagcaactcatcaaagtttatgaaatcaggaaggatttgaatattgtgaaaatggactgtgtctcaaaatgttggcattagaacaatttttcttttagacttggcaaaagtattttgaaaaatatttgttttttataattacagatgtaatttatgtacagaaataaaataaaaataccctg

SEQ ID NO: 127209 - DNA, 1021 bp, Homo sapiens
tatttagttgttgtatcatcatttattgaaaactcacttttctactgttttaaaaattccacatttatcaaatactaaattcctacacacacttggagcggtttctgaatttgttgtttgtttaatttttttatatcctctattccttaaccatgctgttaattattgccattttatcatttgctttactgtgtgttaagtttcaatgggggtaaatgttactcttcttttttaaatatttttggctatattttttcatgtattctcgcagataagcttcagttatgttttggtcacattccaaaagaaattctattgccattttgtttggaattgctttaacaatatagactaatttggggagaattaccaactttgtaatattaaatttcttattcaggaacttgtcatgtgttaaggttactgaagacaatctccaaatgttctttagtaattttgtatgttttgcatatttttattaattgtattgttagatatttcatttctttgttgcatttgaatgggatcatttttccatcattttttattagtggctactccttctggggtcaagctatttatttttgtgtttgataacttttttgaactctttcattaatactccctagttgattctcttctaagtagccaatcattcttaagtataattaatggtgatttttctctcttcctttataatatttatacctcatgtgttaaataaatgatggtaataactttgcccttattcctgatttgttaggtatgccattaaattttaccagcttttaaatgttagctcttagactgaaatacaggtctttatcatgttaaagatgtggtttgatggttcaaatatactaagcattttattagaagttgttcaattatattaagcatactctaggcaactagaaatgatcatgtgattttacttctctggcctattatcacaataaattatgttagtagtttctcaatactggattatttctgcatgagatgtatcctgttaaataat

SEQ ID NO: 127210 - DNA, 1067 bp, Homo sapiens
gaactagcacatcatcagacattccatgctctgatcaccatcttcctatcctagattccttgctcactgacagctaattcgttgcttcattttttccccactgtttatcagcccctgtcttgcgttctcgtccttgcttagtctagattctgtgatccattatcatgatcattctccttgaaatgcattgctttcagcactcttgaacagcaatttcttaattttcctggcaaaatctcaactctggagaaatcttaccatctgccttccatgggccttactgggacaactgaacattttctttgagaaaagtacacagttcagccaattcatttttacttccaatccattaactcaaacctcaagttggtgctgttgttcctactgtagtctcagttctccacatctgagactactcttcataccttttcatctcctcaaaatgttctgatcttttcctccctgtttacttcacatttgcctgagaaaacagaatttactacatacagactttctcatcttgtcaccacaagatcctccaacccagttaccttggtaaccttcctttttgtgataatagagggagcttcacagattagctcctcctgtcatgccccgaatcccagcccccttgccttttcaaggacttcttccttaggttttcccctttctctcttttgcatcatcaatcctgcctcctctcaatggattattccctgcacacatgctccagtgtctttcatcttaaccacaccttccctcgtgcacgtcttctccatctgtgaaccatctctcagctctcctttagaactaaactttttaatggagttgtctattctttcctaccgggatattgtgacaccagtcccacctggtctctctgctaccactcttaaccactccaatacgtttttgatagagtggtagcaacaacctttctcacaaattgaattaagcaaattgttgcttttaggataaaatctaaacccctttaccatggctcacatagccttgcacagtctgacccttacttatccttccacccccgtctatgctcctctctttat

SEQ ID NO: 127211 - DNA, 1073 bp, Homo sapiens
ttatggcatgcttgttatatgccaagcactctgctaaatcttttcatgcataatgtccctaatcctaccaacaactctatgaagtaaaacctattctttcattatccctgttttatggaacagaaaatagaaacttagagaagttcagtgatttacttaggttcacatagctggtaagaaacttacactagtcatctaattggcgtgtaaatgcatatgtacccatagatacaaatgttatgttatgctctttttttgagttgcaagcacagaattttacttggtagcttctaaggagagttttattagaagactttatttggggaaatatgggagatataagtgatcaggccttataggattccaagagtaattgtacaactcagcttcaccattcagatttcaactaggtaggtgttacaaaatgagaaaaaaaaatcagtgcaactctagtgtctggatgttgccctctgagcagcagaagtattgcttctctgctgctattagcccttttcagactctgctttattttgttttaaacaaattacctcactctgtatcttctcaatatggtcttaactgcctcgttccaccctctgctctgtgtccttccgctactttccccttctgtacagcttgagttcaatcttctgtaagaggaaatctaattagtccagttagattcattgcctgttgggctaatctctcatgtcagtccccttcataggttgctggccagtctgtagattggctgctcttgggacagttgctctctcttggtcctgtcatttgtgatcatagtggcagagtcagtggcataaaacatggccctgggccccatagaaggaatcttttggtgggaatctcttaaaagaccatagtcctaaaatgtgatgagctttccagtatacatgtttttctttcttttgaaaggtgacagaatgaaaggcaagttgtgatcttgactgttaggtcaatgcagcatcagcaatcctttccctactgagaaaatgtggaaaatagtgttttgatcagtatctgcatttccttttctaaactgcctgatgacattt

SEQ ID NO: 127212 - DNA, 1260 bp, Homo sapiens
ttatacaaagcactttaatgatagatgcaaccttatttttcagttcctatttttttaaagaccacacatttactaatgttaatatgaaggtaataaatagcttactgatattttatggatgcagacaatccatgcacaaccacttcttatgatactagtttatttccttaaatattgctacaaaaggaagatgcgggtgtaagccctgatttttttttctcccaagaaaaatcttaaaggaccactttagataatatttgattcctactgtaaaatttagaaaatgatgaattcttgtccatttttgtaatcaagattttaggaaaaacagaagtacatctatctttatgaaattttgggcaggtttttgtgtatcaatattttgtacttttagggaatattttattttttagttatttgtgtcaaattataattataaaaggtacagcagaaaatataccatgtttttatataggttcacacctgtacttaggagggaccctgtccatctatatactttttgtataaaattttaaaatgttaaagatccacaaggtcttaataaaatgattctatagctagaaaaacatttaccttcccagtgctttgcactaaaatatactgtgaaaggaaactagaaagactgtaactattgctggaaatgttctatattgaatgtacatgctcttgttggaaaaatgtactatatgtgatggaaataaaccagaatcgaagttatttcagctaaatgtgcttcagcaaaggtgcattggttgaaacttaaatgttttattatcaaatttaaacttattcagtgactatgagcagctacacttgaattatattctgatagttttatttctaagaaatagagtaataatttctctttaatttaaaaacagatttactttcccacatattgaaaatttgtacttatagatctaactttaataactaatagtataatatatttagggaactaaatgtgtaggtggtatttcatttataagccatcttcattagttgcacattattaaacctatatgtttgacttttgcaaggtgttatcttttatgcattcctacacacaagacatattccaaagatattttccagataaatgctgataacccctgaaaagatatgaggattcctaaaaagctaggggttgctctttgcagcatcctctcatttgtatgccagcctttccctctctgcttgcttgttaaatactatagagaagaaagaaaaattgatatt

SEQ ID NO: 127213 - DNA, 1027 bp, Homo sapiens
gcagtaagaatgttctagttccattaagtaggagttgtccagtatgttgtaaatcatttgctacaaaagcgaatgtaaggaggcattttgatgaagttcatagaggactaaggagggattcaattactcctgatatagcaacaaagcctgggcaacctttgttcctggattctatttctcctaaaaaatcttttaagactcgaaaacaaaagtcttcttcaaaggctgaatacaatttaactgcatgcaaatgcctcctttgcaagaggaaatatagttcacaaataatgcttaaaagacatatgcaaattgtccacaagataactctttctggaacaaactctaaaagagaaaaaggccctaataatactgccaacagttcagaaataaaagttaaagttgaaccagcagattctgtagaatcttcacccccttccattacccattctccacagaatgaattaaagggaacaaatcattcaaatgaaaaaaagaacacaccggcagcacagaaaaataaagttaaacaagactctgaaagccctaaatcaactagtccgtcggctgcaggtggccagcaaaaaaccagaaaaccaaaactttcagctggctttgactttaagcaactttactgtaaactttgtaaacgtcagtttacttccaaacagaacttgactaaacacatcgagttgcacacagatggaaataacatttatgttaaattctacaagtgtcctctttgcacttatgaaactcgtcggaaacgtgatgtgatacgacatataactgtggttcataaaaagtcatctcgttatcttgggaaaataacagccagtttagagatcagagctataaaaaagcctattgattttgttctaaataaagtggcaaaaagaggcccttcgagggatgaagcaaaacatagtgattcaaaacatgatggcacttctaactctcctagtaaaaagtatgaagtagctgacgtcggtattgaagtaaaagtcacaaaaaacttttctcttcacag

SEQ ID NO: 127214 - DNA, 1020 bp, Homo sapiens
tgtggaggaactttatgttgctgtctggatgaccatgtctgttgtctcaggtgacaggaagttttagctattgacagaggcacttagagttggctgtgtccaattgtaagtgagcagagcaatcagaaaatggtagctgactttgaagaaagccattctgtctccatgggaaaaaataaaaaaatcttaagtggtgtctgaaactaagggaaaaacttttattatctctgtttgtggactgagacacaccttatttttctcatttgttaactatgtaagtggaattaaaaaagttttaaagtctcatttttgactcctcagttaacttcacatagatttaaaaaatctaatttttagagaaggtttttttaatacatagagctctgtagtatttcatttagcaaatatcagtcatgcattatcctgagagctggggtagcggtgagcatcaagaatatcttctctgttctaatcttccagtttaatggcgatatggaaaagaaattaattacaaaacagtggataagctagtatagatatctagggtgctatgagagtgtaggtgaaggatttttaacaaacaacaacaaaaaacaagaggttgattattgaaggcttcttggaggaagtgacatctatactgggatctgaaggattattagaagtgagtcagatcaggaaagtgggagaatgttatagtcagagaggaaaaaacataggtgaaggcctgaaaagtgagggaaagaatacatttggtgtatctgtggacctgaaagaaatctggactgcttggatcaacgatacacacacttgcgctctctctccctctctctctctctctctctctgtgtgtgtgtggggggggtgggggggtgggggggtggcaagggtaaggggaagcatttgtgattgataattaagattgattagttaaggttagaggcaaatacttttttttggatgtttattgagaataaatatgcagtccctactgaatataacttaactgtataattagga

SEQ ID NO: 127215 - DNA, 1141 bp, Homo sapiens
tggttttaaatagtaaagtacaaaagggtatagaggaaaaaataagtttctatactattctgtccttcagttcccctttgctcaggcaacgctgctacatggtttatgtgtcttcttccagagaccttttatacatatacaaacatatatccctcattttcttcttacacaaatggtagctgactctacgtactcttgtgtacctttgctttattaactgtagattcaactatttattgttgacatcagtccatagatagatgcctcattttttaagaagcctgcaggttttgcagctgcaggttttccacttggaaattcctgatgattggctgacttgagacctgctgtttgctctgaacccctggtttcttctactaccttgactgtgccttaccctttgtgtagtttggctttggctgtgtcattctgataggatcatgtttctaatatggtgtcttcaaatttccctcctctctataacactttcagtttatcttccttcctctttgacctctctccccaaaccaaaacaaaattttaaatagcagataaaaagtgtactacctttacatatttattaaatatcttttatgtgtttattaaattggtttagttgagttcaatattctttcagaatttcttagttgtgtgctagaggcaaaggaactatggaatgcccctatggttagaaagagaaaaatgaggggaaaagagaaggataattttgtctggtattcaagactggtctttaatatgaagctgacatcttctttttaagttcttgaaatatataatattgtaagaagagaaatatataatttgtagaaaaaagattctacatgtagaatatgctagagcagtacatgcagggaactctttttttgactcttagggaggaataaattgtaactttaattgtatggtaatgaaaaatgagaattagcttcatgtgatgtttgctgtcattatctttctaaatttgggtttggtcatttaacttaggcttttttttttctccttaaaacaactttaattgcaattagtttaagctctgactgaatggtgatgcttcagtcctgattctgaaggcaaagcgtagggtggacgtgatttttctgaggtacataggagagtgcca

SEQ ID NO: 127216 - DNA, 1111 bp, Homo sapiens
gaccagagcagggagggagccaatctggagtacctcaaaaacatcatctaccgcttcctgaccttacctgactccctgggccgccagcagactctcacagccatactgactatcttgcacttcagtccagaggagaaacaagtgataatgcgactcccaaccagtgccagctggtggccttctggcaagagatgatgccattttcatgaattcctggaatttctgtgcctcttttatgtgggaaagggcaggctctggtttctgctgcctcttctcttacattgtcatttatttcttcactgtgttgagctgggaggagtcttcaatgtgggaagggattttctgccaaatgccattaatgctgctttatccttaggccctagagatactgaaagtcctggggcagtatcttctgatggtgtgcatgtgaggagaagatgaggttaggactgagaagtgcagaagttggaacagtggtaaggctgttttaaaataagatgttttgttttaataatatgctcctggcacaaagctaggagtaaatgtgactccaaagggagttcagttaatctctgaaatgcacaaaacctagctattttctccctctcatcacagtctgagtctggtccattgctaccccaattctctggggacataaaaccaggctggaaagggaccaggaagtttgaaatagtgacatatcatccactagtcccaagggctaaggaatagtgagtttattctggaaggaactgggaagcttagtctaattagtgcctggggatgacctatgcaatcacaccgcttatgaccatcctagagagggccctgagcaccagcttgatcttagggatttccaaagtaacctgctttttgcctggatagggttaaaatagacctttcttgcctatccttgccttaacctatctgcctgaggttggcctgagattgtgagtcaacgactttgctatcttttcctcagtgttgaactttcattaagaaataaagtcctagcttcttacagagaggggtccaaatggtgaatgctcatcctgcctggattcaaggaattagctcagagattggcccctagcttttctgcctttgtagg

SEQ ID NO: 127217 - DNA, 1048 bp, Homo sapiens
caggaatattggataaggaaaagaatgctgtatgatttcttaataggatttgaggaagcacctgagaaacaacagtaacacacattatatgtggttaggtggaaagcagaacaatagcagatgtaccaaggtgcttcatattgttcagtataatatgtgtcttgcagaatccaagcaggtaataggaacttttgttagctcctgaatcaaccgaaaaatccctagttagcattcttgccaggccatcccaaacctgtgacccttttgctcccctctcctgctttctcagagtttgctgtggggcttttgtggatgcatttttgtctgttcccttgttttgcagacagctcttgcagaggatcaactccgtcagcaatctcaggtagaagaacagagggtggcagccctggagaatcaaatatccgaggtgtctgagctgctaggcacctacgagaaagccaagcagaaggaccagctggccattcagaagctgaaggagcgcattctgcagctggacctggagaacaagacactggctctagcagcctccagcaggtcccctttagacagccatggagaggagtccagtctggatgtcaatgtcctgaaagataagatggagaagctgaagaggctgctgcaggttgcggccaggaaaagccaggtgaccctggatgtggagaagctctgtgacctggagataatgcccagctcggaggctgctgatggggagaaggctactgcactctattaccaacaggagctgaaacagctgaaggaagagtttgagaggtacaagatgagagcccaggttgtcctcaaaagcaagaataccaaagatggtaacctgggaaaggagctggaggcagcccaggaacagcttgcagagctgaaggagaagtatatttccctgcggctctcctgcgaggagctggagcaccaacaccagcaggaggctgatgactggaagcaggagctggcccggctgcagcagctccaccggcaggagctggagcggtgccagctggacttcagggaccgcacactg

SEQ ID NO: 127218 - DNA, 2040 bp, Homo sapiens
cagtgctactggttcccaagggctaaaaccggagcccctaggggcctggacgcaacaaaccaaagcccagcggccggccactgaaaatgggggcaggggccgctgcggagcgatgaatcctttcctcagccgcgctcgggctgccggttcggcggccacaggcctggcaggcgcgttagagacctagacccgttcccaagtaagggccgcacgggacccaggccagcagcggcaactcgcggagcttcagctcccctaggagccagagccgggggaggcggggccgagagccgggggcggggcccggacgggggcgggcccgcggtgacgtcgggagggcagcgacgcgcggaggcggcggcggagcctcctcctgctgctgctgcgccccatccccccgcggccggccagttccagcccgcaccccgcgtcggtgcccgcgcccctccccgggccccgccatgggcctcaccgtgtccgcgctcttttcgcggatcttcgggaagaagcagatgcggattctcatgggtgaggcagatcgagcgcgcggcccggaccggggcgccggccccggcgcagcccttccgcccccgcgtccctccagccccgctcacctgggtctctggccccgagtcacccacctcataacgccccggggcctctgctctcgggcgggtcccggtctgcatcgccgaccccggggcctgacacccggagctgcgggcctgggtggggtgaagctccctccgccccagcccggctggtaagaagggaggattccgcccttggagacgacttttaaaacgagcgcggcctacctcccgtgccccttgcctcccagtcctctcccgctccgcgccctctttggagttggctcacgccacccgactgccctccaggcctcaaaggtagataacgacgcgcacctggaggcgctcccgctctccgccccagtcaccatcagctgttgtggcctctccctttccctggtctctagggggctccctcgctcccatctccatccctgtgcccctttccgttgcagttggcttggatgcggctggcaagaccacaatcctgtacaaactgaagttgggggagattgtcaccaccatcccaaccataggtgagcccggggacgaagcagggagcgggagcgccgcggcgggccctcgcggggtctgctcccagttctgccacttttctggagctgaccctgacaccagatacagctatttgagaagtgggtcagggtatctctacgtggataccggaggcagggtggatgtgacctagccccgccctgttgaccgccagttctggggttctgttcccctgggccttgatcattgccttctggttttgtgtccctgctgaaatctaagtagttttagtgagttcctttctttcaggagttttctcatcttttttttccaattatctgcaggcttcaatgtagaaacagtggaatataagaacatctgtttcacagtctgggacgtgggaggccaggacaagattcggcctctgtggcggcactacttccagaacactcaggtggagtgttgggaggggactttctaaccccacgggaaaaggtgttagggctgggagaacagaattgttggcctaggctgggcccccaggccaaggaaaaaacccttccccacttctaccccttctgtttggctatcccctactcactcttcagaactcaccttagtcttccccagcttggacttctctttagaagcaggattctgggaccaggctgcctgatttagccctcataacatgtctttatttccttgcacatctttggataaactacttcctctttgcagtggggtctctagtttgtgccatgactcctgtagagcttctatagagttctgtaaacttctgtagagtttactagatgagaaggattgacacaattacaaatgggaagaaaacagaaagggccacactacggtatgtcccaggcagaagtgattgcttctcctttcttccttccttcctgcccagggcctcatcttt

SEQ ID NO: 127219 - DNA, 1159 bp, Homo sapiens
ccaacgccatgcccgtgagcgagctgactgacaagctggggctacagcacttacgcagccgcacggtaggggtcctgcccacctggtgctgaatcctgcctcttgagggaagctgcaggctgggacagagatataaaggcattccttttgttcctggttgctgacctctttctttccttttccccacagtggtatgtccaggccacctgtgccacccaaggcacaggtctgtacgatggtctggactggctgtcccacgagctgtcaaagcgctaaccagccaggggcaggcccctgatgcccggaagctcctgcgtgcatccccgggatgaccagactcccggactcctcaggcagtgccctttcctcccacttttcctcccccatagccacaggcctctgctcctgctcctgcctgcatgttctctctgttgttggagcctggagccttgctctctgggcacagaggggtccactctcctgcctgctgggacctatggaaggggcttcctggccaaggccccctcttccagaggaggagcagggatctgggtttccttttttttttctgttttgggtgtactctaggggccaggttgggagggggaaggtgagggcttcgggtggtgctataatgtggcactggatcttgagtaataaatttgctgtggtttgtacacggtgttgtctgtagcctgcaaaggagaggctaggttactgggtaccaagagacaacgtgggagaggatcaaagcagctaaggctgcagggcaaccccacccacacataccctcagctcagcttctccctccttattcttgggctggaaatactgtagggtttacagtggtgcaaatctcattccttcccagctccaaggagcctttgctgaagattacaggatctcccttcatagttccatgaaccacgtaattgtttcccatcattctcgtagctacttagagccgttcttaatgtttgccttacacattaaaattagagggggagagaatgtgcgttaataatacgaatcctgaggtacatttcagaaaatgtgattcatcaggactagtctgatgcccaacaatatgcatctttaaaattacccagaggaggccgggcgcagtggctcacgcttgtaatcccagcactctgggagg

SEQ ID NO: 127220 - DNA, 2535 bp, Homo sapiens
cgcgcagagcggcggctcctccgggggacccgcggtccccaccgtgcagcggggcatcatcaagatggtgagaacgggccccggacaccgacccctctgcctgccttcgggcgggagtcaggcattgactccaccttccgccagcctgctccatgtcccagatcccctttcctctgcccccttcctcacttttcgtcgattctccgaatcctctcactagacggaagcagacacggagtccccttgttccttgcctcccggacaccttgacatcaggggtcacagtgatttccgaggttgcggcattcggatctcctgtctgtttaccaggacagatcgattactgattgattaacagagacaattcgttgatatctgtcctcccatcccccgtctttctgttcattttgacatatgctgagtagttagtagtttttcgagatcctgacatcggctcttctctactagtacttggccatcatgaaacttttctgttcccacaaacgctgttacttgactcccaagttttctcactctgtggccctcttttcctctctttccctccacctcttgtgtcgacctgaaagctcctgatctttgtgtacttttgacttctaaaaggttaggccggcaagaatcttagtaatcatcattgttctcccgtcccttaaagataaggagataggcttgaagaaggcaagtgacttgcttaaggtcacatggtggtttgggttggagccatagcaagagcccaagtgttcggattcctggtctagtgctcatagcactatagattctgcctgattttatataccctcaactttttgaaaattcttcaattttgaatttgaacctgcaaagtttatttttacaatttactcctagctccatgataatttgataatataaattcagtttatcacttgcccccagttgtcctccccaaaacccttccaaatcttggaacctgacatttcttggttttaccaattttctggtttatgatgactgtaaacttctagatgtcgtttcatactgcagttctgacatttgtatctgcaacagcaaatatcttttgtgatactttctcccaaggctccacaagttttgctgttgtagaaagttttgaaaaattctattttaggcctggtgcggtggctcatggtggtaatcccagcacttaggaggccgaggtgggaggattgcttgaggccaggagttggagatcagcctgggcaacatagcaagacccagtttaaaaaaaattctattttattaccctgttatctttcacaagattaaaatgttctgcagcttatgtgtgtgtaaagctgattttaagatcccctcgcccaattcccatgtgctcatttcttaaggtaatagtctgccaccagccaagattcttgggattttcagtactgccttttccttttgtttatgtgtaatggagggtcagaactgatctgaaactgaatgagaagagaatttccaagatccgcatatatttttcctctgaaatactgacctgacccatgaaaggattatcctaaagtggctcttctttcgttagctttttcatttgcactgatcttctcttcaccataggaacaaaaacatctcttggctctccggtgttgggtttggcagtaagaaagagtggatctttctgagatttctccttgctgaggtttaaattgttcttaaaggtctctctcatttgtggaatgggaatagaatgaggctgaacatagttttgtttccgccaatgctggaggcttttagggcatctggattctgtgcggtgactgcccacaaattacccccatggatactgaatatcaccaattacttgtttattgtcatgtcttgtgctgactattctgctcatattgtctcatttgtaatacctaacaagtagataacgattatcagccacattttatagatgtgtaatttgaggtttagaaagaatagttaacccaaggacaggtaccttatattggtaataagaggcagagctgagacttgaacccaggcctgtctgccacggcacatgctcttcaatatcatgcatgatgtctctgacttcatgactccagggtattaatttataacatggagggtggggccagtgatgcataaccacaaattgcaggaaagtgaagctgtctataattgagaaaagattagatgttactccttgtcttgtctgggagctgctattatggtaaatgacttcatttggtgcttatggtcttcacataggagtatggtgtggaagatgattgagtctgggtagtggcatatacaattcagtgatttgagccatctgtactgagtatagattgcactgccttctctgaccacactacaggggttgggtgagttacaggcagggattaggggaggaaagctgagtgaactgcagagtgacaggcagatttgtgccaggtttagaagccttgtctggaatgaaaaattgaccactggcaaattgctgtgtgtgaagctcttctgctaagcaaagttgta

SEQ ID NO: 127221 - DNA, 1048 bp, Homo sapiens
gcttgtttctaataggattaagactaagattttctgactatcagctagtcctgtgtattcccaaagtcactatttttcttctaatggagggaaaaacatggattaaaaaagaaaatgccaaaagtaggctttataagagctaaatagcatctagaacttgccattgttgatatttctcttagcattttgttactacatggaatttactgctgctctggcctctggcagtacttttttgcctagcaagctttagtgaactgtgttagtgaaaagcaaagtagcatgcttcaggggatcaaaactaattatcaggtaagaactcgcttacgcatcctgtggctcattaacatgagtgggaacttctgaggccagtgactagtgctggcaatagtgggcaaatgatttggtgaagtctatgccccagtttatttggaggatgaaatttggggagcaagtgaaaattgtgatttctgtttgtaggtttagcagagaaaattggccaggtttttgaattcaggtaacaaggtatctaaggcctgttgtccactcacttctcagcataggctagctatccatctgacaggtgtggttctaacaggggcatagtagatatcctttagagtctgatctttggatttatttcatttctccaagaagagcatagttacatactgtaggaaattttgtgcattatcagggaaaacaaatgcaatgaaggaactcaactcttactgggcttatctggcttttcctcatatttcttgctgggagatgaatacacaacccggtttctgttgctacttcctctcttgggagactgacatatgctttttgcttttacagcagaaatttatgtggaatcacaggttgtgaacattcgatatagatggaatgttacgggatttcacttactttcattagactcaatataatacattaatgatctttttcttcactctaatgtttaagaaaaaaatgaacagtggtttcagttggcattttttaaaaattaggaagttaagcaacttatgggaaaaataaaactaaa

SEQ ID NO: 127222 - DNA, 1067 bp, Homo sapiens
aagaggaataaaggagatttaaagaatctgtgcttaaagttagtaatctaatttattaactttgtccctggaaagcagcatggcagagagaagagatcattggcccagaagtcaggggacacaagttctggcctgggtgctgccatttgggtaatgttgggtaagatattccacctcaaactctccttttctctaacatgaggttgctggatgcattgtctctaagcattttccagtcccataaggctgtaattttataagaaaccctgtgttacatttcatttaggcatgctgaaacaaagttgagaaatctcataccttaacggcttgactttgaattgccgtttatcttgcataaagcaggttttctgttcctattcttttttttttttttttctaatctttagtttgagaaagaagattagtggaaatatggttttccagtgtggaagaccagagagttagaatgagactaaatgattgaatggtggggtggagagagggtagatagaagtaaggggagttcttggtttcctttcagtagtgtatcatgataaactagtgggagtgttgcttgagacccagaggaacatggttctagtgggttttattcacctagtcctatctctgcttcagaacactgtgacattttcctggtgcagcagatcttgacttgagaagggaaggagagaggaggcaacttagggagcctctggctcatagggagagtctattcttgccctgctcttgactgggagactgtggtgggagtgtgggggctaatagggtcctgagctctgttcttcttgcttggagccaggactttggtttttgtttagttttgttttcagatctttttcagttctatttaatgcacaagtacaagttgagtagcccttatctgaaacgcttggactagaagtgtttcagtttttggaatatttgcattattcttagggcttagcttcattcacctggaaatctcatattcaaaatcctccagtgagcattttctttgagcattatgttagtgttcaaaacatttcagattttggatttttggatta

SEQ ID NO: 127223 - DNA, 1144 bp, Homo sapiens
ggagcccagtgatttcctaaacaggtcatcgcatcaggacaacctagaagacgtttcccaggcattgaattagaagctctgggactggcctggaaaggtctattttcaaaaaaaagccactcctaggctattctgaaagaatcagtttgggattgatctggggctggcatgtgagatccactgatcttgtttaactcctgtactgtttgtagttgaaggggcgggacataaatgataagtgaaatgtatgtatgtgggggtgggtgcaccagaattttatgaggggaggatagtggtttctttctcttcgcgtttgtcttgatggttcccaggacgctttgtttttaatttgtggctcaatattgggctggggtcctcagggtccacttatagtgactcagatcctattcctaggtcacaactgacagctgagaagttgttttatattcctgatttaggccatatgctcattttaacactcatctgcgacttttccttctgtttgcatagattcccaggatcttcctgtaatttggcaccaataacttggcacattatttcaatggaagtctttagtgtcatttacaaaactaagattttaaattcctcactttctgttcttgcaatcctgaggagcttcatccctaggccttttggatctctcctgtttcttattcataggccccattcttaacaacactaaaaccccaaatgatctactcaatggtcttagtctttatattccactagcttgtctaatatggaagtaaaaataattctcaggtcttacgaagtccttatgattaggggtcacatttacagttcccttgatggccttttttcattttggtcaacagttttccagtttatcctggaattccttcagagcgttcaggtggatgtcatccagtgttagtaattgaataattggtatttctatactcaacttgctgttaaaatttcaagcagtagagaggtatgaagtaaaaaagaaaaatccctagctgggcatggtggcccacgcctgtaatctcagcactttgggaagccgaggtgggtagatcacttgaggttaggagtttgagaccagcctggccaacatggcaaaaccccatctctactaaaaatacaaaaattagccggg

SEQ ID NO: 127224 - DNA, 1651 bp, Homo sapiens
gcccctgagtctgagctgtcataaactttcatttgaaatctctgctttatatgttaaagagtttaattatttgttattcattggagagagtgcccccctcaaaaaaaaaaaggtgtggacaatcacagagctgcgctttagtgatagcatagggaaggtagaatattatgagtgtttttaataaaaatggatgagaagtctcttttatggacagtacttgcagtgccgggatcataaacaagttccagatcatgctgatatagctgcctgttaaatatcttgatgtgtgcagatctgtgtttgatgacagagggcgggaagggcctgggacactggcatcgtggtggggaaggactgaccagttctcttgtaattgccagctgtgttagatgatcagggacttgagtttttattcctttatgataatctccctaggattttaataatgaggagaatcctaggatggtaccttaattcagcaataatggactttaaaatgtttatggtagacctgtgatttgcactttattttgacatctaaaattgactatcagtatttcaaataggaaaaatttcctatttgagtttggaaaataagtggggaaaagtcatgcttctcatgagtatcatagaagctgacttatttcctcaagctctatggtcagctctgtatataaatctgagtaagtatattagacattctttagagatgattcactctgagtaatactgagtattatacttaacatcactatttctataggtcaagtttagggaaaagtgtgcatgactttacaggaacaaacctgaagaagagtaaatgcagtcattttcatttctctaagatatttcaagatctctggttggctttcatttagttgtatctggtatacaggtcccctaccacgttttatcattttattatgatttgatattttgtacagtacattttactcaggggcacagtgatggcagtgctgtgaggaggagagatgagatgacagcagccattgttattatggctagtaacgcagtagctgctgtcccccatccctggatcaggaacagcagctgctgtgcttctctcctttctctgggccttggaactggggaggaggaaagttaaagttaaaggaagttaaaggaaggggttgctggacttaacggatttctggtagtgcccaaactaaatctttagactagggctgagtccatcattgtttggtaaacaatattacagatcaggcgtcgaaaaatattccgaaagcacagtccttggaattgttaatcccactcttgacaggcacaagaacacatctgtattacagacatgcacatacagtgcttagaataggtctttatgtcaaaatgagagagtgtagaatttggtgttttgagtggctgcattgttttccattatgtaaaatgctgttgatcaactacactttgaaagcactgaagagttaagttatatgactgctagtcaacatggctacagtctcaggggaagaaaaatgactcagttaaatgccatcatctttcaatagaaacaaaagaaaaaggcagaattgaagagaggcatgtgcagaaatcttctgaaggagactatagaacagtagtcacctgagaacttgttagaaatgtagaccct

SEQ ID NO: 127225 - DNA, 1102 bp, Homo sapiens
aacatagtgaaatcccatttctattaaaaatacaaaaattagctgcacttggtggcacacgcctgtggtcctagccacttgggagggtgaggcatgagaatcgcttgggcctggaaggtggagattgcagtgagccgagattgtgccattgcactgcagcctgggcaacagagtgagactccatctcaaaaaaacaaaaaaacccttcattttttttccttattaaaacatgtttcttcactagaggtttatacatttaccccaatagtatatgtttgattcctttttcccatcagaatgttatatttatgagttgtgataactgttagacctaaattctcagtggctgttcagaatcaaacttcttgatttttgctgtatacgtttagatgcatgctccagaaattctgttttctctgacctgttagtatcgttattcaagaaaataatatgtagtagttaatcttattgagtggtttggtgctctagtctgtctttatgctttgttttctcagattgcaacacttaagaaaattcagaaatgttcctttctgaaggggaacatgggaagagaaaaatgaacactgatcactgcagtaactttcccttacctttaatagcctgagtacttgaccctcgccatttgatagaggagaaggtcccctctatatagtgatactcttttttatgtcctggagtcagttaatttttggttcctcctctgataagttaacacataactgttacctatcctgaaagattttctttcgacagctgggctagatttctcttaaatgacacttcacatttgtctgctatgtgcggttagttcttcctgagttgttctgtcttatttctgcataaataagccttgatctcccaggtccttggcaacagcagagctcagcgtgaggtagtgaggacttggctttgcagaggaccattgtcctggagacagtcctgaccctggtttccaggaggttgagtgagttccttcatggtaaagttttcgattgtgaagtctaagctacagtcttgattgtgttcttttatgtaagtcatcgatattttggctcatgattctcatatcatagatttagta

SEQ ID NO: 127226 - DNA, 1047 bp, Homo sapiens
ccccagtctgtttattctatgacttttctattgttggatttctgggtcaatcatttcagaatttggccccaggctttatgtaggtatttctcttataaaattaaaaacaatcctgtttatttagtcattcaacagatgactttgcatgcctttgaagtgcaaatgctatttgaaatgttggggatacggtggtacacaacctgcattatggtgatacggcctctggaccattcattttctctttcttccccctacgtaggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgaggtaggtgtttcctgaggccatcgtgagcctgtggacctaggtaatagcccactgtcttctgtcgctgatgccattttgatgtactctttctttgtattttgagtatttttatatcatagaactgctgattctggatgtgcccacaagcagcttgtatctgttgtttatatgtttactacctttagtggcagttgaagtcttagagctttttcttgtaccttttcccatagacttagatttgttgtgttttcactactacttttcttggaatagtttaggaacatttcctgggtagccttaagcatttgaaatcaccattggttatggcagagctcttttattaatttatttttgaattcttcattcatttacattgttcagaatgcagaaggatatatagtgaaaaatcgagtacttcccctgagacacctgaggttactagggtcttgtgtctccttccagagatagttaaaacctgtatgatcagacactctcattttcataaatcgtagcatgctataaatgctaggcccatattttattattttattaaagattgtttttctttaaggttcagagggtacattttcatgtttgttacacgggtatattgtgtaatgttggggattgggcttcta

SEQ ID NO: 127227 - DNA, 1132 bp, Homo sapiens
aagcatttagtttttaaaattataataaaggacattttattttaattaagaagttagtgaagcaatggtatagataatagagatagagaaaaactcccataattctactaccaacagcaatcagactaaatagattaaaataaatttaagtagattaaaatcagttctttttcactggtcctccatcagggaccacacatattgagaatattagcatatacctcagggtcgtttaatgaagattaaacaagataacatgaagtgctttagtgcatgcttataaaataataaatgttagttgtggtaatcactactactgcttgctaatttctcttactacagatactcctagtactgttagatcaaccactgaagattaaatatctttcagcatttttcacattttgggcattaacaaatgggtgaaccaacattttgaatagtttcttttcctattgtgtaacagcttgattgcttccaaatgaagagtgttgacccttcttggagctgaccaagttcatttgcccagaaggaagaactagtgtagcctctaagaaagaagggttggattttaatttcctgttttgtggatgagaatcttgggcagagaaatacaaggccagttggaacttgttctaaaatatcataactgtatcccatgttaacaggacggtgaaatcttaccagaactatcctaggtgaaaggatactgtgtaatctgatcctagcattctggtgtagttccatatatttatacagtctagtgctttttgcctctcccagactaactcagtctcactgtttctcctggtaactcttcagagatccctgtgagatgaaatatttgatagctgcagatttcatcttttcctagcccacagtcatcatttctccttcctaataatccaatgtctcctcaccctgctgtgatttggttttcctcctattgtaccctcaaagctgcatcgacacaagttaccagtaatgtcaattgattgaaaaacctgatttccctgctctcattttgactcccccaccccccaccccaacgctgacatccaggcctttaacaaggcctagggattctgcctccttaaaacctctcttatccatacttgacatttgattaata

SEQ ID NO: 127228 - DNA, 1028 bp, Homo sapiens
aattaagggggtgaataaatagaatacaaagcaaaatctgttgtttagaatctggagaaactgacaaggcctcacttgttctgttttcagagtcaggaaaaatttatatctcttcaaagtctttcaagtctgtgttgtttatgtatctgtagttgcttaataggtaaaatgtatttgtttagccaatggcaatgtgaacctgttagaaaggggttgtgtgtatgtcaggtttatagtatgtatatcatgttcaagttcactagtgttggctgtcagtaggatggattgcagctggttttcattaacattttagtctctgaaaagtgctacatctataatttggaggctataataatgctgttttatatcattaagtccctgctctcttatatgactgtcatagctgtaggaaaggctttagagaaacatttgcatgaggtataccaatgatgaggatgagcaaaggcaaaaatgcgccttttgcattctttctaccttcacagacataggggccaggtctttcaccatagacttgtgtggtcctttctgactgcaaggagacatttgctggactctataattggggtgtgccagtgggaatttgttgaattaagatacttgttttggtggtgtttttggacgtatgccaaatttgtatcttaaggacaattactggcttgattaccatttcagtattttgggggaattcagtttgcaattggaatgaataataaaaaaatctcacagcaggactggaccatctcaacaaataaatctcccctggagtaccagtcctttttcctccaaaattgttttgacttcaagtcactttttcccagttttgtgtttggttcaatctcttacactacatttcttcatctaattttgactgtgaatttggatccctgagggtgtggttgccttttggggtagggaagagaggtgaagacttctggcttgagaaattggtaggtcatccttgcttaggagtccctcctgctgaagatgagaagagattcagtttatgc

SEQ ID NO: 127229 - DNA, 1751 bp, Homo sapiens
atctcctgacctcgtgatccgcccgccttggcctcccaaagtgctgggattacaggtgtgagccactgtgcctggcccagtatcttgcctttctttcaagaaagtgaatgcaatgaaaataatatctacatgttatatgacatcggtagaagattttatggattttttgggggagtgctcatcattaaaaaacaagcttagaccagagaatgcaaatcctattttgataatatgtgattacttgtctgctgttttgcatgctgtatttgagctacttgaattgtaggtaaaattgcatcctctgtattgaattacttcttgtattttacaactactacatcctgctttgtgtttttctcattttagtgcttctctaaaacaaaagattgcaatactgttttcagaaataatagttccttttcactgcacatgtatccacttatttgtaagtggtttaagacagctgttcattgattttttttaatctttgcacatattccatttcctactcatagtctggctcagaaaatatctactgggcataatacttcaaaataaatttctggctacataggtttttttaaactcttgtcagtgaacttatgaggattttgttcattttctaattattctatagatgcactgtcatgacagttttcttcttatatataggatttggtagctggtaacctttttgtaattcagatagaaattgagcaggtctgtgctttttaagaaatatgtttgtttagatgtgtgggttcttcccatttttttgtagtagtcacccaggagatattagataaaccagagttaataatgaaggtggacttgaaccatctaggctcaaaaaattgtatgcctggaccatagtctcccagctgtgggcttacattttatatatgtatcttgcatgttttcatttactctcgctctttgttctggtttgactggtagtctttcttctggatacatctatagggtagagtaggatgctgcaccaactgtgctcccatggtagtggtggattccatttgctgagtctgaatgatcttgcatccttgctttgttgccaggtttgccaaagagcgcaggctgagaatatggagagactatgtggctcccacagctaatttggaccaaaaggacaagcagtttgttgccaaggtgagtcattctcagcatcttgatatgcatagtggacattgccaggcgagtaataatacaagaatttgaacaattagaaatgctgaagctcttgaaaatttcaaggcaagccagtaggagtgtgtgtgtgtgtgtgtgtgtgtgtgtgtgtgtgtgtgtgtgtgtttattgtagggggtttagaaaccattagactatttaaatttctttgtaaattagctaacttcaaactagcttgaaatatctctcatagtttaggacttcttttttatctgcctagcaaatagcattatcttaagatttcctatgtccaagtatagatggtccctgacttatgctgggtcgacttaagatattttgactttacagtggtgtgaaagcaatagatactcagtaggaaccacatttggagtatccatacagccattctgtttatcacttttggtctagtattcagtaaattaattaaatgagatattcaacactttattataaaacaggctttgtgttagattattttgcccaattgtagacttatgtaagtgttccaaatgtgtttaaggtaggttaggccaagctatgat

SEQ ID NO: 127230 - DNA, 1045 bp, Homo sapiens
tcctgagggatttctttgccttactcttggattggagctaggattgctggatctcacagctttctctttataatttgcaactttgttttagtggcatacattctctaacttcatggcaaagaatgcttgggaggtaaattttctgagacctttcatgtccattctctacatacacttgatagtttagctggatatagaattttattttagaagtcattttccattagaattgtatctatcagtatcactccactgtcagtagttatcagaaacttttttgatttctaatttttttatggatctgaaaccatcctgatttcttatccttatatatttttttctttctgaaaggttttagcaaattctttttgatcctagtgttccaacatttcatagcgatgcactttgtttatctatatttgagcatattatgcctcaatgtttagttgttttgttctgagactttttctcccaactcttttgttggtttccatctagaatctttgttctcttttttctagaactcctattatttggttgttggattttgtgggctcatcttccagtttttttctcctattttctgtctcatcttctattctttttagatttctttatagttacctttcagtagttttattgacatgatactgttttattttttaagaactttttttgttctctgcatgtttctcttttactattttaaaaaataaagttttatactgacttcagagataaaaatcatctcttagctttctgcgaaattgatttttttttttttagtttcatttttactgcgcactcactatgttcttcaagcctctcctctccccttcttgggttattttggtcccttatttttcatattagaggctttcctcagatatttgctgagtcttggttttctgtcttatttgagaataagatattaaaacactgagtttagaagcaatgaccctagtgtgggatttagggtatacatatttgcttgtttgtttttgagacagggtcttgctctgtcacccaggctggagtgcagtgg

SEQ ID NO: 127231 - DNA, 1080 bp, Homo sapiens
tagcaggagaacagacatggacagtgtgtaaatgaatggttgtggcaatattccaggaaaactttataacaatatgaagtgggctggatggcccttgggccatagtttgccagcctttcttgtagaacactggatagcaacattaagttaaaaatggaaaaaaatacatgcattacttttcataacctggaactcaacagcagttctgtatcattttacctgatttaaaatatctgttagtggcaaacagcttttttcagggaatcctaaaaaagttctaagatacctgggaccttcacatagtctgaaagtcctgcaagtcttccctgagtgattctgctttcaagatcatgtgattgtgaagccttaacaaatagtgattctctcttcaacaatcaccctgttttttaggaattaattgtacagggccccgctaaaagcctcaaaagcctgcaaagggtaacctatggcctctaactggatgcctctggggctctacagttgatttctggaactgaggcaaagctgtaggtcagagtgccaagaggcttattaagcctgagaaatgtgaaacttgacaaagtattctctgatacatgtggcctattgagagactggttccctttgtctgcttaagcagttttacttcttgaggaatgaaatgcaaaggaagggctctccttgtctttccaggttagcagagaagcatgttcacttcacagcgattagctgagcttgcccgagacttttgtgcccgtcgtggcctgccagttccctccctgccttccctgtggcgttttagctgatctgtgctgtttgtagccatatggtcccctgagcacgtggcttggcttccctgttcctgctgctggatccttgggcattgcagatttcacagacctgaataacattgttgtggggggtgggggagggatggagtggaatcatgtcctcaagaggtgtctccttaccaccctacctggttagaggcttcttgcttggtcctctgtacctatatatagattaagcagagccctgaactaggtgctttgaaaagatgtaaaataactagaagtggtt

SEQ ID NO: 127232 - DNA, 1067 bp, Homo sapiens
cagctctaggagtccccagtgtctattgttcctgtctttagtccatgtgtacccagtgcttagctcccacttgtaagcctctttgcctgttttttaattgaggtttttgtttttttgttgttgagttttaggagttctctatatattctggatattaatcctttgttgggtatatgattggcaaatattttctcctattttgtcagttgccttttactttgttacacaaaattttcatgaaatctaatttgtatttgtactattgttgcctgttcctttggtgtcatatttgagaaatcattgccaaatccaatgttgcaaagtttctgccctgtgttttctgctaagagttttgtagttttataggtcttatatttaagtaatgaatccattttgagtttgtttttagttttggtgttacataagggttcaactttgtttttttgcatgaggatatctagttttcttaggaccatttgttgaagacagtcatttcctcattgaatggtctttgcacccatctcaaaaatcatttgactgtatatgcaagggtttatttctggacttcattctgtttcattggtttgtatgtctgattttatgccagtaccatgtggtattgattactgtagctttgtagtaagctttgaaatcaggaagtgtgagttttcctgctttgtcctttttctggattgttttggctattcagggtctcttgagattccatatgaattttaggatgagctgttctgtttccataaaaatcatcactgggattttgataagggttgcattacatctgtaaatcgcttttgggtagtattgacatcttgacagtattgtcttccagtccatgatcatgggacgtgtttccgtttatttatgtctctaatttctttcaacagtgttttgtagttttctttgtacaagtttttcacttccttggttgagttaattcctaagtattttgttcttttttgatgatactggaaaaggaactattttcttaggtttttttttttttggattgtttattatttatagaaatgcagctgattctgtgtgtt

SEQ ID NO: 127233 - DNA, 1497 bp, Homo sapiens
ttgcccttcacttgcctttgatttttctgctctctattggggcatcctattttggttctttctcatctagtgctggtatcttcttcaaatccaacccttgcctctttttctagattcacattgagattttgattttagtttagaagctgtttcaaggaaaatcttcaattacatgtagagacaggatttccagttcttaagctttgtagtgaaccacaaatctttgtcagggcaaaaataaaaaaagattgaccatctttatgaatgatacagattttgtctcattgagaaatcataataaggtctctgggaactgataattatagcatagttttctctgacattgttgcaccatgaaggatgatactgtttttcccacaaatggctattgatctcactttctacctgtgagggtggtgggccttgctcttggacatgtgatgggggccatagaagcaggtttaagcatgttcctttttgctcacaggtgatgcaggttctgaatgctgatgccattgttgtgaagctgaactcaggcgattacaagacgattcacctgtccagcatccgaccaccgaggctggagggggagaacacccaggtgagaatagggaagcagccgcgcctctttgcataaaccaaaaggaagaagttggagaattgattaatatatgacatatataatacatatatgtgggaatgcaaagggacaagtattttaaatctccacagtattattttctaatatttatagcctgactactattgggcaggtctcagtgtcttgtggcccacacccactgctctgccgaatttcacgtgggcactgttggcacttctccccagggggcttgagtgcagtgagggttgggatatgtgagatggtggatgagtttaattaacaagatcttatttttctgtgaataaggagaggagaaggtctgtatctcgtgtacattgtaataggacccgtttctgctggtcattttgatttgatagttctttatgtttttgctctaggaagaaatgaatcttggtatatgtattcactggggtcacctactcattttttgcaggtagtaactctaattagtagttaaactgtttgctattttttggatcttttggcagataggttggtgtatgactcaggtatatcatttttgagaaatgctttgtatgaaaactctaacaagagctggtattacatgtgcagatagactgatttttttttgtagtcatgacagttatgtagccataagagttatgagaattgggaatagggattaaggttgaaaatttttggggatttggttatgtcatatttttacagacgtctttcccgcttctgtttttgtcgtctgataactaaactgtgtgattatgttaactagttatagaactagttcctcagtgagagccagcgccaaaggcaaacatttggacagttttcagtaattaactattgtggattgaagttactgctgtgtgtactat

SEQ ID NO: 127234 - DNA, 5020 bp, Homo sapiens
atatcttggtgcattcacaagttgaaattcagcattgttttcatttgtgtgagagtttatagacagcccgtaagagtaaaataaaaatatgattgtcttttgaatcagatcatacataaaaaccacgtacaggatgggtgatttgaatgtctggccaatcagttctttctctctctttttttcccttagaggaggcagtttaatgcagcaaacagtattatggtaaggttgagaatttaaatgtatgaaagcctagaaatgccaaaataaggttctctcagtaactgtagctctgcctcattgcacagagtaaatacacatctccaattttatcagtattgggagtagtccacaattctgcatctgtgccgtacagttggaattaaggttcccacagcaaccacaactttgaaattcttgaacgttaatttttgtgcctgtatcatcagccagtgcattatgttaatgtagactatatagctgaattttaagcagtttttagggggatgggggtgttatagcttaggtaggatgatagcaggttttctgaagtaagcactaacctactactgagtatttttagtcccagtatcctttggaactcatcagtgggtaaacgatgcatttcccttagcctactggctgacaggaaattgttggaattggagtatttcctagtttaggcagaatcctgattatagaatttcttgtctcttacaaggcgtgttacctcttttttttcttcttttttctttattctttctttttcttcctgttcactcctgagatcttactccattttaagacagttctaagtaagacttagctgcaataatctacaacatatggcttgtgaggaagatggaggaatgatttccattatttgtctgttaaagtcctttggaagagtttactgaagggccacgtaagaaataagttaatataatgaaccttgaatgtagtggtagaaggtaccctgaagagtagccggttttggtgggtggtctgggtgatcttcccaggtcagctgctgtaccttgtgagtgtcaaggatgagaagtgagtcaacaggaggaatggctctctaggccagcgctgtccaacagatatataaatatgagccacacatgtgagctctatttgttattttaaattatcatataactacgttaaaaaactaaaaagaaacattaattgtaatttttaaatttgacttatatccaaattattatatcatttcaacatttaatgaatatgaaaaataaatgagacgttcttcccctttttaaaactgaatatttgaaatatggtatgtattgtacattggcactacattttaattcatcatagcatatttcaaggactcaataggcacatgaggctagtggctaccattatggatagcacagctttagaaatttgcatgaacaggtagtcattgttggtacatatttacagatacttattttgtgccagatactgtgttgggggtgcagcagggaataaatagatgtcccttctctgcctcatggaactttagagtctagtaggggaaatacacaagtaatttcatttacgttaagtgctatgaaagaaaagcttagagtttaggagagtgcatagtttgggaaggctactttgaggaagtgacatttaaggcctgaagagatattaggaattagctagataaaaagtgggagaagacagtttctgacctggagagcagcaatgacaagaatgagttttggggactagagaatggatggctcctgtggacggtgcatgagtggtatgacacctgtgtggtacgaaaccacaggcaaggccagatcaaacatgtcctgtgaacatcttaggatactcaggaagggagagagaaaatggggcatatgatgaactgcaagtgattttgtatgactggaatagaggataaatttcaggggagtgttaagaaatgggcctgggagttagacagggaccacttgttgaaggcttatatgccatgcattttaggttttgtcttgaagaattttgaattggtgagtggcatgtttggattaaaatactcttgtttcggttgtttgaatttacaagatatgaaagcagtttgcatatagagagaatattatgcctggtaaaaacttactttagcaaggaactctggattttcttttggtaagtttcagttgaccaaagacctggaaaatggcatgatgaagagttaatgtcttaggagacgttaactctttcaggctgatgagtgagaactatggatgctgctccagcagtccttctttatacttgccttttgacttaaagaaatccccccacgccaacccctgcccctttccttggcctgagattactaaaagaaaaaagaaaaagaagaagaaaaaagaattccccagagctcttataaagaatacaagatcctgctgtatgcttatgttaaagttaccagagatttacaatatgggtgtggtaagaaacatcacctgggcatcctagtgtgactgtaactgtatgtgtttaaagactgagcaacaggcatcctctcggagtcttaggtttctggtttcatttactacgtaccagctgttacagtcacaagtggagcccagttgagtattcatggcatagatgttggggccaggacctctgttagctcatatggcatctttgtgcaaatttagagaagggtactgcttcttcctgtcagcatcatgccaggggccatggcttggcaagcagaatggaagctaaattttagctcctgttctccctttgtccgctttgccaggtacccttctgcaaggcacagcatgggtaaaaatatgggcctgccctagttagaacaggctggtagaatctccaaggaaaacatcaagggcattttttggaaattgaggagtggttttgtagttgcggaaacatggagtgcttgaggaatgttaagagatgaaggtctgtgatggatggacggtggagggccttgaaagaaacactaaggacatttccttctctctaattacaggactctgcctgggggtcaatggctttggcatggaaaggataacctgaaaacttacggtaccagagccttttccaaaccaaagaacaaagcgggagagggtgcagaataaggaactagatgagtaggagaagagggaaagtctgtggcatgggcttcctcaaggacaggcagatggggcagacattcctgttctagggcgggcctccactgctagctcccagatgaggactcaatgggactttcccttcaaggaagcatgggggaggttcttttaatattttcttcctccgagacaactctacatttggagggtagtagggcaaattgtttttttctgttttgtacacagagacaagttcatttctcttaaattatactggaagatgagctttttgcctatggctaaccatatttctgctcccttaatttggttactttctaattggagccagaggaagtacttggacaaacactgtgatcaaaggaactgttttcatcctaggctttccaatattacccggaaattcatgggtagccacttctggattttggttggagcttggtttgttcctagatagtgttatgcgagagttaaaaggagggatgtgcaatatttccctctctagaattctagctggatttgtctgatgttgacggtgtttctgtggcaccctgcttctggattaatccagtgtcaacccgtaggagacgttaactctttcaggctgagagccagttaagaaagctgacgtgtgatgctcttgtgaacctggccatgtatcagggtttctctaaaggtatagtttgttttatccagttgtttgctataaaggaatgtgctaaatcttggagaaaggctgtgggttttctgagctgctgccttaaaggagataacacattttgcgatctcaggacttcctagagagtgcttggctttgatctgaaactggaaagcctagtgctctattgcccagggctgctgtgggctttgtgttacacttggagtgttaatgacaaaggaaacagcccccaggcatccgatgaaggggctgacttattctccctgaagtctgttcttgcggtgctattgtagttgactaagagatacagagctgaaatttaccttgaaaacaggtacataatttacccaatccccaggtgtataaaatttgctttaggttgctgggcctttttctcagattccttttcttagctgtctgtctctcccattctctgtctttgtatctgtttctctgtctctgacagcccccactgccagcgctcccacttagtattttgggaaggaagtgtggaaacccaaaggtggagtctttccctcagctggtagtcaccccctgctaccagcctctattcatttccatcaccctgtcttttagtgtcctccctgtgaatttatttaccacataaaggtttgttcacaccagggcctccaaatattcagacccgggtgctaaaggatcagttttgttaaagctgccatatgctgaagcccccagtgtccttgttgcctttgtttggggagttcatctcccagacctggcccgcctggctctccagggcaggcaggtgggagagaggagctgagataggtgcattattagtgatgccttgggattcttaagggctttttgtcagaggcagggttatgtaaggcactgataactccattcattgtaaggggctccggggtgctttgccattaaaagcgattttcaacctattccctccagtttagatttgtaaaggcaaaatgactggtccctctggaccctcaagccgactttgccgactctgagacacgtgccaacagaaagctgtggggttagagaccctaagtgaaattggagcaggccagtaaacccactcactgtgatctcctgcttgttactgggagcataaggcaaatagcaaattagagagggactccagcttggcattaaggaccttggagaaaagcaaaagctc

SEQ ID NO: 127235 - DNA, 2418 bp, Homo sapiens
taatatctgggtaccaacacttaaaacatccctgtgacctgttcctcagcagtagaggtcatggagtaggggtacaagcctgcctccttctgatgaggtcaagacatttggtatctggatagatagcagactttgctgaagtgcacatttcactgatctctctaagtgaattttaaactggagaagacagcatgtgcctgtcttgttgccctttgatttcctttcttctccccattacaaattatattttctttcatttcctttagttatatattccctttcccaggatcttgcttatctccttcacataattttttgggattttaacaatctcctagtcttggtggtttatccctgaactgggtgcatttacttctatcaatccatatctctctcttcctttaatcatcactatcacacagttctacattttcaatttatctaaatctttctagtgctggtgtgttcacatttcttgtctcttctcagtctcgtgagctgcagtaattctgtgttgcttccagagttgtcagcaccatcatattcactgccctgtgagcatttactgtacttgctgtgctgaggtaaccctcttccttgacctagttcttgaaggcccctttaggccagagacttccatacacaccatctttcccttctctgtagcatcgtgcactgtttatttgtgtacatctctaccttccattgtgaagtctcacctctaccaaggccaggaatggcagggtcttcccagcttcatatcccttctttcagaatcttacagagtgctgtgaataaataaacatttaataaatgtttgaatcagaatatctgctgaggcttagacctaattccatatattgcttgtgagtgggcatcatttttaccacctcccaatccatggctaacccccttgactgctctgacagccatcttgacttgagccaatgtgctggtatctaactatctccggagggaggttttacactcctgttttttactgcttcctaattggattgcttgttttgctggctaggtcacacatggctgttttctgtaggcacttcttcttctacactcccagttttaatctagttgctgccattgggttgactcgccctgcctctctctgtgtggtggttttcctcataatgtatattccattagcacagtgaagattgagttcagtccaccagaggggttaatttcaggattttaagtgcttttgaagattggtccccaattgactttctttcagcacctctactctgattcaggcttttctgaatatcttcctttcatagtagttcaggtatcttgattcattgaagtttatagttgcagtttttactgaggggtatatatatatattttactgttgtcgaccttgttggttgtcagattatttctttgcttggaactaattttaaaatcaattagagatctctcccttcatctttctcttttatttatgagatactgattgcagagctacctacactgtgtttagataaattactttttttttttttttttttttttacataacatttatattcaaggcaagtttagtgcagtcatccagtgcttcgcatttttgcaggctgggctgtaggtttcattccttggtgggctaattagctttgtactgggaaaattttgtgcaattcagaaaccaaacatttaagttccttgtgtactttaggcactgtaggtctgggaaattatttttatgaataaggtgtttataattttaggatccatatctctaatcctgacaagtatgtgtgtgtgttgtggtcggtcaccaggtagactttagactggatgatggattatggatgaagcagcatcatttctgtcactgttctagaaaaaagcttttcataaccgagactggaatgggaagctgaaggacacaaatgatttccctaccagatgacaggccaattgcttaggcatatttttgatgtcacttttcattttagccttcctctgaaaatctacggtcaatttatgggctgttcacattggacagctctttatttatttatttatttgagacgaagtctcgctcttgttgcccaggctgtagtgcaatgtggcgatctcgggtcaccacagcctctgcctctgcctctgccttcaagcgattctcctgtctcagcctcccgagtagctgggattacaggcatgagccaccacatccagctaattttgtatttttagtagagatggtgtttctccatgttggttaggctggtctcaaactccgacctcaggtgatccacccgccccggcttcccaaagtgctgggattacaggtgtgagccaccgcgcccagcctgacattggacagctcttagtctcaccatctactctgatatccgtctgtttttggcaaatgcctttgcctgg

SEQ ID NO: 127236 - DNA, 1717 bp, Homo sapiens
ttataaaggggaaagaagctagcccagcccttagctgttcctttcaacgtagccggctcaacgttttcctcaggaaaacatgcagggttcctcacagctgcttgagccaggctctgtccttccttcgcagattgccccgtggctgcctgcctcttcactctcctaaagctttttggctttaccttccttccctcactcctcccagtcttccctcagaggactgactggttctttcagcctagacactcctgtttgcctgccaagttacccttcttccggaggtgcatagcctcagcactgtcagagttcaggagaacagaagctcctccagtgagaagccagttaataacagcttttggacccattgttgttattattagatatccataaaatctagcaggtagagaaccgtcactggggctctgctggagagatatgtctcaatcctaaaagatacaaattagtcccagagtacctgataccgtagacggaacctgacaaactggaaactcagtgtgataaaatcctataacctttcatctctcacccccatcacccagtaagaagtgcattctcagggcagaagctaatggtgttgaatgtctctctcttgtctctttatctaggaatacagtggagtgtgctcctgtgggaacacgctgtctctttgcctttgtgcccaccccagagatggtggatctggagacttcggcccttttggccaagcacattgtcttcctccacctgatggttctcaaaagttttgtttgtttctttgtttgcttttgcgttttgacttgccagcatttctggaagtatctgaatggtaagagtataggtatgtgctcctgctactttagttgtcatctggatttctttgaattaccttccccatgccacactgtggttccttccatttctacctgctaccctccctcttggagtgcagagggaatttgtaaacttgggtttgaatgatgaggtcatttctgaccaacacaatttggtcgttctattagttgttcctgcagaccttacaaaggagtatgttgctgttcttatatgcccttgtcttgtgttgttcaaaaatcctctgtgctatgctttggatgctgcatgagcctgcaaatgaatgcttagcattgttgaagttgactgctgccctttagctgtctggctttgggttcagccagaaagagtggcatctttaacctgagtcactttttaaaacatggacaacaacgaaactgtattctagttttcttgagcaaccacatttaagctgcttattaaatacaattttatattctagaaaactacatttgtacagtttaagcaagaccaatattcttctgctcctagaagaagttaagtaaatttatatcttaattggtaaaatctctaaatctgtagtttgtaggtattgatttcaagaagacacctcactgatcacagaaacgagtggatgctgcatgctcatggtatggcacagtgttcttcattctggcttgtttgtaatgtcaggtttcaactttggtgtttgtaaatagtggcgggaggtttcaaaactccagttgtttagagactgtaagatttacttccttgatgcctatggaaggaatcaggctttagacagctgtggttcaagatacttttttcagcttctttctcattccctttttcacatccatctttaactttctctctctctcttccc

SEQ ID NO: 127237 - DNA, 2349 bp, Homo sapiens
cgattctcttgcctcagcctcctaagtaactggtattacaggcacctgccaccacgcttgtctaattttttgcatttttagtagagaggggtttcaccacgttggccaggctggtcttgaactcctgacctcaggtgatccaccggcctcagactcccaaagtgctgggattacaggtgtgggccagtgcttccggccctgaaagttgtttttttaaggctaacgtgtttatctgggagaagtccattggtaggaggggagaagacccaaatgaaagttgcatctgtttgctgctttttccctgaggtctttttcttaactctcttcctctcagagaggatcatctcttcagataaacaggctccagggaacctaggagaccaggggaggatgggggaggtaagagctaagttaccagtttctggcttgctttagggggtcaccctgtatgaccctccagggtggtctcccactcattcttcctaccttcctgcctccacttgaatactttccccctgttcctctctttctggctctggagagctagccttacgagccagtagagggctttggaaggacacttgcagggtgtgtttgtgtgatgcacaggaagtgtgagtggagatattttaatttgtgcacaggtgtgtagcttggagcgacattggctccctctggttcagttctgatgaaacagagcagtgggtttgtgctgaaatgtgtctgcagtttcagtaagagaaagaatgggttcagggctggtgatcattcagtgatactgtgtcatttgtataggtccttccctgtggttctgaagaataaattagtatcttggtcatttgaaaaagtaattttagcttgtagacttcctgtcacacttgagtagcttttggaaagtataatatttttacccaaatcccattaaatgttaggcgctctttctatatgccctttactgtccttttactgattagtgaaatatttatgtgaacccagaaggctgatttatttattttattgtcttttttaataacttgcttctccctagtgctgggtgctttctgaggcccagacaaccatcatgatttctttggtgataatcttctgccctcccctggcctgcatcctcaaggattacttggagctttcttagctttaatgaagcctctagctgttctgtcccctgggtgggtggtaataaatccaaccaaaatgcccaccaggggagagtgtaactcattttagggcatatggtgcattagtagctaagactcagcatcctgactcctgattcccagggacagccatggaagagatgtagaagtaaaatgccacattccaagttggacttggtcctcttgccctggaagcctatttcttgtcctaggtctgagggtttagtacatggttaaattgctggccaaggtgcttcagacattctttagcacctgcctctgtctggacaaggaatcaggcaggggctgatgagagtggtctctgatatgtggtctctggaaattcttttggcccaagtcttaaagtcatggtggtaaaaggttgactagaagagagcctctgagtggagagacatcctatgcacaatgcttgttctcttctcccctttcttattgccagcataaacagttgcacttctggctggcagattcgcccttgctaagtctgtgctcaggttgctgtccatgattaaattctcgctgcctgcaagcacagattctaggtgttgttttaaggttcagggcaaaacagttttctgtaacctctcctgctgtaagggtaactggctatatttgtttgtaatggacacatgtctggctgtgtgtgtgtttgtgtggactacctttcttttattcattaggcatctattgaatggataaggtttgtaaaaaagccattttctttagcaagtagcttgggtatttttttaagcgtttatttttcatgtgttgatttggaataaaaagcacacacaacttggaatgaaataaaagactaatgagaaacaaagccatgaactcatcagtgtctcaactccacaaaattagagtccccaaagaatcacagcaactcatctgtgtatcaagcagcagaaccgattattgcctgctttgggtctgactctgtagcaacatggctcaatcagcagaataatgcagaggaaaaatgttaagaatagatgcttttaatgcagctctcaaccccagtctgcacatcagaaatcacccaggtagctcttaattagtgtacatgccccaggtctactgaatcagaatttccaagggggtggggggtggtctagtagcttttcttccctccaccttccaaagctcc

SEQ ID NO: 127238 - DNA, 1754 bp, Homo sapiens
tgcccttttccccctttgtcctttacctgtttgttttttgtttgtgtacttgttcttttaccttaaaatcgcctgggggaacttgagaacaaaataaaacaaccactgcccaggcctcaactaaaataattaaagcaaatctctgggagtggagtgcaggccttgttgtaccgcaggtgactctaattctgaaagaggcttgcaagcccctgtgttgactgttgcttggtgaggtgcttctctactagccctttctcctccttcctcactctttgctaacattgccttccgttgtgtacctgttatggcccttaggagacctaatcatttcacttctgcaggtgactttaaaaggcccacttgttagaatggaacacagtagattcctctatttgaactttgcttttaataaatgatgacactatatgcttatttagtgttcttttggggtagctcagatctccttaaaagtcttattgttaatcccctcagtgtttcccgagagtgaggtaagggtttccttgttattaaatctaataccctgaaattgctgggctctgttacattgttctcaattgttctcaacttgaatgctgtccctatcaggttggacagtttcccagaatgcctttctggtaaccgagcattaagatttacaatctagcttttcttagccagaaggtaagtcttgcagggacttcagaaaggtgttctttctaatccttagtgaagagatctacttgatgggcagctggtagctgggcctaggtattcttagaagaaggatgttgtaatgttagcattagtgtgaaagtctgcatgaacactgggctgatccaagccagaactgatgagtcgagaggacaacttgtgccaccaagatgtgtctctggctgatgtttaaattgcatcaaattaaagggtatttctcattttccattgtggtgtcaccaaagggcagaattagtgtcattttcagtagctttgagcctctgcaactgtcactctccctgagggtcactagagatagtaactcacattctgaagaggccggaaacctccctgttggatgacttctttggagaattattattccagatccactgaaccctactcaccttcgtttttcctgcaatacttttttttttcctttttaaaaatctagagtaggaaaaacttcctattaatgcctgtctgtcatactaatagggtagaagatatgggcgggtgggtagtgggatggcggcaagtaccatgtaccttttcttgtgtgaaagtgctccacaaagaatggcccatgggaatgttttaactgtgtagtcattttctaaaagtttagttcatcgggtggtttcttcgtctttctttcctctgagtgttgtgttaggcatgaggaggggcacaaaggtatgcaagatgaagcccctactgtgtggtggtgggaataactcaagcacatgctaatcaaggcagcttatgataagatgcaagagggacacaccccaagtggtgtgggcattcaaaggagaaagaaatcccctttgacttgttctttaccacttggattctagtggtgttcctggtttatctgttgtgaggtagaaaccaaagtacagggcatgcagagactgtttatcactgggcacagttatggaggtaactaacatgttaaccccccacccccattttattcttgcttcaggaatttttgtctctgttttctccttgtaaactcttttgccatccccattgtt

SEQ ID NO: 127239 - DNA, 1208 bp, Homo sapiens
ctgaagggaatggtcatcttagaactccttttttactttatttcatagcatagtctctgcctgccagtatgatacattgtaattttagaagttcttttaaaaaatagatagctttgactgtaatcattatcttatagcaacaggcagaggtcttaattctcttacagaagcaagcttgaagatttcattctgctttcttgcccgctacaccagcattttcaaccctagctcatgtgtccttacattcatttccataacaactgttgttgagcctcaaactccagggattatgatttgaggtgggagtgaatagcaggaaccaatgaatgcttaaatgagaaatcttttagtaatgtcacagactcatcagaggagggcattagagaaggaaaggaagaatggaaacgccacaggcatcctgctggtatggtgaaaatgtccctcttttccaattttctgtgccttatttcattgggagatattttgattggctttatgtgggcggccttttcttactaattccttcttcctatgaacattcatcttttgagtatggtggtgtcttaggctagaaaactgatgtctggcctttgtaggtataaatacctatttatacctggcttatgtgatgcctagtctctggtccccttcagtccatagcactgactggccactttgagcatatggtagtgagctgcagatatgactaagtaaggctgctagcattcagtcttagccatttaagtagtcagcatatgctagtaatgtttgtattcagtataacttggaggcaaggtgttttttactagcacattttggttttctcgttgttgttattgttattaattttttaaaaagcttacattggggataattgagaataaatgcctttgcattcagcatgcatgagatgttttgcttgtgtatagggaggttgttgcttgggtggaagagttagaatttgtatgtagaaatgaaggaaaaatgtgatttgcagggctactttccaggtcgaccaagttcttcaaagtgacaaacatctctgttcctttgaaaattatagagacgctggtgtgccctatcattaaatgaattgtcaaaggccctggatcctatggtttggatataaatagcacatgtggctgtggaaaggactctgttgagtgtgggattgcctatgcaattcctgcccttgtctctctgaggaa

SEQ ID NO: 127240 - DNA, 2471 bp, Homo sapiens
ttccattgtcaatgtcaccatgtcgtattgtcacttacttgggttttctctccctcctttgctttttatttgtctagtgtagggacagactatagaagacaacaagggagaacagggtttcttgatccttgtaggattagtatgtttgtgtatgatgatggctcaaatgtagtcaatgttcccccttcccaccccttttactccatgtatgtgttattgctttggatcaagaacatcttggtttgtttctgtctttcttttatgtttggttaccaactggccaagtcagtgttcaccttgtttctggcccagtggaaacacaaacttgcatgaaaataggatattgaagtgagaatctaacactcacgggaatcattccatgttgtctccactgtgcctgtgattctttgttttgcttgcctggccttgtctcctgtatcttcctcttgacagcttgtttcctgccttttgattccacacaaacggtgataccatagtatgcttacccagactgggtctttcactttttcctaggatgcttgtgtacaaggtactgtcctttcagaacacgctcatccccctttgggttctggatcggaatcagattaatcaggtgtatgctggtagttgtgtgtctgaattggtagtcatgaagtctgattgtctggatcggaattgcatcattaatctgatgtaattttaaaatcaagataccctaatagtatgagtgagaattggactaagtatctggtgagagtaggaaagagatgaaatatttcttcttcccctaaaggaatttataacctaactgagcaataagcttaaacacacaaaatgtttttaaaagtaagaagaaaatacgcattagaaatcatattcctacttcagtagaaagtgaacaaaactacatgaattggtctgttagaaactgctgtaattgttaagaggcaggagaaagtgtttcaggatggggtggaacagggtggtttagtagaagaaatgacattcaagcaggtcttgaagggtagctgaatggaaggtgcaggcctatgtgggtgctggaagtaaacagtttttttggactagtagcctccaaaccttgagtatagactcacagagaagctttaaagaaacaacacccaaaaccaagaaatagcaacagtaacaaaacagattcctgctgtgcaccccccatgaagtcagaattatctgtgtaggagggggatatgcagacatggatatgttaatgtatttttttctttcgtttttttttttttttttttgagacagggtctcactctgtcacccaggtagtgcaatcatggctcactgcagccttgaactcccaggcccaggtgatctttctgcgtcagcctcccaactagctgggattataggcatgagccaccaagcccagcaattttttgtagagatggggtctcaccatgttgcccaggctggtcttgaactcctgggctcaagtgatccccaaagtgggatatatttctaaaagctttcctgattcagatatacttctagccttacgaagataggcctggaaggtaacttggatcccaaatgaaacagtcttgaaagctatctatcctaagggtgtagctttggcttccttctgtgggctgtcattgaaggctcttgagcagggatttgatgtgattacagtgttatgttaggaatatttatctgtggtgaagaggctgttggtggtattaataatgaggtgtggagaggcttaattagacagtgtacatggaaaggaaggaaaagatacaagaacgttcacaccgggaagagtcaacaaggtttgtggattgctgaaatttggaatgggatggttaagttgtagattagtggatgtagatttatcaatagagatttaaagttttaatccaggaggacaggaattaagttaataaaaattggtggaactggtttaagagactctgggaaaccacaagaagttcagcttcaaacatgtagagtggtaggtgtagcctccagttgggaaccttcagatgagaagttgaatctgggtgcagtggctcaagcctgcaatgccaacaatttgggaggccaagatgggaggatcagttgaggccaggaattctagaccaacttggacaacatagtgagaccgcatttccacacacatagacgccaggcttggtagcatgtgcctttggtcccagctgtttggaagcctgaggtgggagggtcatttgagcccaggaggtgaaggctgcagtgagccataatcatgctactgcactctagcctgggtgacagaatgagaccctgtctcaaaaacaaaatcaaacaaacaaaaaaacgagtaagtgaagtttaacctaaacaaagttttgtacggcaacagcaattttgatttggttatgtaaagattcattgttcatccagtaacgggttacacagactgcagataggtcatagcgtaa

SEQ ID NO: 127241 - DNA, 1502 bp, Homo sapiens
gttgaatggtgtaaaagcctagctagactgcaggttgtggatgaccagacttggctcaaaagaagcattcttagcattgctagggggcttttgcagattttggcttgtctccgatacttgagtcatttgatattgtagcccatgaattaggacagtgtagtttcaagagctgagtcctggctgtttccatggtagagtagtatgcattgtttagaatgtcaggtgagcagtggcttttctgcctgtgcattgcccatttagcagactctctgcttttatactacatagatgaattgagccatggtttagaatggggaaggttttctgaggcttaccagttaaaaaaggaagttggctagagagagagtcttaggctatagccttcatttggcctagggacattacttctagagagacaggcctcagtgtcctcatttgtttgaaagatagtgatgtggggttctatgtgactcgtagcaacctcgctgttccagcaaatctgtgggctgggcagggtttggaaaataaggagagtccttgcagttttgcaagacagttgttgtgaacaaatgaccctattgcattccctggttactcagcaccctctggacactggcctagtcatgggcaattggctgtccaaatagcatggactggtctgcagccggagctcttagtgaggatgaggcacgacgcttccccagctgactgctcgcgggagcattacctggtgtgcagctgttgcctgaatcccaagtagcatccaagtgtaaggctggcacgcttgcctcttcccatctttttccttgctgctctgtgaatatctgatcgatggggccagttggctgggatccagctaagccagccatgttgttagatgtagcatttctgcctttccccttctcatcttttccattttgtcacatcctaggatattgtcttcctaatataactggagagtttattccagtgggaattgtacttgacatgctggtctccatataaatgatgagtgatttttatttcactctctgtggtgtcttgtggtttcaaaaagtgagcaggtggaaatttggagggggtgggtgtgttggtaaaccctgtgtggtgagttttgttttgcagccgtcgtaatgcttatgttcatcagcagttcaacaaaacacatttattaaatacctattgtgtgccagctattggaaatagaaagatgaatatggccacttttcttcggagacccagccagcctttcactgctggacaggctgcccatctggactgctgggttgttccagtggtagtgctggaattttaggtagtgctctgtttcctttggtaagtgaaagaggaatttaaaaagtataatgcaggggccaggatacttgattttctataaagggccaaatgataaatatgtaagcaaatattgagatttgtggaccaggcactctttgtcacaactattcaactctgccattgtagctgaaattaaacgtatacac

SEQ ID NO: 127242 - DNA, 2263 bp, Homo sapiens
gctgaaatctgaatttcataaagttttcacatctccaaatattgttcttttgattttctttcaaaccattaaaaaacacaaaaaccattttcagcttataggctgcacagaaaggccaggttatgtttactgacccctggtataatgcttttgttgagcattggcctttatactaattctgcctccttgtcttccatcgttgtctaaggaatatctgcttgaagacagctgatttagcattgatcaggtactgttttcctgaactctggtttgtgtggtttggcagcatggagataaacatggtattggcccagtgatcttaactcactcccagttttttagggacaaatagtgtcccccatcagagctgcaaagtgtcaaaatttcagtgcctgctcttggataatgaattcctgttaagtgtcttgtttgactcagagtttgatgtagaagagactgggttcaggcagaggtgttttaaattcttactggagtggcttgtgctttggggggatgatctgaatggaaatttttaccaatagcaacaatgataataggaaacagtgtacttttatgtcttgaaaagcagagacagtgcagaatagacccactggagccttggatgctaggaggcagatgttgtttgtaggtgtgtttggcctgaaaattgagatgttgatattttttttctaaacttttttttttttaaatgaaaggcctttcctcttcccctgccaccaaagatgaaatgccagtccccaatcagatccttgcttattctgttcttatggttacataacgcaactgagaccgaagtaagcaagagaggctcctagggtgcctaggtgtgtagtggacctttcatttctgacaaatattttgatactttggcagaaaattcagaatgtgtgaacaaagtaaggtagagcagtctggtgttgtggattttccttccccctttattgtgttcattagagcactgtctattatttcctgccttctttgggctctgaagaatatttttagcactgaaatttgtctttactactgaaccctgcccagctaatacaattttgtaacaattgattaccgctaaaatggttacctctctttgtcaatactacacccatccagatctcagtgaggaagtaagatttcaacacctaaagaaccaaaatggatcccttcccaaaaattagctttcactaaagtccccttgaacgctcagagcctatttattagtattttattcacatttagcccaaagtagattatcaattagaagtgaattggaactagcatcctgatagcaaaataggaagcagagaaagatagaacagatattagactctctgaatgtggtgtgtcattttgtgtcacagtatcttctatttggagaatagaaaatgatttctctgttggaattgtatagattatcttcttgagtgaaaatagggctcagattgaggaggtcagatagaataaaataatttttctttcttaaagtgggccatcatgctttgagagatcctattgtgcctctctgattggatgttttgttactttttactacagcatcagtatccttgccagaaccaaatttcctataggctttatgtagtccactaagggtaaatcatgttgcagtaacaaaagctcagtggctttataacaatagaggtttatttctcactcatatgtccataataggtaggctgtggttctgcttcacttttccttcactttgggatccaggttgatagatcatttgttatatggcattttacccttatcacagtggagggaaagagagatgtggcaatcaagagctgactctgtgatttcactggccactcccaaatccaccaggccagggaagtgctgatggtccttccccagggaagggtactgaacactacatggccaagaccagcagtgggttgggaggttgttattctctcccagagagggacagacaaaattttgaaataataccacagacttgatggttggccagatttatgcagtctcaactggggaacccatattcttttggagcaccagttgtttaaaaaacaacttttggcttgcaaatatttcagtggtctgattttcatcagcattaaaagcctaacagagtatagtattcaagttgtaggtcttattttcattagcattttcatgtttccaaaagccttatttcttttagacctaaataaattactttgggtctgtggattctaatttgcatggctctacttag

SEQ ID NO: 127243 - DNA, 1166 bp, Homo sapiens
aacatttgctggtttgataggagccaagtgctgatgctaaaacccggtgtaaaatcagaccacatcttttacccttgccagccaaactgaggacttgaaaaagtcaaatctgtcttgtttcagacacctctcaaaatataattctgctgatgctgggcagccataggtgctttggcatttgggagtgaaatttaaaatctcttgctgctggtgaatgataggatggatgtggagtttctttgtctgtgcccttcagaatatgcagcagccagctgcaaatgatggtctaatttgatgtggtgactccgtttgaaagcggaagctgccggtttcagaccggctccctgtaggataatgaattgtcatgcctctgctgattatctaacaagtttgtacaacgtgtaacacaagctgacaagacaaacaattttattaatttaagcctgctgctaatgggattgcagtgctatatgaatgtaggagtattatacgcaaatacaagagtatgctactctacacatacttgtagtctgggtttgataatgggaagtctattaatttttttaaacaatgtttagtgtttccatttgttttcaaaaaagaaaattcatttggatttgaattgaaaaatatttatgaatgcttggggatttatggagcttaaaaaaggctatcagcctttgaagtattagagctgataaatgccagtgggcagtagataaacttttggttgttataaaccaattacgctagaggagcttttgtcttaaatgtgtctagagtttggttgtcagttgggagagtgctagggcctgtggggagatggattctattttcagtttgcggcctttgatctgtagtatttttttcaaatcatctcatgttcttataaacttgataatttaaggtagttgaatcttgaattgttgactaggattgattagctatgtttatgaaaggaatttatcatctaagataaactggggcaggagagcagagaggggactagagccaagctctgtaagtgtgttttgtgtaattaaaatgatcacaaattagaaaataatatggtgggggtatgttttcctttttatcttcattcttgtgaagcagaagctgtgttgtagaatgtagcgcctttaggccttccactgtccttaactctg

SEQ ID NO: 127244 - DNA, 1044 bp, Homo sapiens
cccaaaaatttccctcatgtccatttccagatggcgttttttatgccttgaaataaccattattccacatcaattagttatgccttctcaaacttcagtcagtgcaatcatacagtaggcagcctttaatatctggcttttttcatgcaatgtaatgtctgtgagatttatctttgctgttatttatatcactagtggttcttttctgtatagtattccattgtttcaataaactacagtttattctcttgttaatgatcatttagattgtttccagcctgggtctattatgataaagctgctaatgaacattcttgtgtctgccttttggtggatgcgcacattcgtttgtttgtgtatatctaggaattatattgttgggtcatccagtagatgaatgtttagctgtggttagtactcccaaacacttttccaatgttactatatggaaagttgttccacatccatgccaacacttggtgtttttatgttgttagttttagctattcagatctgtttatagtggcatctcagttggttttaatttacatttcttatgtggagcaactttttgtaaggttatcaggcatttggatatcttttgtgaaatgcttgttcaggtcttataaagattttagtttttggaattgggttgttcatccttttcttattgattgttaggagctgtttgtatattctgaatgtgacttcttagttgagttgttttgtgaatatcttctaatttgtggttgccctttgtactctcttaatggctgacagtgtttcttaaatgtttctgaaaatgtttcctgtgttcttaatttctttgtgtttgagaagacattcatttcttgtcttctctttatttttgaaaagcttccctgctgttgatgctcctgccatgctggaatataagtatcaatataactgtaagcaatcgctatgccgcaagatcttcctgactctcagaggaatactaggtttccttgtaaggcacccacacaaaatttactttggagaaagttaaattaatgttattacata

SEQ ID NO: 127245 - DNA, 1033 bp, Homo sapiens
caggctaggcacggtggctcatgcctgtgatctcagcactttggggaggctgaggcaggaggatcacttaagcccagaaatttgagaccagcctagaaacatagggaaaccgtatctctacaaaaaattaaaaaattagctgggcatggtggtgcatgcctgtggtcctggctcctcgggagacaaaaatgggagcatcgcttgagcccagaaggttgaggctacagtgagctgtgattgtgccactgcactctggcctgggcgacatagcaagatgctgtctcaaaaatagatagatagatagatagatagatagatagatagatagataggcaggcaggcagataggtggtagcagatacatactgcttagtagacaacttgcagacaagtcaaatgaatcgataagaatcgtcagaatgtagtatgtgacttaagatggtgtctgtcaggcttttttactgtaacagaatgttctctaatcaaataataaacatttcatggtgaggtgccttgaaactatataaaatcaaattaatttttatcaatatggactcttggtttgatactttattcagtgagttataatacattaatttttttgtttgttttcatacttaaattgtccctgatttggccagtgagagctcttaaagctagttcctgtgtccttttgatgtgtccccatccttctttgatccatttcttgctttgtgggatgaggcttagtttaaactatctccaggtcagccctagagtcagccattttgccaaggaatcttgttccttttagtagaaaatggtatctaaaagtcaagaccttgccatcagatatgctcattgctactggagtgttgcttgcccccagaccatctcagttgataagctctagagaatacataggggcatatacatccatacgtatatttatgtctgtatgtatttctgtaactccatatttatgttgcaaaccatatatccacaccaacacctccagttccaatccaacaccacagggttcagctagttttct

SEQ ID NO: 127246 - DNA, 1446 bp, Homo sapiens
tccacttccacatctcttttggttagctccactgagtaggtacagtgtgtgtgtgaatgcgaagtattttaatagtgcaatttggcttttcatggtccttaactctggaaggaactccatgctcattaagtttgtggtgttgctgtattgcagatgctgctgaaggcttcctctgccctaggctgccatctttagtttgcctgcatagagtagagtaacaaaaccaaaccaaatcagaactttgacaccgatgtggcaggctgtgcttattatcagaatatcttttaatgtttgtgtatttgagttttcgttgagctgattttcagaaatgctgtctttttaaatttcccatttgcatttctgtgtcaaagtaaaggatttggaatctgaaaaagaataatgtctaacttggtaccaaataatgtttccaggactggtttgaaggatcagatgtgagtttttcaaattggaaccttttctaatgggcccctgggaaatgtcttagctaaattgcaacagtgactggtgaagtcgatcgaggtaaattgctcccattgctgagggttcagaaaccaggcagtggaagctaaaatttcaggggaaatcgggcggaactattgcagatggtttcccccttgaatagagatgggggttggtgtcgctgttgatgaatgggaggagattaaagcctgatttttgcaacgagttggtaacattctctttgggagactaaagaggaatttatgagaagaccatcagaatcagttaggtgattattttcaattttgactacaaatgacatctaggaacacaccatgatgccactggactctgtagtggtctttattagaaaagtagcaacaagagactttttgtgatgtttaccctcagtgagctcagaggtcgaggaattgcccagaatcttgcagattttcatttaacagtcaaccattgagcatttctgatttgcatttaaaaaaaatgaacctggctggttttgactatttgtggtgatatgttagaatacagatcctcatgcaagtatttgtgattggcacgtctcactcagacatatgtctcactcagacatcttctttgtgtttgaggaagccccttaagctctgtgcacagtgagaatagtaaaatatcacagaatcgtgtggcaacattaggcccttagtaattggtaaaacttgatactaacaacatctgtctgtccatttttctcaatctcttgtaagtgctgagagtactgaagtaaggaccaagctttaaatccttcaattaaatatttcgaggctgaggcctggagagaatttcttgtattttagctccctatgactcttggaaattcttcctttatagaagttttagaagattaaggcctccaattaagaaagataaaggatctaatggctcccttagctgatgagcattgtgtaacca

SEQ ID NO: 127247 - DNA, 4135 bp, Homo sapiens
aaagctttggattctgatgggttgattttcttttgtgtggacccttgtactggttactatttaatagttcttttcttatcttaggccgggcgcgatggctcatgcctttaatcccagcactttgggaggccaaggcgggcgaatcacgaggtcaggagatcaagaccatcctggccaacgtggtgaaaccccgtctctactaaaaatacaaaaaattagccgggcgtggtggcgggcacctgtagtcccagctactcaggaggctgaggcagaatggcgtgaacccaggaggcggagcttgcagtgagccgagatggcgccactgcactccagcctgggtgacaaagcgagactttgtctcaaaaaaaaaaaaaaaaaaaaaaaaaaaaaatagtttttttcttatcttaccgtctcccagaattgctattgccaaaatttggtgcaactatgtatttttctgttttccccaccactgtttgtatgtaatttaggctgagttcctccaggctctggtgcctgcgttttgtggtttgtaaagtgctgtgtacttttatagcctctataaataacaaaatacagctcatggcaataacactgtggcaccctagatgtttagatatagtgtgtgttagatgggaagagagagagatatatctagggtacaaagtggctagcttgcaaaacttaatcgtcacttactcatcctacttctcatttttgttcatttgttgatggcattcctttatctttgggacattttatatgtaatgactaggtgtggtgccgttctcctcttctcagtatcccttcccccatccctttccactgtttaatgtagtagacatgaagaggagaagagctggttcacagtgtggtgagatttccaaccagatgcttgcatggtgggggcccagcttcctatcctggtcttcctgttttgtttcagtagatcaccacagctgccttcttatatgtgggagatgtgaagctaggccctcgaatctatttctattagccctgtcaatatagtttgataaaatgcaaatgtctttgaaatggtagacttccaattaaaaggctccagcagggagtctgttttgataatgaaagtgattaagaaggttctattttcttccattggtatgaatgttcagctaaaatagcttggctttttgtctgtaattggactctgctaatgaggttctaataactcttaggttctaataatgattctaacaaatctattaattctcttcattgatcagtgctggggaccagaacacagtctctggatagcagtgtcatataaggttgtaaatgtcattcatttccctttctccttcattctaaagaatcaatggagcaaatgtttatttccttaaattctataatcttatatagatacatcttacctctgagtagagccagacatatatggtatatcagtacgcatgttaggaattgccctcaaaccctgcagtttatattaggccttgaagcattggttttggtgtggaaagaggggctgcagaataaacacattcacagaagaagactaggcaccatctgaagcctaatttttagaacgttcattctgttcaacccctttccatacgtacctgtcagcccctggtaaaactaggcttgataattgaatatgccgcagctctttagccagcataatctgggacatagaataggttggtgggggtgagctgccatggttatctctcaccacctcattagcggcctgtcaccttccatctttcgttattagaggcaatgtttgtgttctctgattttaatcaaaatctgtcttttaactgactacttttctatcttgttcactgttcattctcaaaggtccttatacttttcccttataacaaacttgtgaggcagaattacaagtaggagaggattacaaagggattagagtggcaaatacctgttttgggtatgctcagtgactcagaatggccaccaaacttgctttgttatgtaagttcataatttccatttataattgtggccttgtcagtatagccgtctgaatcactggggacttttatggaacagagaggttttctatgatcttgatagttgaggaatgttttcaaatgaagggataaaactgactaaaaatttagagacgatgagtctttgtgtgaacatccctgtggttggaagagccatttttctcaggtttccagcttgtatagatggtgctcatattatctatagctaatcaaatagcagagttgtggtttttatttaaatatcagaatgacaaattacaatagaattatattttacccaggggtagaatctaaggtcagagtatgagacgaaaattgtatatagtgaaaattattcttgaaaatccatttagtgtcgttttattcaaactgaagtgcttcaggatggtcagatgcattgtctaggatcaggaacagtttatagtcaagtcctttctcttttaagtacaattgggaggggacagggctggatggataaccatcaatatttaaagttatttcccacctccctgactcctctcctaccttctttatctcagagaatatagttatataccaataagttaaatatgtgtatatggcaaattctttgtcttcatggcatctctggagtttataaatgaattgctcctggataagttaatgctgccatatggtttgtgtatcaggagactgaactggggatagtgaggtcttgatactgctggtaaaaatgttagctgctggcgtagaattaagagtggtcaagagagggcttgggtttgtttctcgaagcccaaaagtattaggtagagtgtttttttttttagaagtgacagtagtaaactccgtttcctcagggtgctaactaatcagaagcctgggctgtctgtccacaggtcagggagacggatgctcatctttgccaaagggcaggatgtaaacatgtttgccagccctgttgaattctttgtgctattacttggtgatttcttctacctggagtattgaattcctgctgaattcagaggactgaacttaaattgctatttctctctagcaacctgtccaaataattctggtcacctctttttctgacagtccctccctggtttctctctgttacttatgttttgaccagcttccattccttgtccagatctgtttattccatgtatcttgttcctgagtgggcttcttcgaaatttcttttccttgtataatgttgatggaatcttaaaaaaaaaatctgggtgtttgtgtgttgtatatgtgtatatatataaatgcatatatagatagatgtatttaatgaggaattccatatatatgtttatattccctttccttttccattacaaaggcaactgtatgaaccagaacagtgccctttttgtagcccactgctggagtgtgcattgcttaatcctctgttgctttttaactctcagcgtgtaatgaattaaatagttttttacccttcctgataaggatatttatgagtcagggtggcagaattccatagtagcacattagtgtctgctttgagttgacacattcatgtgaggtatccttctgaatggagggaaatggaagtgctttgggaccttgctgctgcctaaccttccagctttgtgccactcaccgtcaccggtgtgcagggtggcaggcagtggataccagggcccagaaggtcttaaacctgcagaattgtgtgcactcattgcttagatatttccttagcacaactatagaacttaaatatttttcagtatcatgttagccaccagggagtggagacacgaaaatgtttctaaaagtaaatggggatggtgggtggctgagtcagggtgaaatacaaataaatacaatgttttgtagaataaaagtactttaagagaggcacacaagtaaaataacattcaaaggatgaaagaaatttgaggcttggaattacatagcttgatattgctgtaactggtactaaggataaatagcaatatcattttgcatacctgcactaattagatcactttacctgcactatctaattggttgctgacaaagtcaaagccctatgagggcttttaaaatctttattttttatgtcagga

SEQ ID NO: 127248 - DNA, 1093 bp, Homo sapiens
gcccggccaggaatgcatttagattgaccagtggaaggaaggaagggaagtcaaagtagaaattaattggaagatgaacagcatagagaaacaagggctagtcatgaagccctcctccaagattttttaataactgcttgagttttgtgggatgattcctgagtatgcagagacagaagtgatattgattcatcttgtgaattctgatgcatgctcttcacagaaggaaagagaaaaatcttatatgagtttattagtggtgagatgacattctttaagaaataccatccttgatggccattggggaacttgagccatttaagccttttggcctaaaagtgatctaacaattcaatatctttctgggtgactgtaattgctagatgttcgatagtcatgaaatttagttagcattcttgctgttgaattgattcttagtgtttatttgcaaaacctcaaatgtgtatctaaagtcttgaatgctttctcatagttattcattgtatactcagtagatatgaaatatcaattttacaggctaccaaaatggtatttaatggtggctgacaggatagtgtttaaggacaatatgtattggatacttaaatttttctattacctgattcttggcacagatcattgaatttaagttatactgagattgcagaagatctgcctgcctcaataaccccagctatgctgcatgtttatttagtcctggttccttcctgtgccttctgctttctaagcatgtacagaagaaaataaaacaattatttggtttctaccttaacatctgcttgcatcaggaaagatgtctaaaaaaaatttgagggacatttttgcggacacttcctgaagcctggaccagttttatgtgatttgttgacatcctttttttttttctttacccttttctaatgcctgcttcttcaattatccttaaagacccagggttttaccacactgcaacttaaaatttgagggtaaatttggtaaatcttgagctccttaaaagatgatctgttttatacccatttcatttttctcttgaatttcattttaaattgatcgctatgtattttaggcttat

SEQ ID NO: 127249 - DNA, 2040 bp, Homo sapiens
tcctgtacataacccattttttagtggctctctgaataagaaatccctttgtgactggcccagattgcatatttgcttgtagtttctaccccatctccttgtgagggaacctctggtacatactttaaacttctcatcattgtcatctgctcattggcacaccttttcttctgtctttttatgctttttgtttgttggtttttattgattttcctttgtttgtttgtttttgaggggggacagggccttgctctgttacccaggttatagtacagtggctgtatcctagctcactgcagcctcaaattgctgggctcaagctatcctcctgcctcagcctcccaagtacctggttctacagctgtgtactaccatgcctgcctaatatttaaattttcattgtaaagtcaaggtctcactatgttgcccaggctggtcttgaactcttaggctcaaggcagttgccttccaatttttaaggctgtgtagctttcctgataataatgggaagttggtttttcatttgatcctctgagaatctgttgatttgtgttgatgttttaatgtgccacaagtatttcctgttagctgcctgcagatacagaggacttttgaaattttgctctttgttccttttccttctctctctgttcttcctttccttcctccctggctcccaatttggattaaaacttaatgagtaagaggcctaaaagacgtaagacatttacacaactgtagatttattatctttgaatttttgaaaatgaacttttaaaggcttcttttctattttttaaggttttcaagtcatgccagtgtctgtgcagactgacaactagcactgggggaggggaggggaagaagttgcatttatccaaacattttctgaagggatctaactttgatttcctttctatgacctgatttaatggagacatttccacctcaaaggaggatttcaggaatgcatatattctcactagtaggcgaaacgggtgctgctttgatttctcacacccttggttgaatatgaatgttacaatgtggcatgttttccaggaatcatagggaattgacccattttatgtaacatttacaggccgatgggcatttagagttagaaggaacatcatttagatctagtcaaccctttctctctctttttttaaacagagaaggaaatgaaagtccagagagattaagtaattttattcaacaaatattaattgagtgtataacatgtgtcagactcagtactaggtgctggaggctacagagatgaataagtttgagtccctgttggagacaaatacatggttcccagatcatacagtttgtaattagcagattagagaatagaatatttatgaatcattcataatccagtctttctgtattgtgacagaaatgctctcagctgtccttttttgtaccttttaatttactcatttaataaagtcgattttcactttttaaacaaaataaaatccatgttctctcttgacccaataccctcctttagctgccattctttcttgaaagattcgtgtacattaatcatgtacatttgatcaactatgcgacccactaaaatctgactgaaactgctcttgctgaacttccagtgggcatgttttggtcttcagaaatcgctttgaatgttttaagtctgttgtcatatcttccttcttcaaattctcttctctttgggatcactggtgccctgattctcctggctcttttccttttttgttttcattttccttagagtttcacctgcccacttcttatttcttaaatgggccatacttttgcacatgtccgtagccagtggtcgtccatccttcaagacttagctcagtatcatctcatgaagcatatctgaccttttcaagcatttaggcacttccttccctctgttcttatagtaccttgtatatatttcctcatcctgcaaggttttggtctatatgttaagctgtgccttctaatttttctctcttgagaaccagcatctccagtgattggcatgtacat

SEQ ID NO: 127250 - DNA, 1813 bp, Homo sapiens
ttcatgtttctcactgcggaagagagactatcctacataatggcattgtttccatatttaatcgtaagctaaacattcatggtcttcagcatgctgacagcacccaaacaggcaaaagacacgtgtctgcttttaaggaaatccagcatactgcaataaaaaggcatgcaggttggttttccctaaagcctcatcttcaacttgttacgtggccatgatagttctttcaggcctgatagcatgctgattcatttgctgaggtagaatgtgttttctctggattcctcattttgtttatgttgttgatccttcatcctttgctgtgcacttttactggatcaaaattagctgaatagaactaaatcaagggaaaaagaggagtgtcctcaaaagaaatagtggccatgtgttaccattaaaccattcagaaagaaatatttgtatttttaaattatagccttttatttctaattagttccaatgttaaacctcctatctttagaagtatagaggtggtgacgtagattgttaggctggtggttctgaattgtttgtttgtttgtttgtttttcttataacctcctggtcttgggttgtgttcaagtctgtaagatttattaggtgaacattctgtagctaggtggcatgatgttctggcttctcattagcagtgaccctggagagatttcttgcattcagcaacatttgtttggagccgcccagcatccttgtcatcgagtggtgaggcagagcttgggtttgggtgaggaggtcaccttgtacatacctctggaggagggagtggtgctgtgtgggggatgcttaggctccctggcttcccttctccttaaacacgatcagctcttctaggacaaggagctgagtgcttggaggagaggaaaaggactgtttttctcttgctcaaagtcttaagccgttaaagaggaatcataatattgttcgacgccctgtgatagcatccattggccatggaatttggaattagttaaattagagttcaccttttgctcctgccatttttagtggtgtggccaagggtctctcaatttctttgagcctctttttcttcataagtaaaaatataggtaatacttgctgactcttttgaattgctttgagggttaaatgagcatagtggtatcaaaaaggtgagcaagatgctgtttttaatttcaggtagcttgtaatcacctgtaggattacagatgcataatactgagttgggttagatgtattacgagaatacaggatattttattagaaaattcacagacggcttcctggagtcggtaagcagcatttgagcatgtcttgaagaatatttggcatctgagtcaacaaaatatttcacactgctgtggcagtcacatctaggcaggagaaacaacatcaaaagaggaccataagatccattcgtggagcttgttcagcaagcagtttggaatatagttgtcaggagcagaactgggctagcatgcttgattgttaaatagtaactaagtatctttgcagttaaccaaagatcagggttttatactgaacatttttatattaatgtggaaattgaatttgatagcattcctgatgcttctcccagattaaataaatcagcagagtattgaatgaaatgagctttacctctccttttttttttttttttttttttgaggcagggtctcactctgtccccaggctggctggagtgcagtggtgctatctccactcactgggcttgcaacctcctggactcaagcagttctcctacctcagcctcccagacagctacaactac

SEQ ID NO: 127251 - DNA, 1054 bp, Homo sapiens
gggattaaaggcatgagccaccatgcccaacgttacttttttttaattgtggtaacacatatataacataaaatttaccatcttcaccatttttatttacagctctgaaatgttaaatatattcactttattgtgaaacatatctatagaacattttcgtcttacacaactgaaactctgtccccattaaacagtgatttcccttttccccttctcttagccctggttatgcacccagctccacttatttttgacagctggcttaagagaagttcctagacttcattcagaaacattgcatgataaaatatgtgataacaaatctgggatttttttcatcttgctatagtagaaaaatgacattttgctggtattttgggcctcccgtgatttgccatctccgttaacccttactttatttacatcccattttatgcaatatagtaaccacgttgacacatttaagctaactttagtcttccatttctatcatgattgcaatttacaaagccatgaatgcagccttcctgtgattgggctttaaaaccacaaaatgattcactatccatgagagtgttcaacagcatattaggtagaaaaaattataggttattttgttctcttattgtgtaatttttatatcttgcacattccatggattagacacatactgtgacttgaaagtcttctctttactttgtgttaccaattgttgaatcttgtgagcatttctcggtcatcacatattttaactgtggaagctctttatgtgtactagttccttttttattggatcttttgtgcatatctgcacagtggaggtggtcatggtgtgtgggggcaggcagggtgaaggtggtggtatggaataggtaagagggaattttctctgtagagtgttgtttatcaagagaggtggactgctgctatctgatggtcacttttctttgtccaattgtgacctgcagagagggtgcttttagctactgtgtcaggatccagtaaggagacagaaagcacaccagttactttaacagagaacataatttaagag

SEQ ID NO: 127252 - DNA, 1391 bp, Homo sapiens
caggattatatatgtatttacagaatgctttgtatggaactaacagttggtaggtgctcagtaaagattttttgagtaatagaattggatttaaaatatctataaatatttgaagggtcctaatacttaattgagcttcttctgtaatacagtttatgcctctatgtctgtgttaaagaccatttgtttccagtttgggtaattacaaacacttcatttcttatttgtgagcctgttatgtgaaaaaggtagccctattctcagtaaagcatttcaaccaaatacttttaatcatttattatgtgtcttaacacatttaatatttgcgatactaagagataaccaatttcagacacattcctatatcttgtgctgttgtacatgttcatttgatattgttcattcctgatgtcatgttttattttacttttaggataagaacaagaaactgcgtcccctgtatgacattccttacatgtttgaggcccgggaatttcttcgaaaaaagcttattgggaagaaggtaagtaattgatgacagaagcatatttgcaagtggttgggcttaagctaatcttttggaggcaattgttataagctgggccctttaccagcagatgacacttctccatcaagtcaaatggaattactttgatatgaagagaggcgtgtttatgtgtcagaaacggtacccgatgggagaggtttaaaattggggccctgaccacagtttgattgccaatagtctcacagcagggtccgggctcaactccagttttaataattgcatattgccctgagctccattcagttggctctcttgttctctccagccaccttcattaaatgtccagggctatggaatttactagcgagggaaggttgctgctttttcatgcttcccctacttctgagggataggctggctataaggggaagaggggatgacctggactaagagcacgcctattgtaatgcactgtggcatcaatgctccctctattcttctggctggcagaatttcctataccctgtgggagttttttttttcaggaaggggtgtgtggcttcctgatagttcatgtgcagatttttgtgtagcttgatggcttctttttttttttttttttgagacaacatctcactctgttgcctagtctggagtgcagaggtgtgatctcagctcactgcaacctctgcaccctgagttcaagcatttctaccacctcagcctccagaatagctgggactgcaggtatgcaccaccacgcctggctaatttttgtatttttttggtcgagacggagtttcaccatggtggccaggctggtcttgaactcctgacctcaagtgatccacccgcctcagcctcccaaagtgctgggattaca

SEQ ID NO: 127253 - DNA, 1007 bp, Homo sapiens
aaagtgctctgtcacaggataaaaggactaacctccagtgtcagatatggagtcaattcttaatcaattaggttccctcttggtgagagaagcctcctttattggttcctgtgcaacagagttgattgtattctatttgtgctgagctcaagttttgttccccagagtgacattgtataaatgatgaatattgtatccctgagtagtgagtaggatgcaactcagctctgctgggctggaacattcctgatgcaaactgcttttcctgactcaccacctgaaaccacttgcctgtcttctgggcctgtcacttgccacagtgaacacccatgtactctggcgtctgggagcaggcagggcagttgctgcctcaggggagtggctagcacatcattgcacatttctaccaattcccttcagacctctgcagctgttcagcatggcacatggtgattaagaggcaccacgagggagcatgtgtatctatgtgcctgtgtgcacgaaagctgattagggcagcctgtcacagcttaagaaagataatggaggtaaaatcatcttctctgcctagactattatttgaccttctcagggattccataatatgacaattttgaggagttgctagaatgcagagaaataagactgaaggtaaactgctaaggtgttttgttggctttgatgacctccatcctagtttttggaaatggattcacttcctggatttaattctggattaatgcctttaattaaattacccatacttctcttggaggctttgtttcgtaatttgtgaaccgggactattacttgctttccttctctcatgaagttgagttatgagaatataggatgatggtagtatttcatgtttgtccagatgccagtaaagtatatggtttgattttgcttaatactgtttttatatagaatctttcatagccctactttttcagttatgatatattcctggttctgaggttatgagaagtgcatcagcgtgcgac

SEQ ID NO: 127254 - DNA, 1090 bp, Homo sapiens
gtagaagaatactgtgtgtatccttgaagcattttggaaactccctcaattgccatactgcctagtagaactctcttcccatctcctgtttaccatctgccctctttcactaaaatcttgactaaggaatattcacagcaaagagttttgtgttaatttcttcacaggctcatcatgaaatggaatttgtaataactttaacatgttttctggttttccagaatgattttctcgctgtgtgaatacgatggtgagactggtgtccttaggctgtggtcttcttctgatagcaggagcaatctttttctgtgtttataatttatttcccttaacgcttagagatcagtttgcattgccctagtcattttgctttcaggagaataaggtagtaactgggatcttcattgggatttccctccagctatcttataaaatatctaaagttgagactcagtatggtttatccatgtgatacagttttttaaaatgacatatgagtcatttctatagctcttgtcccttaattgcagaatttctatcaccatgggaaccattgtatttaaacttgcaatttgtttggacaactggagtttcaaaaatgatggaaaagatggaattgtaagaagccagagtgcattgaagcttctgtgctgacagtagatgctcattgtaaactgttctatcatcagagactgtcctgaaaatatatgcctattgctttaatgtcccttttactatttcttttgatgagcaaatattggggatgagcctcatttgtaaactaacagcagcctttttgtggctttcatgccattgaaatttgttatctgaactaacccagctctttttaggcacttagaattgggcatttttcttgatcagtgcagacatttgggaagttatggggctataaatcatttagtgagttatttcaaatccagattgccttagattgttgttctcttttcaaaatctgtctttcttgaggtatgtacttttagggtgtggagatggaaatgatctccatgtgcaccagacttataaatccagaatttccaagactaatctcttgatcttctggtggacatct

SEQ ID NO: 127255 - DNA, 1050 bp, Homo sapiens
ggcacagggtcacggagaagttgaggggcactgtaggtgcttgttccactgtatgagaatagatctccgaaggtaccgggagtaacattgcttagcaggaccagtttttcactctgctagtgagagctcttcaagggcacacagctttcctgaggaggactccacccttctccctggctatttatcagggttgtgcttttccttaaaaacacttgtgttctgtctgttgcagtgtgttacctaatcagctgtgttaagtacaaaaagctgggattctggggattcttgttcctaattacctctatttaagtttggattttataaacatttcttttgtcatctccacatttttcacctcatattaatttgattcattcatgctatggaaaagtcctttacattaatgatcaaagcaggccctaaggttgtgaatgcattgtgatttaaattgacaggtttatacaaggttgcttgtccttgcctcctcagtgccagctgttcggtgtggctgtaaattttttgaacaaatgactgaagatatttgccaaattgagagctgttttgaatgacttgtaatttccgaccatgcatttttctaggaagagttctcccacttggaagtggtagtaatgtgtcaacatgcattggagaccatgtttcattttagatgctctttaccctttgggttttgggaaggatcctaatcttttaccccttgattcttgagctctcttgtaaagagaaggttgattaacagaaatgactggagttgcctgtttctggaagctcagcaaggtagctttcttcctgctgccacctaaatggtcttttcgataatgagtttttggttgtttgttgttgttgttgttttccctgcagactctgaaaagtacctctgttctttgaggactatcagggtgttgagctgagcacacatttctttggtgaagtgtgttatttgttgttgttgttgttgttgttttcttgaaatggagttttgctcttgtggcccaggctggagtgcaagcaatggcaggatcttggctcact

SEQ ID NO: 127256 - DNA, 1797 bp, Homo sapiens
tatgggcacctgccaccacacctggctaattttttatatttttagtggagatggggtttcaccatgttggccaggcaggtctcaaactcctgacctcaggtgatccacctgccttggcctcccaaagtgctgggattacaggtgtaagccaccacgctcggccttgaagtgtgttatttgtgtgatgtatgttgtaatatcctctttaaaaagcatctctaagttaaatgaagaagctagagttttcaactgcgttcctggaaatttcttccgtatgctcacctgagggaaatgatttattagctaccagaatcctcgagattctcatatctctgggatatactcttatattaatttgcttattattaaagactttcttacttggactcccaagttgctcatatttttctggtgaatgttcccatatttataacatgatttgtggtcggcttgtcttaagccacccactcctgatcttttcagctgggtttctgaaatgtcgtccttggggctggaactttccatgcttactctctgcaaaccaagattttattttaggggagatttgtgctgaatcagctcagctgtgtttgggggtagggagaggacaggctttttttcccactttaaaaataacccttatgtgccaaaaaaccctataaaatgtgctgaattgcaaatcttccaacttcctatacctcctggtttacagagaatagattcttttgagcttgggcttgatgatactgtgcagaatatcttatgttgtagacgagtgtgaagtgaggctggatgcagatgtgctcatttggaaaggaaacctgactattgctatcttttttcagtatttttttctccagcatacgatcagttttgtccacttacaaggatctatgtagggatactagatataaattttctaatgagaaaaacgttttcttgtgtatctgcaaaataacccatatcattcagaaagagtccaattggaaagcaccaacattccagggtttctatgtaagtggatctctttttgttatgctctgtaaagttgggctaattgtttaggttgcttgaatatttctttcccaagggtataaacagtttgtttgcgtgtgagaaggtaggatgcacaagtgtctgttggttctaaggttgaaatttgtcgactttttatagttgggtgatagaagtgatattttaaaggctacatcttcataatttgggtcatgtagttgtaagttaaaaaatgagccccttgttttaatgtatttaaaatctgagtgatactttttgctcttatgtgaaagaaattatttttattgacacccagaattggcttttttttacttttacctgagcagttatcttcttctggcaaaacttaaggtatccctaaagtgtaacagttctatcccatgagtattgctagcttggacagtccttcctgatgttttcatgatgatatgtgtagtggggttgcacagcatctccccagaatacccatccatctcgaaccttagagtgtgaccttatttggaaataaggtctttgcagatgtaattagttaaggtaaaattaagtgatactggattatgatggaccctaaattcattgaccagtatcctaataagaagacgatctatagccaggcgtggtggactgcacctgtagtcccagctatttgggtggctgagataggagaatcacttgagcctaggagttggaggccgcagtgaaccatgatcatgccactggactctagtctgtgcaacagagtgagaccccaactctagaaga

SEQ ID NO: 127257 - DNA, 1100 bp, Homo sapiens
gccgaacctcttgtttctgggtttctacttcagtagttagtttctttaccaagtaatctgtgagatagggtttgataatgtcagcattctttcatctccgatttcatgcctgttttgtcttacttcctttatttgtgtttattctttctgtgaatactcctcctgggtggtaatgccttccctcctgcagaccagctgacagttggtgtggaggaattgatacacccaagcacatttccagtgttgtccataggcttacctccaaaccagtgtcctgttttctttccttgaagcatgaacactgatgtccacttaagaaggctgccctgtctcatggccatcccagtcacagggcctccatcacttctacttagtaattagcagcattttgaaatatgacacaccctgggagaaatcattcctggcaggagctcttggtgagccgtgctcatcccattcaaggttgatgaatagaacattaagaataattagcacaagactgtctactggaacactatctcttttacatagagcattatgtggcactgtgcaggaattttcttcagtaactataggaatcccaggtgttctccttaacctggcctttttggataagatattttttctgcagctttgccttctcacctcttctggcttcaacaagtgggctgggctgaagagcaagtcctctgaaaggtatttgctcaatagttggtgtgcttattttctttagaactcagtccctgaagctttggtcatgtgtaaacacttgctatgttaagaaggccttaatacgttaacaagtaacctagtaacaccaattcatttctcaaactctttttttttttttttttttgtaacagtgtctcgctctgtcacccaggctggagtgcagtgatgcgatcttggctcactgcaacgtctgcctcctgggttcaagcagttctcatgccccagtcttctgagtagctggactacaggcatgtaccaccaagcccagctaattgttgtatttttagtagggatagggtttcaccatgttggctaggggtctcgaactcccaatctcaggtgatctgtctgctttggcctcccaaagt

SEQ ID NO: 127258 - DNA, 1344 bp, Homo sapiens
acttttttctaccctctaaaaagatgatcttactaaggtatccagaaagactcaatttgtcttcctggtatttctaatcagattctgacttaacaacatttacttttaaaaatgtagttttcctagtattgactctgaggagggccaccataaagaggcaggtggccccaccttgtaggatgggctggaggtagaaaaattcaggagtctggagtcctggcctgaagtgcatctagtctttgttcacctcacccgctttctattttggcccttagttaacccctctctaaaaacagaaggaaccagcaggccacctctgaagatcatttcataaacccgtttgaagatttgttgcccggttttgcattgattggactacttttagggttccaaaagtttaatctttttgtcatcaaagattgttttattttaaatatcagtgaatttgatgaatactgatgtgatggctatgtgtcacacacaaacccctgagtcctgtggccactgggtgattctttgaacttactgtgaacactgattgttaaaggcctgtttgctgagaatgctataatgtaaatctctactgtttctgtgcagtgactttaattatcttaatcacccattatgcccgccttctcccaacccctacaagctaggagattgaattcattctttctccacctctgcttatgttaccaggttagggtcaaagcagatctttttatctgaaatgtttaagtggttaggctggggttacaattcagttagttactggggaaaggaattgtttcctctttttctaagatgtgtggttcccaatggttttctctcatttgagggctggtggtggtttccttctgtcatttgtcagttcactacattttgaaataatggctttaggaatccagtgccatcagaatgattgacttcttgacattagccaggtgctttttcacatttttccctagtttctcctattgctagtggtggagtttgcttgctgtcggcagtttggaagcaaagcagcatgtagtttgaactccacagcatgggagagtttttgaagatcaaagacaaagatgagtcatgttgctgttcttcggtatttctgctttggtgtagttaatcacagctttccaaggggcaaatggtaataagatcactaagtctagatagatttatgatgtctcaacattcagagactgaaagtagaattgatagtcttttttacgtcacagacacaaacttccccttcctttctttctctctaacctcattttcttttgtccctctctatctttcctttttccccctttccttctgccttccattttccttcctcct

SEQ ID NO: 127259 - DNA, 2341 bp, Homo sapiens
tatttattgacagtgttgagcactttcttacataggatttggtcatttaagaagcttgatagatttttcccatccttttatgtccttgtattttatctcattgaaaaagtcaacgttttttgtttcctggggttttacttctctcatattaaaccttaatttcattcccttttttatcttaaataccatttagcctaggtactaatgattaatttatgattcccttattttaaaacaacatagcaacaaatactcccttttttaaatttttaaaatttttgacgtgcttttatatagatcagcaagaggtatagctgtagagtggatagttttggagagagccagagtcattaacagaatttggaggtctctgtatgtcagtcttcttgtggaccaccctcttagccatctccctgtgtcattcatttcttttaaagggtagcttctaaaatgactccaacttggaaggcccttgggctggcctttccagactgaagttcaatccaggcataaaatagactttctttattgaaatgatgttgatactataccttttacgtggtttcctatcctcgcacttcagatattattctgatatttaggatcttagttataactcttttagtaactagatgtttaaacttggggaagccacataacttctgaatctgttttctcttacagtgtatgagtgctctaggtgataactgtggcccttttcattctgatttaaagtaaagctttcattttaatttatcccttaaaagctcacttaaccaattaagagttggaatttaaaatgaaatcttccaataattaaatcgttaaaaatttaaatattgatcattttttaaaattaatttttcctatgcagatacattttgtgtttactgttttataacctagcctaattgcaaattatgactttgcaatttatatttcacatctctttcaaaataccccttttcataatttgggggcaaattgtttagcttctgtgaatgattaataactcttgtattgtcattgtagatgttattgatgtatctttccaccgctccccagccctattaactatggattgtttttctagactttttagcccagacttatcattggatattacttaatttattctattcttatgtttatcacgatgcatattcacaggaattatagcagatgtcactaatcaaatacttattagatctgatatggcatttcattttataatcttctgtcagttttaaccatttattatgcgggttttattaataagtatcattttattctcaacatgcctatgcatcttggtttgtcttttacagagaaaaataaaggaatagtatattatgcacctatttttaatatttcagatgtaattatactagatataattaacctgaaatgtagttgttccttaatacatttatttgcattacttttctgggtggtttctttaataacatatatagttagcatttttcttactatttttctaatgtagcaagtttttttgtttgtttgaggcagtctcgctgttgcccaggctggagtgcaacggcatgttctcggctcactgaagactctgcctcacaggttcaagtgattcttctgcctcagcctcccaagtagctgggattacaggcgcccaccaccatgcccggctaattttggtatttttagtagagacggggtttcaccacgttggccaggctggtctcaagctcctgacctcaggtgatctgcctgcctcagcctcccaaagtgctgggattacgggtgtgagccactgcgcccagccgcaaatttcatttctatttcctataccttctggttgttctgatatatatatatcagaatatatatacatattctttcagtggtggggctttggatcattcctttacttttttttgagattgtttgaccaccctcatttagagtgatttctgtgaagatcttggacagcgattacagtaaattcctgtctgtagttggaaacctcatttgaggattttctagtgtttgaaagttggtacttttgtataatcttggttattgtatcatgatgcttcttttactgcctgggcattttctctggaactgctagaaattttggctttgttcttctttcttgtagagttgtctaaaattttctggaaaatctatagtgtcaaaatattattaaatatcatcactgctttcttgggctggtcttttgataatcaggataataaatttatagctcaaaatgttacctccagagcaaacacaattcttctattcttgaggtattgacttatctcctgggctaaaagacccagagacttttctttaa

SEQ ID NO: 127260 - DNA, 1006 bp, Homo sapiens
cttataactcatgagatttaagattactgaaatctcaacttgtaattatgcatttgtgttaaactactatgaatgcaaaggacaccacatttgtacatacatctttgtttctgtagattgaattcctagaagtggaactgctgggttaaaggacatccacatattaaatgttagtagaattgccagcctgacctccaatgatgttataataatttagactcctgccaacagtgaaaaataccacttagagaagcatgtggaaattggaagttcattggacaaaagcacagacaacagtgattaaattcagcaactagagaagtagataaaggtgggaaaatgatggtgaatgcactgaaaattctgtagatctgcacgtgatagatctctaaggcagacaattcttcatagaaaaattctgtcacagcgcaggacatcaaaatttgtcaattttataggaagtcagtgagccatagactattcttatctcccttctatgactgcctctgagaaatggtaagaaaggcatatttgggttgacttgtggtagacatgcagcttgtgccttagagcaagggtccccaagccccggactgcggaccggtactggtccctggcctgttaggaagcaggctgcacagcaggacatgagcagcaggccagccagcgtcactgcctgagctctgcctcctgtcagatcagcagcagcattagattctcatagaagtgcaaagcctagtgtgaactacacgtgcgagggatctaggtctcatgctctttatgagaatctaatgcttgatgatctgaaggtgggacagtttcatcccgaaatcatcctccccaccatccatgtaaaaattgtcttctacaaaatcggtccctggtgccaaaagggttggggaccactttcttagagtgttgactcttttcagaatgtaagaaaatagccaagtgtattttatatcctgagaaaggtggcctaaaaggtagactattttatcttata

SEQ ID NO: 127261 - DNA, 1057 bp, Homo sapiens
atacataaaataaaatttaccttcttattcaattttaagtgtacaattcagtgacattaagcacattcattcacattgttgtgcaaccatcactgtccatccccagaactttttctttcctcttgcacaatcgaaactctatacccattaaataaatctctccatcccctgtcaaccatgttcctatttttggtctaagaatttgactactctaggtaccttatttaaatggaatcacacagtattcttttttgtaagtaagttttttttttgtgactgacttccttcacttataatgtcctcaagataatgagaatttccttcctttttaaagctgaataacattctattgtatgtatctaccatattttgtttatctacttatccaacaatgggtatgtcagttgcttccacctttggctgttgtaaataaattcttctgtgagcctgggtattgagatatctctttaagatcctgcttccaattccactgatgtatacctagaagtggaattggtggatcatatagtaattctatttttaatttttttggaaagctaagcaatatttttgcatcatatttctgataatttaggagtggaaactggaacactgtggaactgagaaatggtttgatctagaattatcctccactggtaactgcccagtttgtgaatgtgtgtaattgtaggccaaggagttggttgtgtgcctgttcactgttttccaaaacaatgactgtaaatcaagagacctgaatttgaagggagacgcagatacaatgcaggatggtctttgatcggtgtctgtgactttagttgtcattgttctatgcacgccgtgcctttgatcatggaaccttgcttcatttagtaggcctctactttgtgaaatagagggatggtgtggtatgtttacaggaagaaaggctgatattgatacctgattttcttggaatgtttacttagccacaaaactgacaatttatatacacaagtgctatatccttgtgttatttagtcattggcgtgtattcctaaagaattattgtgttttt

SEQ ID NO: 127262 - DNA, 1236 bp, Homo sapiens
gaactaaaaatgtatgtggcttatctttgtaatctagtcagataatagatttgaaaaagaaaatgaaggctaaatattttatttttgataccagggtttttatatcatatttttttcatatttggtttaagaatgtttacaaagattcataaaacatacgttcacagggaaaaatacagagagaaatcagaaccacagataggatagaggaatgaggctaagacttgtgccttaactgatactctaggaatgcccactgagttttaagcattgcagtgtggctggtccaaattgagatgtttgtaaagtacacaccagatagtaaagatttaatacaaaaaaagatctcaacacttttataatatttgttatatattgacacgatgttttagaaattttgcattaaataaaaaatcatattaaaattaatttcacttgtttctttttaatgtttcaacatggctactaggaaaatgtgaacatacacatgtgggtctcatttgtcacttattatatttccattacacagtacttgcctagaaggaggtaagtttaacatcctctcttgagagatgagcagttccacaacggctaatgtctgaattagcttggaggtaagctcagagcatgcccagaggcaggaccaacaggctccttagcaatttgttttgaagctcttcctgtacctcgatgaatgggtgattgatgtgtgttttaaaatgtttaaaaatatgtatcacttttataagtttagaatgataatatacttttaacagagaaaaattattaaaactacattatgtaaatattaaggagcactttgtatggaagatcctgttgttataaataaattttcagtgctgcaagagaagtagcactcgaacataaatttaattttctcagcaaggcaatttttacttctatagaagggtgcgactcctggatggagtaatggtgagagcacacttcaacaagggaggggaacaggcaggtagcccctactgctatgttgttcccctgttggctagggttggaccgcacagtctaagctaattccaattggctattttaaagagagcaggggtacgagcctgagtggcggaatgagtagtttggtgggaagggcttacagaacaggtgactcaagatgattcagttcagagcaggtgaccaggggtgactcaaaggacggagcaggtgaccaggggaacagatgtcaactactgattagaactg

SEQ ID NO: 127263 - DNA, 1748 bp, Homo sapiens
tgtgtttatctcatggatacttatttagcatttaactctgtgccagacactgccctaagaaaattagtacatgtttatctaaaaataactggcacttagatagaacgtacaatgattcaagcactgttctaaatgatacatatgtatcttcctacagcagtgagatacgcacagtaaatgtgttaaacataagcagagaagttaggtcgcttatctaagttcacacagctcctttctagaattgctgggaaccagtcactgcagcctggctgttctgaagtgtccgtgttcttatcgagcctatgtgaaacattccattttacttacttttgtttctaggcagcatccgtgggactcaggccaaatggtgtcgtcttttcagtattaggggtgcgtagaggctttccataaagtctggaaattctgtcatgagaggggtaataaaggggttattttgagagacaaggtgtttatttagctctttgtgaatttatgagtggctatgtggaatagtgggtgggattatgtggcgattatgccccaaagccttacgtaacagctctagttatattaaaactaagctcaggctacaacctggaaatgtggctctgcagttgttttccttcctacctcctctaaccttttatgcttaggtagttcactttttggcgttttgttatcatcagcatcagtctgtgaagttctttggtggtttgatactgttctagtcatacattgtatgaagaatatccagagagcctgagaattctgttgtgtggcccatagctgttctatactaaactattccagactttacaagcaattaatatataaatttagtttgaagttaccatcttagttcctctgaagggtccctgaaattgctttcaaggaaaattctataatctaatagacgaaggttgcctgctaccctcttacctttgagaacctctttgaggaataaataatatgagaaagtatgtatgtttcatatttggcttgcttcatctttcatggttgtttgcgctagagctttatcacagttttaaaatattgctcctcccccagttcctcctccctatcctccacggtttaaataaatatatttttactatataaaacagcagaatgatcaacagcttgacaaaatggtcctcaggatgccctgccttcccacttcaagggtatccttcataatgttatgtctgaaaagattattgattatatatttactcatgcaacaaacatttacagcgtagtctcctgccttacaggcccatgccagctctttgagtgaataagacatggtctccccactcttggagcttacagttggtgtgttccaataccatgtagtaaatgtaaggtaggaaatacaaagatttaagaaaacagtatatagtaccccatgtctgactaaattatcttttagaattctagagtgaaatgatgctctgatgttctaatctagtgctctcgtttttaaggtcaagggaaactgagacccaaagatgttacgtgcctcatttgtaagggagcttcaagtagcaccaagcaagagcccagggctctttgtggtcactcattgctataaacagggatcagggtctgagtcagttatatagcccttggtcatgtattcgtaaaatacttgcatacaaaacatttcaggaatatcttaaaaaggagaacccatctatattaatcagtttcttctctcatgccgttttatacatacttacccacaa

SEQ ID NO: 127264 - DNA, 1088 bp, Homo sapiens
tgtatcattttgcattcctaccatcaatgaattagagttcctattgctccacatccttgcctgcctttggtgttgtcagtgttctgaattttgactatgctacaacgagcagtggtatctcattgttgtttaagttggcaattttctaatcacatgtaatgtagaacatcttttcctgttcttatttgccacttgtatgtattctttagtaagctgtttggatcttttgcattttaaaatcaggttgttttattattgttgagttttaagagttttttgtatattttagataaatgttctttattagttatgtcttttgccaacattttctcccagtctgttgctcagctatttcttttaattggttttaaaaatcttagattcagaaaaccaaactggagtgagctgatctttcacagttgagcaggcacatgtggctgctagtgagctatgttgcagactctcaaccctaattcccttgattctttgtttccaggtcaatgtgacggtggactacattagaccagccagcccagccacagagacagtgcctgccttttcagagcgtacctgtgccactgtcaccattggaggaatgtgagtgttctggctggcatggactcagctgtcatctcaagtagctaagagttctttgctcatttgaatctttccttcctttcactctgctttgctttctcctgctcttaactcagtggtttataattttgtgcctgtgtagcactttatatttgtaagtactttataatcactcattagctaatcgtatactttcattattgtagttatttaagatttattgggctctgtgtgcctggcactatgaagtacacatcattactattaataatgccatttattgagtatcaagcaggccctagatactgtctaaaatggtctctgcatattggtttaggaagtctaggtatagaatagcaggtaacaaagagggaagaagaggagaggttaattggacattttcttgtatgtaatcagtagacgatgaggtcatcctattctgctgtactggctgtaacctggttagattccaaggtctgttggcagccagg

SEQ ID NO: 127265 - DNA, 1063 bp, Homo sapiens
tagggaggaaacattggttctgagtgttataggaagtaaaacctttttctgttgcacatgccctgtctccatgatttgcaatttgtgctctgctgcatctgcaagacaacttaaacaatgcttaaacaatagaggtgaactgggttgagctgcccctgtgcttaacacatgcgaatgttttagtaaatacacactctttgtgtgcttgtatttcaatgatatttaatgaagtatgtaattaaaacaacaagcacaaccagtttaaactagatttggggacaaaaacaaatggctcatctggttgggacagaagtgctcaggtgttgtacagtggctctcagtcactctcactggcatctgccagtaccctatgctgaggacatagaatgtgcaagtcagttaagggaagggttagtaaagagagcttctatggcttgcatagcctctgaaaagtgcactctgttcagtcttgaagaaatgtgaaattaagaagaaatcttatctaaattatgtttgttgtaatctgtcggcttatatacctacatttaggccttcacagcacctagtggctttcctgttattaaagagaacagcagacttctgtaactacagaagagcttctctgaaactagtgattttaggggactgagaagaaagaggcagatgagatggtgtctcttaaagggttatttcaaagccaaagtttagatgcatttcacatgcagggagtgtgaattgtctgtatcttctatagggtttagtctaatccttttttcctctcgatgtatgggaaggagtcgcatcacaggatgctggcagggccttgctggtgtgacataggcttcagcttcctatctgtttcccctggggaatcaatgaaaacaaggttcatcattcctctaatagattaaaatttttttcttgattaacttcactgtggagttggcaagagttgttatctgttaatcaaaactgtttaaataaaaaataaaaagatcaaactttgagtcttttctcattctctggttcctgggttgggaattagctgatcgttttaggcctg

SEQ ID NO: 127266 - DNA, 1082 bp, Homo sapiens
actagggtaagccacacagatacacacactcattctcaccaccacctcacccctcatccatggaaaactgtcacatatacagaagatacagtcactaaggcacttccctattgtttcccattatgtgaagtatttcaggatgataggaaacaatacacatggcccattttgtgaaagttaaagaatggcacagagatggaaccttgaaaggtgagcaagtgaaaattcctgtttattttctgcagaagatcacatctttttagacaggtgactttattttttctgtttatttttctcatattttccttctgttgcttccctgcattgctcttctttcttgatgcatgcatcaccactgccacctgccttgatggctgtcagagcatgagaccttgctatcagaggtattgtccaagttctgtgggggctcgggacatcttagataattctttcccatgcagcagcttcaaggccatctttatgaatatcctttctgtctgtttagagtcttcgtggatagcgcttacctttaatgtatttgtatgaaccagactattaaatttgcaaagaataagactgcctttgcttttgctttttctttggttctaatttgcagggatactttttttctcccagctgttctattagtgactgaaccattaggttaggtcttatccttactctgctagaataatccttttttaatcctagtttggtttttctcagtcacagtaggaataagtgtcatacagcccccagcttttctgactacagttgtatagctttgaggtttttcactgtcagccaaacctcctatctctcagagttttcaattcttaaaacacattactaatatctgactttcaagctacacttgggcaaaagcagcctcttgaatcgctcttttctggcctagtcatcttacccagagaggcccacaacatcctgaagttccttttcagcacttgagaaagtatggttacagtgttaataatggcagtggctctgccgggaggtagggtctgtattatagccaaccctttttccccacagattgatgacttacgctttaatcatagtca

SEQ ID NO: 127267 - DNA, 1025 bp, Homo sapiens
cttggtctcaaaaaaaaaaagaagaaaaagaaataacaccctcttctgttgtctgaattatctgtttcctcttagattaaatgttgcctttattttgttccttttctttgataaatccttaaatatttgtaaactttcatctgcatttatgaaggaacaactttactatttggggtaggcatggcatttctctgcagttacgtaggtctacttctcttggacagcttcatcacaaaagcgagtagggaggcaggtagtatcagaggcaggcttccttgaaggctgcccaaaagtatctggtcctgcagcagagaggaagcaagcaaattatagaccccactgaaattgtcgagggaaagaggctctctggtagagagctttaatgtattttccaggattattttgcaagtgggggctcggggttgactgggatgtgctttgcagaagctgtctcaaatgctgtggccacacgtccatctaaacttcttcccgtgttaaattaagggacagctttagtagtatatagataatagacttttaaagaaaaatctgagtatctaatgttgagaaatctgcaacagtaacttcctttagtgtaagtgtgactattttgtggctttgagaactttaatgctttccaccacgttacaggtaagcttggtagcaagctgcaacagtaattggaagaactgtgaagacatcctttagtattaaaacagtgggttaatgaatggtctctgttagaagcaaagtcctctagcacctcctctagaagaggagaaggcatgagggcccagggtttaatgctgccctgctggtagagattttactgggcttgtatttttattaggcttgtttttactagtgcctgggcttcaaagttccatagggtttacttgaatgatctgcccataaccctatttttctcacaagccctttttatttaaggttttctgtgcagttttgtggtaaatatatgataccagttatgcctgtacttttgccaggtatcaaaaccttttgct

SEQ ID NO: 127268 - DNA, 1793 bp, Homo sapiens
cactctgttgcccaggctggagtgcaggggtgtgatctcagctcactgcaacctctgcctcccaggttcaagcgattctcttgctgagttcagcctcccaagtagctgggattacagatgcccaccaccacgcctggctgatttttgcatttttagtagagatggggttttgccatgttggccaggctggtcttgaactcctgaccttaagtgatctgcctaccttgcctcccaaagtgctgggattacaggtgtgagccaccactccggccagggctttattcttttccatatctgtctttctcttatttcatggggaccttgtaaaggatggtgtttggacataagttctcagtagatcttgctgacctcctactagcattctatttatttatttatttatttatttatttatttatttatttatttagaatagtgccatgatgtgataaggagaagggggcattcgacatggttactaataagcattatttatttatttatttagaatagtgtcattgatgtgataaggagagggggcatttgacatggttaccaataagcaaaacttatgggtcttttctatgccatttctcagcccccttctctttataattcctgtggtcagcacagcactaagtgttaaggggaataggaatggagtttttataaatttttgtaactcacagtagtgattctgcttaaaagggatttgctccctttcattctgagtgatcttttaaaaagtaataaaaattgtagtaacattttcaaaagaaaataggggaaattgcctgttatttcatcctgctaatataatagctcctattttgggggtgcttcttttgagtgctgagtgcttttttttttttttaaagaatataaaatttagaagcagaaaaacttggaccactcggcataaggttgagatgaagtctaaggcaaactattgttgatattaagattctatggaattttttttgagacagggtctcactctgtcacccatgttggagtgctgtggtacaatcatggctcactgcagcctcaatctctgtgggctcaggtgatcctcccacctcagcctcccaagtagctaggaccacagctgaatgccaccccacctggctaatttttgaagagaccgaggtttagccatgttgctcaggctggtctcgaactcctgggctcaagcagttctcccaccttggcctcccaaagtgctgggattatatcatgagccactgcactggcctgggtatttttttaaatgtagagtttggaagtaaataggtctgaggtaaaaaactcagctctactattagatactgtgtaatcatgggccttagttttttttgtttttttgatttttgtttttccagctgtaagttagagataatagtatatacctcataaggatattgtgaggattataggtgatactgcattttaaatgtttagcatagtgactaagacataacaatcaaatactaaagtgagccctaagccctccagaggggagctgcttaccattgacctaattttaaaatctaatagtttcttccatctttctctgtcctctttcccacctctctctcacatgtccagctatttctttaagctcaaacttgattttatattctgttctctttttcttcatcacactccctgtggccaactcatccactaatgtgattgctacccaacagattcttttaaggatgaatttagtaagtagtagctacccaaggtttaatttacaaaacaaaacaaaatgcctcattggattatgg

SEQ ID NO: 127269 - DNA, 1359 bp, Homo sapiens
cagggactgtggaaatagaatcagaatgtcgttattctacaacttttctaaatcaaatttatttcccaagcatgaagtgttaacagcaccctacccactggaatattttgagggacaaaagaaattctgacttgattaccaggactctcgtctccctcttaatatgtctctaagaggttttttgccctggaatccggtgcccggtgatcttaggacaattccccatttgcagcataatttataagttacccattctctctttcccctgtaataacaaaattgctgtgatagccatccaaccagttaaaaaaaattcaggtaattcatttctaaattggaacttgtttcttttaaatcagccttgtaatgtattacagacatcactctcagcattggctacagaagtgatttaatgctgagtttttaatgattccttcattaatcctggtattctgggatttaacactcactggccaatgatgaaaactttgatttcatgcatatcagataacgctgggcagttgctgaagccatgaatcttgcctctgtagtggcatgtatgattgagagtgttgcggatggatgggtgctctcccaggccgtgcactgctgctgaagaggtgaacacgatatctttatcagctcagggtgacctcttcccagcacagttgcatttgaagcaagaatttgcactgacagcttcgtctcctagatctctggacttgtgaagtcaagcttcaccttttcaactatttcctaaaagatgctttctttgagaacatgtcccttgatgtctatattttgatttttttcttctaataaagtcatataattttttagtagaaagacatcgataggactatctagtccacctccctcattttgcaaacaaggcagcggagtccacgaggagtgacataactaggccaatgctaataataatgaaaattaataacaacagcagtgaccgccaacatatataatgcttactgtgcgccaggcactatctaaatgtagtaattcattttttccccacaaaaccttcaggaggtaacattgcacagcaagtccagtatcccacacagcttctttctgtacctcctgctgctcttaaaagcagagaagacagtgttggttgcattccttactcttaatggaagcattacaaatgttccatggaagcgaggtgccagtttatttactgtagagtcttatggccagagtgttaatataccttgaaaaaatgccatgttctttcttccctcaaaaaaaaattattgcttagtgaagaggaagtcaccttatccatagagtcttctcagaggctgtcatattacagtgtgctgccttagttacttt

SEQ ID NO: 127270 - DNA, 1112 bp, Homo sapiens
agtctttcctgttagaattttattactttgctgccagtttaattttctgatttctttctggtgtctttctcccttttttcattctcgccagttcagtgctgactaacccttttctttgtataccttgtcaaagtttttaatatgatctaattgaaggcacttccctgcactatggattttgctggtctactagagacagtttttctttattttcagcatgccccttttcagatgcatctggaataacagctgcattcccactcctgaataaaatgggttaggaaagcttctcattggcaaagcacctggattctttggcaagattggaggtaaactccagaccagatccatcaccaggagaatgggaggaccaatttttatagggtgggggtagaccatatgaatgaggatgtgagtgaactcatgttatagaagcaccatttatatctgttaaatgtaagggattagataatctgtcattatgctaattctgggtaacagatggtggagagttctgcatctcaacagcagtattcaccatgggggaaattagcttgcacccagatcagcagttaggcaggaattccattgagagagaaacactattgatgattacattagtgtatccctctgagagcatctacacatatggtgggttccttcaaattatctatagttgacatatgcttggccatggcccttactaagttacaggacctctgtccttctatctataaagaatttgaagttcgtttaggaagatcaagattggaagtaggttaggaaatgtggctcagagcattattgtatcatacagtttttcttcaaagaaagatgccatacagatgtcaaaaacattgtttgtctgtctttggaaatgaactccagaaatgaaatgagaagcaggaactggatgtgttctttgtaagtgccataccttatctttggtacaagattaaacaaacaaacaaacaaacaaaagatttaattaagtcctttggcttcacattctctaagggactgtcttgattctgtaattttttttttctcctttgtggttttgttttgtttgtttcgtttttgagacaaggtcttgccctatcactcaggct

SEQ ID NO: 127271 - DNA, 1075 bp, Homo sapiens
aataatagctttgattcccaccaggagctgaaataattaaaggtgtttgatgctgcctaggtgttccttggggtattgagagaaagcaatttcattaggaaggtagtgatttagttatttatatgttaaagaattctgttatcagttctttccttctactcttgccatccctccactccatgcactcaacaaggcagatccaagcatttcgtacctgcaggttttccccctcttcaaatcttgctgcataatactcctggattaattttccataaatgctgttttaatggtgctatttcactaccatggctattttagactttgaccgcttttgtccaccaagcccccctacttaactatatctcttcctatcactgtcagcagtctcatctcttactttatggagtaaatatagggttatcaggaagatgcctttaacttcttgttctctcagcttccagtttgccttccttgttatgcttgctttcttacctcctgccttcccatctccgtagacagtttcaccttcttctttccaaactaattgttctgcctacatgctctagattccagttcttttgttctccttgggattttgtgctattggctattctctttttaactagtgttatttttaattgtccttcagtcttctatcctattatatctgcttttcttcttcttgccttctcttcatagccaagttaattagaataattaaaagacattttaattctgtcccgtttgctattcattcctttcccttctagctttgaaccttccccatcattcaccaatgcttccctgaaggacacttctcagtctttacttttacttgacctctctggagtatttaatacttatcttttaaaatcttgttttcttctaccttttcagtataccacactttcgtggatttccttctacaactctgataactttttctcagtctgctttgaatgctccttaaatatttgtgcttcctaggcttctgtcattgtccctcttcttaccactattcagtctctgggtgatctgatggtgatgctgctgacttccctttccctgtctctag

SEQ ID NO: 127272 - DNA, 1928 bp, Homo sapiens
taattgtatgtgctatacatttataggattcacagtgcggtaggtttatttttaccagcatcaccacaaacttgtgagtaatgcattgtgctgcaggctatgactacgcagtctctaggccatagcagatttttttagctccattataatcttatgggatccacctgcgtatatgtgctccatcattgaccaaaacatcattatgtagtgcatgactgtatgtaaatgtgaagatgagtgtttggtttttcattattttcagtgataagttgcagaaaactgtatcttatcactgaaaataatgaaatttctcctgctgccatagcgctccaaactagaaatgtgtaaggtatgcttaatgctcattgaaatgataaacaatcttgttggcctcaaacattatcatcaagtgtcattataaagatatggatagaagtgtgaatctacattgaacatgcactacgtgactattaataagtagatcctagttcatgttaaaaattataggctgggaggagggactcacacctgtaatcccaacactttgggaggccgaggcaggaagaactcttgaggtcaggagtgtgagaccaacctgggcaacatagcgacaccccatctctgcaaaaaaatttaaaagattagccaggtgtggtggtgcacgcctgtagtctaattcatcaggaggctgaggcaggaggattgcttgagcccagaagttcgagtctgtggtgagctaggattgtgccacgtactccagcctgggcaacaaagtgagaccgtgtctcaaaaagaaaactcattataatatgtctgagctagaagttattttgtagagcatttagatctagcatctcattttataggtatggaaactggcacaggcttagcacatttacatgaggtgaagcagctatagagagagctggggtgagaacccatatcctctgctctgtgttcctgctctgtgccatgtggggttttgtgaaacaggctcagaattgctttctggcctgagagggctggaggaagtgcataagatgactttcagtactgaagaataaataccaatgctgtgtgtaacttctttcttttgttggtatggatgatggagaattaattgatcagtgtttattcccagcatttctgtttggccatatacatttgttttgttgtgctcttctcactcttcacctattttttataatttagatgaggatttttttttcctgttaaagtgttgatatgacacagtatcttacattagaccttttttaacacacacgcacacacacacacacacacacacacacacacacacacacacgactctgccacgcagtgaatcttttttagaatgttggtttcctcttttctaagctttagaaaacaaacataataagctaagctaaaagctgaatatatttttggtacctacagatgtgaaattattttaactggtaagaagtttactgtctgcgatcgatttttttctattgggaaaatgaatgtagttggggagtcatatttggttagaaatgtaaagaaaataactaggagaatatctctttgaccaacaacagacctacatcacatttaccttgttcattcattcttaagagcacctaaattgatctctttgctggaatatagtggtatctttgtgaaaaccagagattgatatgttcttgactttaagatactcatctcttatatattccaccctttaatatgccgttcacggatatttctaaacttgattttattcttcacccagtggcagtatccttgaagccaccttcacttcatcaccagtcttctcttgcctttctcctttttctgagcagggtgactgaaactgttgggtttcaggtgggttagggaacctcacaggaatttatgtgttcaggtagagaacacgtcattaa

SEQ ID NO: 127273 - DNA, 1092 bp, Homo sapiens
ccttccctcttactctatcctaagtacctaagcagaggattaaagattaatcactacccagccacctttcctggactccgtaattggagtgggatttgcccaaccacccaccttagacactgcagctggaatgggaattgggtaatacagggcaagaccgagaagagaaaatcctgttgtatgtccttacctgagccttcaagacttcttgaagcctaactgtgtcacctacctctcaccctgggcctgggctccggtgtttcctagtttagaagaaagcatggcctatgcaactcaggcttagggaccatttatttttattttgttttgttttgtgttttttaagagacaggctgtgttgcccagactggagtgcagtggccattcttaggcatgattatagcatattgcttccttgaacccctagactcaagtgttcttcccacaacagcatcccaagtagttgggactataggcacatgccaccacacccagctggactttttattattcagctcttgaaatcgaacctcataatgtactgttaagatccttctggttgcaagaaacaacaacaactctgactattctaaacaaaaggaagatgtatgggacattatgaagagctaatagaactcactggagcatcaggcttggaaaatagatggagaacagggctcctgcaaagggccaagaagcaggatgcagatttgttgtcttaattaggagcagtctggccaggacaccctcccttatggtgtcacaggggcaggacaccactgtaaatgaaatttgactcttccctctattttgtattactctccacgcagaagcatttaataggcagagactctgtcatgtgtctctgccccacctgccagggacagggacagggtagtcatctgatgattttcatcttctgtggtgtacagcttagcattgcatcctattaagagtacaacagtgtgatatgttaaaagggagataacagttgactgttacatccattgtttaacatgtgaaagttgactttcaaacacatattgaaagaccatattatgcacaaaagtatgtaatgactgttatcatttt

SEQ ID NO: 127274 - DNA, 1019 bp, Homo sapiens
gtgagtggaccagtttagttggattggaagttcatgtagtttactttcttcaagcttgatccagtatttgattggtctaatcttaatgtttttgaagtatctatttgtttccttctgggaaagaagcatgtttgttgtatagcaggagtgtcactttggggacattaccgcatgttctgtcccatttagagagattcagacaagtctatgcagtttctttctattgaacaggtttctttttcttgtttttcttctctcattgtgatgattgaagatcagggaaaatattagatatttgaagatggacattgttttattaccgcttatatttaatatgccctgcatacttcagccaacattcatcatgtcctaacttccctagatattttgctgacatggaaatgcagtggtattcagagaggagctggcatagtggagtctaataccagttttacttgtcttataaagccataaccatgatattgctgaataaatgagactatcaaataagaggtggcaacaagattacagtactgcagaaatcctgggggcagaataaaattgtctatttactaagcataactatttgatataactgtttgatgttatgccttcttccttctcctttgctaaattgctttggcccatacttttaacactgtattctctacttgccagctttataaagtgggttagttgttgaattctactgcttccatgtatatttctatcttatcttcctctgcccgtttgttgttctttcctgagatctcaggtagatgctgaccaattccaaatactgccttcctgggtaggaagggaataagtagaaatgaggtaatgggtatgctgtttctcagagataccttggagcagaccagtagctcttttggctaggggattatgaagtgacatttctctatcatccttcttatttatttatttataagaggtgaggttttgccgtgttgcccaggctggtctcaaactcctgagctcaagggatccacccacctagg

SEQ ID NO: 127275 - DNA, 2371 bp, Homo sapiens
cctcaaactcctgatcctcctccctcagcattccaagtagctggaactacaggcatgcaccaccacactcggctaatttttaaatttttattatggagatgggggtctcattgtgttgtccaggctgctcacaaactcctgggctcaagtgatcccagcgcccgggcctcccaaagtgttgggatcataggcatgagccacagcacaaagaatttcctttctactagaatgcctccctcctgcctgcctcttctctcttcattcatagtcttatcttttccaagcccactttgggtagaagatctactctcaggagttcttataagagaaacacttcgttatgtaaaaccaatgtttctaacgttgccaaactaaaagaagacattttctggttgttctgtcggctagaaagattttgagaaatttaggtcatgcttttatatgttccatttttttctctatgtgcctaatattttatagcagacttttcttgagggcagtggcttgtttataacattctgtaaatagcctggtgcaatgtgggctttttacagatttttttttttttgctagtttttaatatttggattgatatagcatctgactgtactaaccagaaaaatgctgagctagggaactttgttatttaaccttttatttggatttctagcttagcaactcataggtcttgaaaccttggcttctctctccctctgccagaatgcgttaagacctccaggtgctaactgttattatttctgttgactgagccccatatgcacttctagtgctcactgacctatcttttctgttgcagaaacattgctgaggctcttgtcagcaaaggtctagccacagtgatcagataccggcaggatgatgaccagagatcatcacactacgatgaactgcttgctgcagaggccaggtaagaccaaacattactaaacacatggggaacccacaccctcacttttttctttcccagttttgtgcctatacctgagcagaatgtgttggaaaataatatgctgagaaagcatgtattattattctagattttccccatgaaaagaaggacacactttgaacttgctgtctaattttgtttaagtgcacttggtcttccattttaaaaaatatgtaaaataggtatatattagatatgatctccctttgtagctgtataaaagaaagcatgaatgagtgctctataggagatatgtttatcatcattccgggactaactgtgaagccgtgcttatgtctgtagtacatttgcctctgtttcttacctccaaaggcctctactcctagcccctcccgtttaccacctctagaccttttgtcatgtacaaaggaaagaaaacatttattaggaaatgagttttagtttcaaacacttctgacagctggcaggagaccatttgagaagccctgtgacattttacttttgtccttcatccctgtggctggttgccccaaggacatgcatgctgctcagcagtatttctggccattgtcatccctcaaggctcttactcagggagtcttttgtcactgggtagtgtggtagttgagtgattcccagacttcctgggaaacagagcaagaactgagctacttattgctgaactgacttggatagctcagcagactgcttggactcaaccaaaatatatccattgtttaaacgtgatttcagaggcctgcctcactcagcagtttttccatagcctctaggacccatttagttctaggagtttggtaattgtcaggttattttctatagttagaggaggaatgattctgggcacatgttatctaatctcggcttcagattttgtcattgagatcacttctcttgctctttggcccataacattgccctgatatgtgacatttacctctaacaccgtgtcacatcctgatggatagagcatctgtagaatgtcacacagaatgtcagccgagaaatcagtctgtcaggctgctgtggcttttggattctttcttgtgggcttttcccaatagaccctgttgaggacctcattcttaagtacaaagaatccagtgaaaatactcacatctttggttttttaaagctcattaatggtcatttaaaatacgtagttcgtgattggtgttttctcataaacctccttactttcttctctccctacctatattatcagtaagcaagacagtcccaaagaactcatgatgagaaatgtgatcatgatttctcatgatcttggttctgttttgttttttttttaatttttttaattttactttttgtgagtatataacagatgtatgtatttatgggttacataagatgttttgatacaggcatgcaatgcgtaat

SEQ ID NO: 127276 - DNA, 1135 bp, Homo sapiens
ttaatgagcattcatagatagtgaaattttttaagttttaggttttaaaatgaaaacagcctttttagtctagtgcttattttgtgcagaagtaatgtaacaagatgcttgcttgctaaggcagtgagctgcctagagataattgtgttgagccattgctttcagactgatggtgagaaaattggcttcagggtcattgcactgttgcaggttgagtaaacggagagaattaaccacttccctttgcccatgaggcattgccataaggaaatacaggccccataaagaatggggagaaatactcagcatgaactgtgagtgaatttttatttggagcagtcttgtcagtgagccccaggactctaagcctggtgccatcttctcgatgctaacccccaggaaagtgaagtcagattcaagaaagatcagaatgcttgctagataggaatggtggttttgtagccattaaaaaagattttcagtgcagaatccccatcctcatggtttggtgttttgttttggtggctgtggttgttttgagacagggctttgctctgtgtccaggcgggaatgcagtggcacaatcatgactcactgcagcctccctttcttgaaaatggtaaagttgaacacttttcaagaccacttatgtcctgacactggcttatttgagtttgcctttagtttgaagcacctcgttctcctatgaacattccccatgttcccttagcattcttctcacctctctcacgttacagcgtgtcagagctctttcactgctgcttctgccccttatctggccaggtattgaatattatctgagtttagggttgttttttcctagatagattagctgtatgttttctaggtgaactctgctttgtgattttatgcccctgtcaatgcattttctctacctcccagcttcgtgtcctctgcagatctcattagtgagttgtttactccttttctgggccctgaataaaacccctaaacaagaatggctttggtgttgaccccaagtctctcactgcttgaactatcacttaactgtcttttgtttatcattcttcagccactttttaatcttcagcgattgtgtactgaaccaagccagtttgaattaatttcccaa

SEQ ID NO: 127277 - DNA, 1033 bp, Homo sapiens
ctaccagtagctttattttaagaattcctagaaattgttagaatctggctctttgcaggaaaacacagaagttatgttagttcagaagttggggctttattcctttaaggtatcttttaattctaagatttgcaatttcaagatcggatgtatatattcagaaaagaaattgatgctccagcctgactgtaggaaagcaattgtattgaacaacctagtgtctgagcagatttaaatgaatttagattcagtctggtcatacataatgaagttagggttatctcaggagaagagaaaagggcaggctctctcttatcttttcatgtgtattctatttcttgcctggcacactgcagatttagaaaaccatggtggtgtcatccatctttgagaggcaagtgtgaacctgccctcatctcagcatcgccttggctacttctcttcctggtcccctgaaggactcatttttctgattcagcaaaccctctttctaaaaaacaaaaaactagcactccagccttgctgtgttctacatctccaatctccaaactccaaaccccataagcaccagtctcttgctttttttagtgagattggcagtgccctcatattttaggcttctgtgtttgaacctgtaggaaatctgtgctggcatttctgtcacagactttagtcaaaaagctataaacatatcaataactctttctttcttaaaccaatatccctggctattattaagagggattcagtattaattgcatatctctcttggtaacgcagttaatgggggccacagtgggctttctaagttccatatgtttgtagcagtgacttgtaaatatattttgcaattccattgaatgaagagcttccactgggaaggaaatgctcttggtcttccaccctggacttagctagaggagctctcccttttttctgatttatagggaagtttttccataaaatttcaataaatggaaaaagtaatgtgtgccttaaaaaaaaaaaaaagaagaaagaaactgttgactgg

SEQ ID NO: 127278 - DNA, 1338 bp, Homo sapiens
ccgttcttttttaactttggaaatgcacaccccaccctacattttggggttgcagttaagtgtcacgatcatgaggttgctaactggattcagcacgtgtcattatgtgtctgtggagggtttcgctgttggggagtagggaagataagtttttgcaagtggatgtgataacaggaaaatgcattaaaagagctggtgttgggaagtgatttgacgatgcagctgaacgtggggaaatttagcttttccctttcttcagaaaagatgatgcactcaacatccaaatagcagtaatcaatctgcatttaaggcagcacaaatggccacttctggagagctgtatgatgtctccatttccaaatagttttctccttcaggatattaagaggatctgttcactccctccatcccatccttctcttccctccccacccctagttccttctgacataactcatgctgtgagacttttctttatgattcatgaggggctggggtatagctgacgccctttagctttatctcctgtcttgactagcaagccgtgggtagtcctgcagatcatgggtggatgattaactgctggaaagcagtcctccttggctctgttctgtaatcattagtctacactggttgtattccttcagagaggacattgttctaggctaaacttcctacatgaattagccatcaatgtgtcttcccccacccccatccgccaaaataggttcagctatgaccacttatctgtccagagccacttgtctattttcttccgtctcactctcctcttggctaagaggctcttgcttctttcacacaacccaaaatatttgatatgttgggaggttcttgtactgggaatataatttcaatccaaaataaattgtaactataaagtgataacacttgacccttgactttcttgaatgtcttacaacttgcttccctaaaccagtggctctcagaccaggcacatcactatcgctcggaaacttgttagaaatgtgaattctcagcaccctgccccctgcagtctaacacattctttaggtgattctgatgcacactaaaatttgagaagcactgccctaatcagttcctgatcattgtaaaacaaatcaaagtgtatgccctttcatggaagattgatcatttaatcttcattgtaattggaattacagtcgtggttataagtaacagagaacaaggcatggaatggatgagctttggatttctatagtatgtcccagctctttattccccttgactcctgtctctttcccccttcctcagactctgagttcatggctccttaattcgattccttctgaatag

SEQ ID NO: 127279 - DNA, 1041 bp, Homo sapiens
cttaagagaagagcagctttataatcccccctccaccaaatcctcttgcacagactggctactcagcagtgtacagtgtgacttgtgtagtcatacatccccactttaacaaccctcgcttctctcttcatttttgcaccctcctaccccttcccattgtgattcttgttttaatcggtttttctcttcttccttaacagagctattaagaatggcaaaggattgcatagcaagaaggaagtgcctatccaccgtgttgcagatatatctggggtgagtcgagtccctgaatcaagctgtgtggctcagaggctcaagagcgtgtctgcatatttgctgaaggacttcagcttatgtattttctctagctcgctccttttcaggcactgactgtgacttttccccaccccggggcatctacttaggtatctatagggagcctgttttattatctggaaaagcagaattaacttcattctttttctttacctgaactgtttctatgttgctttttcatttttaattactgtattttgagtttggaaggtagttcttcttggttgtattaaaataaaattgcctctttttaaaacccctgtccagttcttgctgtgagtgggaagtcttagtagcaaaaggtcaagtatagatttcaggagaagtatatgaattcatcatgatttcctcatgacctcttgttcctctgcttgcctgtaagtgggacagaatggagaaatgtatgaacatcctttgagataattacatatagataataaagaagaatcaatggcaccaatattttagagctcccaataggctgtgtccaaatgtttctttaactgtaaggactttacctttgaatgtttagggtctctttggctgcatagatccgtttgatagttgagctagtttattcatttagtcaacaagtatttgttgagtgcctgctgtatgccaggaattgctctaagctctgagaatataacaatgaagaaaactactgaagtccctgcattcaagttggaaagggaggcagttgca

SEQ ID NO: 127280 - DNA, 1042 bp, Homo sapiens
aaagctgttatagtaataaaagggcaaatttttggtggttcctcagcaggagaaaaaagttataagtgctttggaaaatgcaatgaaaacccgtctacacaaagggccaaatatgcccatccaaaaacttatgtggggcccatactccagggccttccagaagctgatttcaaccttagggataggctctctccttgggcccacctgagttcatttctagttctgatttggcaccaacagtgaggtgaagcaactctaaggaggttttgaggttcaggcacaccagtctcagggttgtcctctccacacccctcagtgtggtatcctaaagatctttattgctgtctctgaatcttatgctgcctcctgccttgatgatttctgatgctttttttattcctttatttccgttgtcattagcagtgggtcttgtgaaacttgtcttcatttatttatttacttttgttcctaccccaccaattcccccttaaactctagctcagtttcataccaatttttattatcttttctgtctcagtattggaggattggtttgctcttaagttaaacataaatgccaattaaatttctctcagtcaccacataaataaaagagtaaagcttgagcaagtgggagactgaaagtgaaaaagctgctcgatttaaatggatgtcagatatgaccttgtctgcctgaatcacaaattattcacctaagagtgcagtttttttggtgccctctttaatagaggagttttgtcttttcccaccttcttcccttctttccatcacagtgttaagtctgtgtgtatgttgggtgcccttgttcaatttaagtgagatgtatgggttttctgcttcctgaagcatgctggcaattttgctgtctgtgggacaggtgtgaggtcagatgggcagacggcttacagccagatgaaaaataaacagggaaaaagacaatgtaatgcacatatacgtaatggtttcacagaggtttcttaattgttttttaatctttaactgtgttacctactgccccaga

SEQ ID NO: 127281 - DNA, 1122 bp, Homo sapiens
gttggaagtgactcatctaagcacaggagtgtgaggtttatggcttagaacgtaagataccagcctctgtagtggccaaataagccggcctttttgtttgttattacagatgggttttgatgtcaaggtcaactgagttttgagttgtccataagatggacagaacatctgcatataacaccaactgaatgaacccccagtttgtctagggctttgataaaaaatttggccctctagaccgggcgtggtggctcacacctataatcccagcactttgggaggccgaggtgggaggattgcttaaggtcaggaatgcaagaccaacttggtcttgtagtcagtgtagtgagaccccatctctaccaaaaaaaaaataataataaatgtgtgtgtgtgtgtgtgtgtgtgtgtgtgtgtgtgtgtgtgcgtgcgtgttgacccatctgcgtctcttacacctatttttagggtaaccactaaaggaagaaaattacatactcccaagctggtaccttagatcctgaagaagttactggttttttgttatttccaatttttcacagagtaggaactgggctattagaagtaccagccactgctgccatttctatcatagtctagtttcctttcaagccagggtgttccagagtgtgtagaaccagctgagaatttgaccgacttggtactaggtcttacttgatttgaaggatggttctgtggtgactgacttcatacatacatgttttcattattagttggttttgtttttcattgatcctgtctgagctccctccctcaccagcatagaaaaaattggagtatgtgtgtcagtgttctttatctcaggtttctcagctgttctttatcttaggtttattattgtttttgctgtagcctgctccgtaataaatacaatctcctgcagatacagagtgtaaaacaggcaataaaatggggctggtacatggcttactgttgttctggtagatcagacaaatcaattatggttctgagattagagagagctccccactcctcaagttgcagccagccctgcgagtgctgattttaccatttacctttacctccacttctccatcttcctcttatatgggagtagga

SEQ ID NO: 127282 - DNA, 1226 bp, Homo sapiens
tatgagttaggtctgtgttaaattgcagtttttcttatatgttttctggcccacctagtttagatttatttttcttaccctcatatgattctaatgttcctttcagctttctgttttttctagtctctggtatttgatggcacaaatgctctctgagtgtatttgttttttgttgttttaaatagcccttcccttttttaccccacttggctaaaatcatggccctacatcatgttctcacgtctctcttgccaactgcagtctaagttattgtacagatggcacaacatcaaggcctatggttctgccgggtgggtttctgtgacctggaggggttgcctagcactggagcttcattcacacagtagctgctggctccactgctgggctctgcatttggtatccgagaaaatcccaaaggaactctggaagagccagctcactgtctgcagaacttgctctccagagcaggcagtgtgtcctctctaaatatggttggccccttgcctggaagccatggttggtgggagtgttgggttatcctggtggcttccttgcctccctgttgtgtttcgtagctcaagttgtcactaatttaggaaaagctattgctctatttctttcttcttctttcttcaagcaaagtttattgaactctagttggactacaatgtacaggtgactggcttggatcctcactgcacagaaacatgccatcacctctgtggcacacaacctctgatgccaaagtggcagccacctcgtaagtttctcccagactttggaaaaaacttcaaactctttctctttcttttcttttctcttatattttcaatttaattttttatttcaaaaaaatagagatggggtctcactttgttgtccaggcttggtctcaaactcctgggctcaagtgatcctcccacctcagccttccaaagtgctgggattgcaggagtgagctaccatggctggcctcttttctctctctctttctctcttttgttgagatggagtctccctctgttgcccaggctggagtgcagtggcgccatctcagctcactgcaacctctgcctcccaggttcaagcaattctcctgcctcagcctcctgagtagctgggattacagctagtttttgtatttttagtagagacggggtttcaccatgttggtcaggctggtcttgaactcctgacctcatgatctgcccaccttggcctcc

SEQ ID NO: 127283 - DNA, 1547 bp, Homo sapiens
agaaactgtgtcttatctctagatctgtagtttttaggagtttcgtaacaataggaaatgcatacatgtacataatgatggcgtctatgtagttttgaatgagtgaggaatcttgagggcatccatcagcaagtgtgcactgatggagaaagaaatgacaatgatgtgagatccttaactgaacaaactaacttatgttatcttcaccaaagctatctcaattctctgccatcacttacgcactctgtggtacatcattttccactgatagacaaggtccttagagtctcaattctagaaccccaatataatatccacatgtggttacatcataacaaagttgtaaagccactgggtggggtaagattaattctatattttccttaagaagaattagaattcccaaatacaccgaaagcactaactatatttctaactactttagaagtatcattctgtaaaagtagtttcattattgtttaagcttgttttcacgtatttgtatgcatgcatgtatatgctttattaaatctatttctgagcctgactgttgggcttttacaagttgctctctttactaggaacaaatttttattctcacatcatattaatgtgtggtttttgtttgttttctacccattgtccacactcttttttgcgcgggtagctgtgacttcaggcacactaccacacctggctaatttttaaaattttttttgtagagagagaatctctatcctatactgataggatctgctatgttgccagagctgatttagaactcctgagctcaagtgattctcccacctgggcctcccaaagtgctgggaacacaggtgtgagccactgcacgcagccacattaaactcttagtccttagaaacaggctacttagtttggtgtcgttagtaccataaaacactgtgcttaaatctgtttttgatggaatcacagagcaaatttcacatgcagcttcaggtcaaactgtttccacatcagtttacagactttattatagcatcaataatatttatttgtttcaaaatatgtagaacaattaattataagaactaattcactgcagtgaatgttgaatgctgacacttacaaactaaagggacaattagttatctgacctttaataatttacaagtttatctaggcaaagcttaatcggccatagattttttctttttttttttttctttttcttttttagacagagtctgactttgtagcccaggctggagtgcagtggcgcaatcccagctcactgcaacctctgcctcccacaagttcaagtgattctcatgtctcccgagaaggtgggattataagtgcctgccaccatagccggctaatttttgtatttttttttttcagtagagaagggctttcaccgtgttggccaggctggtctcgaactcctgacctcaagtgatccactcgcctcagcctcccaaagttctgagattacaggcgtgagtcaccgcccccagatgactttttttcttttagaaacaaaaccttaggcatatttttcttta

SEQ ID NO: 127284 - DNA, 1006 bp, Homo sapiens
ttcgtagaatattttagctgaaaataattggaaggtatacctcccagtgttaaactctcctataaacattttcttcttacaaattggtatttctgaaccactatctcttattcctgtgtttgagtagatacaattaagtttcatactaaaataaattttcttcacatcattactaaagcattcagttatttcaaaaatatagtacattactatactgatgaataatggaagaagtttgtctgttgattcaacatattcaagagtaggatagtttttctcctgaataaaactacaaaatcaatagtggatttacttacttgacctcaaagagataagacattttgtctatgaaatagtttatagttttttgtttgtttgttaaacaaaaatgaagggaaataaaccaataaagcagaaggcatggattgaggaagcaatctgggaaaggttgtgaaaagaattgccagagtcttggtcaaggggaatcctagcaagccaccctgcagaggtcgcaggaggatggaagaactcttgggaggaagctctctaactggagggctatcatttacaaagccatgatactataaacactgagtattgagttaacaaaaaattgtaagactagtgtgttgagaagttagagtatggaaaaaaggggaaaagggacagtttgggatgaggtagggaggcagatttattcatggaagcttttctatacagcaagaattatgagccatacctttcagatagttctgtgggttggcagccctcatcacctggcacctttggcactgccttgatagctgcctctcacccaagttagagaaagaggattgaagacaggaagaaagcaagcttatgtgcttgatactttatcctaactaggtatattcttatttccgccctttttacttgaggcacagatacaccatcatctgcactttctgtgcctaacttatcttaacaaaaaaaaaaaaaaaagcattctctagaataagccaagggc

SEQ ID NO: 127285 - DNA, 2311 bp, Homo sapiens
gatcccactgtgatggccaggctggtctctaactcccgggctcaagcaatgtttttgcctcaggcaaaacattacaggcatgaggccaccgtgcctggctcagaccattttctgagggtccctaatctattcctctaacattatttcactttatcttagtgaactgcggtgattgtccgaatggtgctttgcatgttttcattctaaacatagagatgtgtcttctcttcctaagtatttgccaagttctggtttcatttctcagtattgtacactgtggaaaggaagaaataaatggtgggtaggaccaaccaaataaaagtgtttgtagatgtctgactttcttagggctccttaaactcttagatgatttagttccttgcaagtctgattggagagtaattgttttcttccatatgttggagtgctatccttgcactactttgccctgtggcttccttcttctagttgggcaagcataccattcctgccccctttggaaactttgcttagccaggatatttcttttaataattgtaatactctctgttgagggcatcactgattggaatgatacatcctaagctcagggctttcttccagcttaatgctcctacagatgtccaaatgtcctcttgactcatgctcccagaactggagctcagagcctgggctgcggtttctcctatgttcaacatggtgcaggcctgagtgaggtgctttaccaaccaagtaaacagtgtgagaatctgtaaaccacagacaacacttaatgattttccattttttaagagacaaggctagagtgtcacccagggtagagtgttgtggcatgattatagctctcggcagcctcaaactcctgggctgaagcaatcctcttgccttagcctcccaagcagctgggactacaggcccgcaccaccatgcttggctaatttttaaattttttgtagagatggggtattgaactcctagcctcatgtgatactcccatctcagcctctcagagcgctaggattacaggcatgcgccaccctgcccaattattgaaagataattgatggcctagctttagcaccttttttttctgttgtaatttttttgtttgggggtttgtttttgtcagtgttctcctctgtgttcacttcattcctgttaaacttgcaattcactgaagtttacgccctccctggtctctctagtacacatctcaccacaaagcattgataaccagccagggaagagcagtttcaaatttgaaagtgctttatggtaacacaggagctcgagggcattctcagagtatcctccccccgcagggttccatgtatttcaagagatgatcatgctgtataactggctcttcatcgaatcataaactcattctgtgaattaaaatggcacttggggccatagcgcccaagatgtggaaaggaggaagagtgtggagcgataggtgatggttttgccttgctgataggagatgtagttgtgatttgtcttccatatagccacaaaagtaattctcctggtctgcacaacccagaaaaacatagataacgatggcagtgaatgatcaccatacaccatacaccatacacaatacacttaaaatgagagagcacatttgcttcagtatccttaacgatttgttctgatctccacactcttttttttcctgtgtctgtcctcttgttcacaaggattttgctgctttagagcacatttgcttcagtatccttaacgattcgttctgatctccacacttttttttttttcctgtgtctgtcctcttgttcacaaggattttgctactttagagttaagattggttagacccagacagcactgtgccctggagtcctttaccctcaggtcagccctggtgggaccaagcagtacagagagcttcataggaagaaacatcctgggatgggcagtagagcatatgcttgcacctccagggaggcccatcaggattgatgggcttctttctagctgtttctcaagtgctggtagagtatacttccccagtaataagttctgcatgtatttgtttgtagttcattttcctgtgatgttaatcaaagattgtgatgatgagaactaattcgtgatcttcattattaacaatttccatttgagtcttgcatatgataatcctgagtggttaattgttaactaataggtttagtctattcccattttcccatgctgttttctgtgctgttatgtttacctctcaccagccctttctagtttcatgcctactatttggggactttcattggagaaatcatgggaatca

SEQ ID NO: 127286 - DNA, 1022 bp, Homo sapiens
atttctggaatagagctgttgagttgtgcattgagacttaggaggagtcaggaacatgtattgatttttatgacatgggtagcactaaggtccctttgaggctccttgattattctcagtctgagtaggtttctctctttataaagtaggtaagagtttagcaaaaaaggaagagagggtgctgcaacctccttgttagtttaaacatgaaaggcatgcctgtgtgtgtgccattgttattcctataagcattttttccagataactacatccaaaggatagtgatgagtagaagtctatttctgaaaaatgtaatttgctctgatcttgaggaaaaagaccttctcttctgagatgttaggttgcctcatgatttgcgataatcaatttgataattgttgttgacttactggttcagctcatgaatagtgtcccagatttagactagtatggcacaaggattttaatcaagtagtgctttctttcccatggagcatttatcttgtttgactgttctggacttcagccagctgccagacaggcatttttcatgtgtatatgtgtaggagaatgtgttgcttaagtgttcaatggggaagtttccaaccccctaaagctcatggttaccttgccttttaccactgtactgttagagacactgagaatggatcgctgtctctctttttctctaagaatccgtttgatgggaagcatgaatcttagttactatgaatactgttttcatcccagcctacctcactgcttctgaatgagaggagcccctttggctgctctgaaaactcttgaaatacttgatggcttgttatgttttcattatctaatgtgcattaatttaaataaaatagctctgttgttagaagaagagtcaaaaaggaaaagcttggctgggtgcagactgcttgtgtcacagaagtcaggaaagtttgcagaacttggtgtcctcagagggagttttcagttctgctggctgggctgaaaacctgaaactctaaaatccagtg

SEQ ID NO: 127287 - DNA, 1082 bp, Homo sapiens
tcttcctctctggttgggatatgcaaacacagtttctagattggatcctcctgtgcctgcagacccagcactgcaccccctttctgctcctcatttctaccaagcacaggatgtaggagtagagcaacttgcaagcacgcagcccttatagagctagagcaaaggaagttccagactaggaaaataccagccatggaattctcagagttggccttcattacccacttgaaacagactgcccatgctatgttagttgtggggaggcctcagaggagccaagacactcttcccctgtagctccccaagcagtgccctttgtctccctttcattcttttcaaatgccattaagatcccagtcctttatgaaaccccagccatgacgttgctttcacacgctcttcccacatcgatagtatttcttgttgtgctaaggttgacgtgctaaggcaaagatgctcctttctttgctgacttaatgtgtgtcttaccctatcttttctggtagcttaatatttcacaagccagaaggctatgtataaactgtgctctttgagcaatttacatttatgcattcaaggaacaaactgcttcatttctttgctgctggcaaataatagttatttatttccagttggtacttcacagagactgcagtctttgagggaaagctgtcattttacttccaccaccacccccaccccgcccagccacccttgcacacacaaatattcattcacttgcaaaagacatatcccgccgtggtccccagatgcacatggtccccaccttgccttttttgctagtgtcctgttgtctcagcacttcttacattgaattactgaatagaatttgctatggggaaagagaaacgggagtcatgcttgctgcctcctgccagatcgccttggcctccttttcctagaaggcacaggtagtttcttgtctggataagggtctccctcaggccccaactaaatggattgagttatgagagataaatcactccctgaacacatgaccatggagctcactgctgctgcttggctgtcacttctcattgtggctcttgtacatactctta

SEQ ID NO: 127288 - DNA, 1281 bp, Homo sapiens
taagacagtcatgagatagcattcttctggaagccaagggagtgaagaattcccaggcaccagcagtgtcagagtttacataaaacatcaagtatataaaaactgtaaagggcttttatgctgtttatcaactagtaagtcacaggtaacctctcggtacagtttcatcagagttgagttgattaaaggtagattacaggtgactgggaagtaaaagtgggaagtaagaaacagacttagtaagtacagattgcacttccctgatatctaacagagaatggaaaagtagtgcagaaagtaaaagccaaagggtgaaggtaacattccgaggatgtcagcatcttgtgcgcttttagaactgtaattcttattcaagaatcaagaaggtatggatagctgaaaaggctattcagtacacctattgttttcataatataaattttagaatgtaaaactcaacaaaatattggcaaatgaggttataaaaaaagatagagtgagagattatcctggggaacatgaggtttgaaatattgagaagcactcgtctgaattctgaagagaaggaatcaggaaaggctgcacagggataatgaatggagcagtgacctagaagaagcagaagggatgagatgcatggagaacgtggtttgagggagtaggcttggagagagaaagatcccttggtcttttaaaactacctacaaagctgaaagtgagtaggcatgctattcatgttgtgggattgttcgcctgggcagcgattgtcctgctagagctttgcagatatctgccgtatgcaccctccattatgtaagtgtggcattctgctggaaatgtctctttgcagtaaggagggggtttgggttgtgattctcaaggggaaagtcaagataattattgggagcagtcccttatgtgctgctctcattaatcccagccttttggagagccttctgtacttcaaggtggggtggacactttccatttttatgtggccttttttcaggcagacggccccacagcttgatagggagtggcatttggcccaagccagctggctgttctgtcacggttcctgcacccctgtatgtagaatgatcgcttggtcagatgggatagcaggtggggctagagaagtcagctgtagccaacaggtcagtgcctcctgaacgctcttgccctctagtcctttaagcacctgccttaggcttggctggtgagcaggtgaccttacagcatcagaactgagactgttcaaggtctctctgcctgctgctg

SEQ ID NO: 127289 - DNA, 1046 bp, Homo sapiens
caccatgaatcatccccagaatgagcctcatcatacttgtgggtcattcaattacatggttatttaataatttttttttatattcagtgggcacaatgctaggaatacagaaatggatgatacagttccagcctttgagcaaagtaattgtgtctactggagtaaagaatgtattgacatgaagaaaaaaatattttaaaagcataagggtaagcaaaacatggcttaaatactatacaaatgagaacagctcagattttataaaacaataagagtaaatatgtaactgctgtcaaaaaggctgtttcaaaactcggaaatacagaacgcagagaggagtggagccaggtactgacccagcccaagtcattgcattcctggtggtacggtgtaccatctgaggaccatccttttaggaaggacatcaggaaactgcaggtggtcagatcagaggaggatgaacaaagatgctaagagcctcagcatgccaatacctgaagattgggagtaggaattaaaagacagacttccatgacataatctagtgtttcagggtaaaagagagagaaacatgatttgttcagtacccattccagagtaataaataaagtcatcactaaaaataagatttgtttggcctggtttaatggcagtcacagaccttggagctaaaacacttaaagatgaattcttgccctcctgcttcctaattaattatttccgtcagactggcctgcttatcttggtgtgatgctggtgacctggaggtgagggagacagcaaggccgatgtggcatttatgtgccagcctatctagggcctcctataactagcaaaagatagtcctagtggtgtcatcgccttctatggagtcagactgtggaggatggtgtggcctcctgattggggtgttcagcccttaccatctactgggttttatgtgccaagaaaagatagatgttgatttacccttgctgttagatgataggcctgtggattagctttggatgggtaggtcagtgaggagtttccttcctcctgaattc

SEQ ID NO: 127290 - DNA, 2083 bp, Homo sapiens
ccctgtgggggagtccatttggtcagactaatagtagaaaatggcaggacctggatgcaggagagggagtgtaaatggtttggtaatttgaaattaaaggttaatgctttgaaatctggtaatgggcagcgccagggtgaacagtgcacactgctgtaagacttaatcctggttgctatggaaactacctcacaaatctcccacccctttcaaccagatttgactgggtttaaaaaataaataaataaaaccattcttcatcattgaaaagctgtttgcccccttccccaaactccaggtcattgctcaccttgagtttctttcaaaagtttttctgaggcttccccagtcagatgggctggatctgttagagtttgggcctggctctttgtgtggaatttgaataaatagcattaacatgggaattagaagacacttaagtgtccaatgtgggcagcatgtgcaagcttgctctcctgctggccttgaggaggcgtcatagtttcagtcctggcactggacagggccactgaccacagaatgcacttcctcattccccatgtatggggggctctgaggaagcccaaggagctgctcttcgtctcagtgctgtggagtgttcccagattctgctgcagggctgccaagcactggcctatgaggagcaagaacaatccacagaagttcgtttcatgtttggaaggcatctgagacacaactgcattctctccgtcattttatttcatcattagagctttttccaatttacttaaatgaccctcttaatctagaccttgtaagtttttgggctttttttaaccaaagcttcttcaccctttgcctatgatgaagtaaatgagatctacatctcatttggctccctgcaagattagcttataggcttctaaagtaggctttgtagaaaactttctattcaagctttctggattccctgtagtttttccttaatatacttattatactctgtaatgctgttacaatagcattcctcagtaaaccctcgtaactcccatgcttacctttactatgagtaggaaaatatttaaatccactggttagtctgcggctggtggagaagttcccatttccctgcccttgtgtgcctccttttcctgagcttgtacatctgctagtgatttttctagggttaatttgggtgtttttatttttaaattggaacatggtgtctgtctcttctctgtgtgtgttttggatgcagcccctgtgctaggcatgcggttattaactccactgatataccagttcgctcattagcatttgcattttaaattacaagctagagcagacgacatttatgctatatttgtaccattgccttcttcatgaatgatgtcgtatgtgcagggaatgcagaaataactcttctaaggccctgatgtattttagtctcttttttagcaaactgctatttcttttttactcttgattcttattgtttgatagggagtttttttttttttttttttttttaaattttccaagtttagacctatttgtgagtgctactgattgggaagtgctaacgacagaccagcccttcatatcaaaataggcatattgcgtagagtggccatttttccctttcacgtggtgctccttgtaagcagcctgccttgatttgagaggagggagttttttcctccacagtttggtgggtgggaagacatggtaacagttacttgttcttgctagtattcttgctcacatccctcttttttatagttgactagtcagtggttatttaacacctgttaattacttgacactgcaaggggaaaaaaggaaatagtgtatgccttcaagggtcttatttttgacaagcatttatattgcactacagtacagcatatacttaaatattaatattgagtgtaaaataccaagttagaggtgggtcttttaagtgagatttgccaggagcaaaggtctcgtggagcagccgttgctcttgccagatggtacaatagcttcagcatctgcatctcaagaactgaatcagaaatgcacagtcatagatcatggatctgtgactgaagccttc

SEQ ID NO: 127291 - DNA, 1049 bp, Homo sapiens
gcctcattgtgcctaacatagtgtctggtttctagcagcaggatgagggcagaaagcgagctctggtagataggtctgtgtttgtgccattttgctttcctctgtgagctctaattttggttctctgagttctgttgcagagtttcttcctgttggtgaatgctaacttttaaaacatcacatgaaaaatacagggaagtcatactggaggtaaatgtgcattgttgttaggcaagcacaaattctgcagttgatagaaactatttttatttccccactttctccctaaaggttttctctgatataatcttcattcttctaatagctgttggaataaccaagacacgaagagttgcatttgatgctgataatccaagtacagatgatacattaattcagaacctgatccctttaaggagtctcattgctgcacatggcatattatacattaataatatggggtaatagcattctgagcctcttacgtggatccatttcatgctatgaggttggcctcacagtgaacattgccatatcatactcactccttattcccttaaagaatacatcttactattggaatgagtgctgggtggttggtagctttggttccttcaacacagtagcacttgagctgtgccacttcacaatccagttctacttcatgtttgatacagctttgtatatttcttttgattctattaatcattgtaataatttcttacctggaatctattgattcatagtttctaagaaatccatacacagcacatcagagctccaagtggggtccaaagtcatgtgagggggtccttagttcccacctcacctcaatcttcacattagttcattttccataaataaaaatactcatgaaattcttttgaaaaagtgatgggcaggaggacaagacaaaattgataaagaattgttacctatctctgtatttatcctacgaacgtggtccattttgggtccattgtttgctgtgcccttctgtgtcttccatgaaatccaggctccagacataggcctttgtgcttcaatct

SEQ ID NO: 127292 - DNA, 1029 bp, Homo sapiens
agtctccattttgcagatgagaaaactaaggcctgggaaagttaactcacttactaaataaatagcagagcatattttcttgatctcctcatttagaacgcaatgccctaattgacattgaacatatttatctccaggtaacaagggacctttccaatcttccctccattcactgcatctgcgtgtactctcttattggctaggaatcaatctggtactgcctttcttttgggatgatcaaaagcaaagcataagaatgggacagtggcagtgaccctaagtaggaagtgtagtaatgaaggtatgaatttttagttgtttgggggtttggatttgttttattgtccccagagatgacaccaataggaacatatctaagatgagagcatggctaagacatgtgatcatagagcaagagagagcaggtcagacctgtgggatgggtttatgagctggggcatttatggataaattaaactttagccctgagtaagcaaagtcctaagccagttattactgctctggcacttctaatgggccctatgcaacccttataaattattcagctactttattaataaaagaccaagcaacttgcctagtcctggtgatacttaagtgtatagcttagagagtgcaagttagaggaatagaatatttgccatccaccaaggaatcctcttttctaatatggaggtgaaagggttaaactgactaccttgaagagcagagttttgagatagagtacatgaaactggcattgaaatgttaacagtgtctgctaaaaaagggctttcctctgaggaagtggctgttgagatttcctggactgttgcatctgatgcacctttcacagaatggcatgactatggcgagtaagtgtcccaggagatccaccatttaagcctcaagttttttatttttgtttttaataattcttatgcctctttattttgatataattttacacttacagaaaagttgcaagaatacaagtacaaagatcttccatttaccctttattaaatt

SEQ ID NO: 127293 - DNA, 1028 bp, Homo sapiens
gcttggatttggccccagcacagggtgaaatgtgggttagatcctctgaagaaggaaaaggtgcttccctcagcctttgtcagcactaatggccagctgtgttttgtgctctatcactttgttttgcctttcccttgtcatttggtgagccaggctttatgctgaatagaagataaagagtgcttatcctccactcccttccctctcagttctcttcctctcactgtacttgaaagaaaactggaatgctgggacagaacttcttgatttgccctttagagtagaagctgtaaagagactgtggtcaccaggaccccatgagctttaggatcccaagagctttagaatagtgctttccaaacttatttaatgggtctggagttgggccagagaatttgcatttctagcaagtttccagacgatgtcaatgccagtgatttgcagacccctcttttgagaagaaagggcctagacttccctccccctttttttttcctctaggtttgggaattacgaaatattcattgtatacacaatgcgttaatggctaagagaacaggttctggagccagtccccacctagtctaagtttaggctccctaacttgctagataaatgaaactctcagtttccgcattaaagaagtggagaaaaaatagtgtcattgtgatcagcagatcatccttgtgatgtgcctcttatccggtgacacagcatttgtatgatgcaaagaaagccctaagtggccatttcgatccagtacttgatacatgaattgaatcctgtccacataaatgctattgtctgggaaggcctttgccttatgacattttagggcatatccttgaaccaatactgtacatgactttccctcccatccatgaaatgaaactacagtcctgttacattccctccctcctgcccagattcgcccttgtttggtaagaggtgcagagctcttagtgtgcatactaggctggtctgtcattgtggccacatcttacagagatgtaatggtggctgcagat

SEQ ID NO: 127294 - DNA, 1061 bp, Homo sapiens
cctctcctttcttgttgaacagggcacatgcagcttctctgtgtgggtgacgtccacataaggagaatgccttatttattttaggtccatgagcttgcgtaatgtgcctatttaacaccctcctaaaagcgcttttcagcacatgagcaagtaacgaagcccactaaatcctgcctcttctgggcacactgggctgtttaaggttgttcctgcgctgtgtatttatggataggagctggagttatgacatttatttctgttggttagggcactgatatatatctgcctgcatctcccatggagaaccgcaccttatcttgagagagagatgagagcattcccataactcatcctgccaagcactgggactgtcagggtgggaagctacttctctccccctagccagtggagttgtgggggggtggtggcacgtggttatgcagagagactttggtggtaaaattatctaggatttaaaacaggagagagaaaaatgtagctcctaataagctctccttttgctgtcatgctttgttcaacctgccccccagtcccctttctcaggcatatcatcagcaatccttggggtctatagaatcagtttattccagtcttttgctctgacaggattctgtctcctaaccagtcttcttctgttctcatgacccttctggcctgtctgccttgtacaagggagaccattctaagacacatatctgctcacatcatgccctgcttataacttctcatcagttcctttaccttcaaaataagacatacatggccttcatgatctataccctgttcatccttctagcttcgttacccacattcccccaccatccgctcttcctgagcaggagcacttgaagagtccaaaactagtcttactggcctcaggcatctaaccctttctgctctctacttggaatgcctgttgccttctctctttttatcatcacctcccagaacctggtgtaagtaagtatatggctccaaagaaacctcagtttagcatacatgtctctcttcctctagcctgtgttccttgtttatctcca

SEQ ID NO: 127295 - DNA, 1282 bp, Homo sapiens
tgtgtccattctcaaccagaataaatcagtgcaaatgccagtgtccactccctcgccagacctttgagacctagttggaagaaaaagggtatattttatcaagctacgtgaaaatcaacaggacaccctcctgcaacaacagagttgccctttgttggccgaagcgcctcttatcattacctgtgagagctgattggcctgaatgctctcagcacctgccctgtgcatcacgtgatcggatcctataagtatcctaagatcatattgcacaactcttagaaatgagtgagagaatttaaaggtagaacagctacattggtacacataatttatgccttttcttgaggttactaaaaagaaaaagtattccagagagttctaatataaagctgaggaactctttgtataagggagtatgatgtgttctctctctgcttggaattgctgtgctggaaggaagatggggaaagggaatgaatatagtcaaataaattaagccttgaaacccaaatagtgctgtgtaagcaaactgactgcaaatcaaacagaggagtgttagcaaaagaatacacgatcttggttgaggctgaacaaaaccaggttctttgtatatacgtatatatttctctggacgtgtgcagagttgttgcatttctactcccttaatctcagacatctttggcaaaatgtgttatctgtccatgaagaagaaaactgaagagtgtatttcccccaaatggcaaagcgtaggctttatcaaatgtagacatgcctgttggcaacagaaagcaggatgtgtatggcttttctgtctttaggaatgcccatgtttcctatgtttcttaccatttttctggctagcatataaatctgaaaggttaggttatggtgtgggtcataaccatcaggcccagtctattctccatccccactctgcaggcagctctgacactatttctggagcaagcattgaaaactatccgactgtctggttttgtagatgaggaaacagcacaaagaaatggagtggcattgtcatagttacagactgtgtgagtggcaaaacagaggcttcatccactggactttcagctctacaacttgcaatcaggcataacatgttcttaacttgcctttttgaaatgacacctctctgagccaaagcttctctaagcatcagttcaaatgactccatgatctcttagagtctgtaaaaaacttgagagtagaacatattttcttccttcttagaacctcaagtcaaatcaacaattactttata

SEQ ID NO: 127296 - DNA, 1873 bp, Homo sapiens
cttagaatcaagagtagcaggaagactggcttgtgctctcccaagcataacacaacagatccaacatctcctgaactgggctgtggttctcagaagaaaatcaagggccctggcagggcacatatagtttgtttttgcccccaactccccaaatccttggcttccttctattgtaaacatctggagcagaatcagcaaccgcccccacagttgtgcttgaggtatggtcctctgggcagcttttactcagtctttacgactcaactccatccagagttgcctcctgcacgtccttctctacctcctctgtgttcacccaccatcttttgctgcctctgctattgcctagtccactacctagtaactgttcctttgcctggagttttgacactggcaacacagtggaagtaaatagttggtggtgggtaggtgggttctgagtcctgaggaagaggattacagtagaatgtacatttctctggttagtcattacgggtgccttgaacctgggaagggaggaaggtataccgagctgcttccaccacatgtccaagcagaaccagctagcccgctttctgtcccctcaaacactagtgcagtaacgtgctgtatgggaagaagtaaatgatttaatatacagatgcctggtttctgatcctggctccattcgctcgtatacaaaatgagaaagttatacaataagaactccagctttaggctgggcgcagtgactcacgcctgtaatcccagcactttgggaggccgaggcgggcagatcacgaggtcaggagatcgagaccagcctggctaacatggtgaaatcccgtctctactaaaaatacaagaattagccaggcatggtggcgggcacgtgtagtcctagctacttactcgggaggctgaggcaggagaatagtgtgaacccgggaggcggagcttgcagtgagctgagatcgcaccactgcattccatcctgggcagcagagcaagactccgtctcaaaaacaaaacaaaacaaaaaaaactccagctttgtaaattcagtgatatattcctttttgagggatgcactttactgtattcatttcacatgtgaattttagaatcacaggaacagtctcaaattctggatatgccctttataatccccgtgatctaggacaacttgcttaacctatctttgccttagtttatcttctataaattagagtttctctaagtattacctagcatgatgcctttatttaaaaagtgcttgatccagtgccctacgcagcagaagggtaatttcacattgtagtcattattgttatgtgagtttcttctccagtagtctatatagtcacttgttgtactttaaaaaacttttaattgtatgtgaacctagttttgataatacagctatttcctatgtttttttaaagtctatcatagtctatcagattatctgttcacttgggaaaagacatctaaaaacagaattcctttggataaatcaggtaacctaagtaatataaagttcattcaacctgaactgacaggatacagtggaaagaacaactgcccatcaaaagatagggtttataagctgcattttattgccaagttgccatgtgaccttgtgtaagtcattgaacttctcttatttccagtaacgtcctctgtaaaaataaggagtttggactcgatttctaaggttctttctccagctataacattttgtgattctgtgaatgcttaggtgatacatgaagatgtctttgctgtcactgtcttttcctttttaggcagggaaactaggaaagataggcagtgtgattttctttctcaagtttttttttaagttctgcgtgtcacagaatggtagtcaaac

SEQ ID NO: 127297 - DNA, 1049 bp, Homo sapiens
cctgggatcaagtgatcccctgtcttggcctcatgaagtgctgggattacaggtgtgagccacagcacctggccctatctttgaacttcagaaatggaatcacaatcttagtttacctttttttcttgagacagagtcttgctctgtcacccaggggcccaatctctgctcgccgcaacctctgccctctgggttcaagcaattatcctacctcagcctccctagtggctgggattacaggtatgcactatcacacctggctaatttttgtatttttagtagagacagggtttcaccgtgttggccaagctggtctcgaactcttgacctcaagagatccacctgtcttggcctcccaaagtgttgggattacaggcatgagccaccgcacctggccattttacccaactgttgtctatgagattcatccatgttactggatgtagcagaaagtcatcttttttcattgcattatgtaattttcaaagatccctttgactgctgtatggagacaagattggagagggcccaaatgaggtgaggaagtctggctgggaggtggttgccatgtgtctgagaagaggtgtgcagcctgcctaggccgcagagtgggaatgaagaggaaggagcagccctgtttaaggaggctttaaacctggttggtgctttgatagtagagcatgaggaagagagaggtcagttttctggcttgttaataacacaaggtttgatgaggtcagttttgacaacttggatgttagatgactgtgagtgtttgcaggtccagatgaattcaatagaaatgtcagaaatggagattaaaactttgagagtcatcagcttatagtggaattggaagcacagagagcaaatgattgcctagggactggatttggagtgggaagcagctaagaacagaccattgtgatgttcggaggcttctgaactgtcagaaaagaggatctgacagcagaggcttagattgagaagaggtaggaagggcactaggaggaagggcaaacaaagcagccaagccaagggcagaggag

SEQ ID NO: 127298 - DNA, 1043 bp, Homo sapiens
ggctccctttggagcagcgatttcattgccctctctcattcactacctcgggagccatttggtttccaaggagatacagaaatgagcccactttttatgccggtccaaaatactgacattatttaggtgattgagcttcttcagattccaggctgtctaggagaattccccttccaaagcattcacctttcctcctgactcaggcatgaacagctgtctgctaagggtgggtgaattcaagaatataggattttccagtttagtgacattaggggagacagcctccatatgaaacacttctcttgtttttgtttttctcttggctgttaggctgtgaaatttgcctcaccgctcccccgcccttttgctgacagctgtcctctttgccattcaggagctggtgtctccctaggatggttgactgagaaagaaaaggccatcttcctttgtcccctgggtcttgagttgtattgctgaagagcatcttgtgtcaggagatctaattgccttcagacctggggggatccatttgggccagagagtgtccaggcactttgtgaattgcagagggagttacccaaagagaaaaagccctatttgtgactggccacttgattttgtttgttttgttttatatttttagaggacatacaatttctttaatgataaaaactatgaaaaccaaaatacattgttacacaaaagaggcacacacaaaccatacagcttttcagactccccaaatttccctacaaggacgtgcagcgcatcgtttttccattaatttaggtgtttttgagcaggccacttgtttacaccccagtattgagttgagtgtagtagggagacactcaggagaagcattacttgtgtttgtatgtgtgggcgcgcgcgcatgtgcgcacgcgcgtgtgtatgtgagagattgactcccctcgtgtgtgtgtgtgtgtgtgtaagagagattgactcccctcgtgtgtgtgtgtgtgtgtgtgtgtgtgtgtgtgtaagagagattgactcccctctgcttgcacccc

SEQ ID NO: 127299 - DNA, 1141 bp, Homo sapiens
tgcgggtctgttgggtacctgattttctccctcactgccctccttcttttcaactgaagctttgtgtccagcatgacagttgaaatcctggtgctttggtgcactgttgccacactgtgacaggggctaaaaagcttccgttgagtgcactgctgtgccttccctgtccactggccacagtggtgactgaaatactcatgtctgcaatgttgcatcagtggaaagtaaaggatgcagaagtccttttctttccctcaggtctcccaaccagggaaaatcatcacttcagtagaacaatctttccctgaattctgcaaagtgaattctgggcagtggtttggatttgctgttcctttttatcccttaaagcccagtgaatgagagaaggaaatgaatagactgcttgtcacaacaccaccagggtctccacagtgcctggggctgctgctgagagacagagaatgaaagctggaatggaggccgtggaggcaggaaacctttgctgggacaggctccacctcccctacatggtgtcttgagggcttcccatttccttcagtctggggattccgcccgcactaatggagctgtctcttgctgcagcatgcttcctggaggaaaagtccaactctgcctggccacacagagagaagactgatatgcagtctctccacacccctcccccgtttatccaacaaagcagcacatttcactgcgaacgcttccggagtcggctctcaacagtgcagaaaaagggatgctccctgttgcacactccaccacccccattggacgtttttaattaaatcaactagaaagatattttcagtttgaagattcacttcatcttatgtaggtttaaagaagaaagaaaaagagtagaatggtaagaaatcaaaattcacgtctcatgaggaccttagaaatgttcaacccagagaaaataagacttgagaatgagaagaaatagatgttgcaagtctcttcaaatatttgaaaaggtgtcaaatgggtaatgcatgttttatatggtccgaaggaattggaccagatcttagaaggcctaggatgtcagattgtggagttctgattttgtttggaagcaaataaaaaaaaaagaaaataagaagcagaacattgt

SEQ ID NO: 127300 - DNA, 1038 bp, Homo sapiens
tgaggttctcatagaaaccaactcctcctccttgctcagacgtagcatttgtgcctgttagatgctgtctgcacagtgccactgtgttacataaaagcttgagccatgtaggagctttcttgtcattcagaacactgcagctctagcttttgacctcagatactttgttttctgtgaatttgttaatgaaggtatgaggttgttgttttggtatggataataaagagaaacccaggaaaaaaaaaaaatttttgaaaggcacaggtctctcccatgcccagttgttctttctgctagtagctgatggtgacattattgcagctgctgcttatagcaatccccaaaaatgaacatgggcattgggaagcggacagcctgcgatctccagtccccttcccaaacacacctccagagacagcctggtgaggtgggttacagcctgctcttgggatgccacagaaagggaaaggcctcgttaatcagtgagagggttttttttttctccccttaaaaatcattgttttcagatcttgctttgcaatggggagaattataaaaggttattcccatgctggcctgattgttatcttctgtaccagctccatctaaaaatgcttttttcccatttgggagagattgtgtggtgtctaaagctaacaataaatcaaattcagtgaagctggttttgtacattgcctggctagactgagagcaagatattcagtataaggcctctaagtcatcccttccttgcctcttccactggctgtggtcaatgattgagcatttaaccacacactcacctttaagtcctgagaataagtagtactagaattcctcatcaatactccacaggttaactcatatgcatccagaactcttggaaaagcaggttgttgtaacaggtttggtgtatctgttattgctagattttctcctctctggcattcatgtagcaaactgaattattgagcatcttctgtttgccagataccggggatgtagagagaagtggcatatcccttacctcaaatgact

SEQ ID NO: 127301 - DNA, 1054 bp, Homo sapiens
ttatcagcaggcagcactgcactggtatgttatcagaaaagacagctattggtggtaacatgcaggatccagccaggcactttctcaactggctggggagaacttctgcagctccagtgatatctcacttcatatttacagtctgaggccctgtgtggcttgggagcgctccattgctgcctgtcagcctgcccagctgagcatcagcagccttgggtttgctttcttagaacccaactttctttcccttcatctgttttctttaacttttatttttaacgtccattttattgcatcaccagcccagcagtgcaggcattgcttgaggaaaggtgcagcatggattaggttgacttgctccctgagctcttgggagaggagggcacagcataataactctgctcgctgccagcatgtggcttcatctggctttcagcagcaacgacaactgactttttggctcagaatgttaccatttgtgtggtctcctctctaccagtggacagcatattttttgctctgttccttggtcccttagtacacaaaagcaagtctagaaactggataaaccctcagttggagcacttttttaactctgcaagaaagccatcaggacctgccccgtccttccatccttctgtctttacacctcagtcaataccagtgtttttcaaactgggtatttgtcccactagaggttttaaatcaattcagtgtcatagccgttttgtttttttccttaatgaaatggtgaacagaagagagactgtcagtataacatatactgacatatataactaacatatatagtcaagattaaccattgttttgtggaaacgtaataattgctaagctggcctccaataaaaataaccccccaaataaataaatgaatacataaatactgctctgcaaaaggtaatatcaagatggcagagaaggaaacctcaggaaatggtcttcctgcctaaataattgcactggcagaatctgcctgatgtgactgttttgagactctggaatctattgaaggcttcttacttccattggttgt

SEQ ID NO: 127302 - DNA, 2787 bp, Homo sapiens
ttttctttgaacatttatttgtatctttgagtaattgtattttctgtagcgggttttctgacttaatttaattgtatttctgtttctgcctgttgggctggctcttgcatgcaggagttaggatctcagctgctgtggtgcccttctacctgctaattttgctcaagccttcatcaacagatccatcttctttccaggagtatgccagccatttgtcctgctaggtgggcacaagaaaggagcagcagggaggtgtgcttggctcagccttaggatttttgaatctgccattgtccccatttcttttacagtcatctatagggtccctccagctttcataatactcacagaggtacaagattatagggtcctagaggctgtctctctaatgagtcttcgtagatctttgagagcagatgcgtggacttctttaggatgctcagtgataaaaatacctgtttgtaagcttcagcctctcaagctgatttgaattgctaagaaatacatgaggcgtgagagaacaagagaacacgccactccgagatgcttatgttggactatcctggccttgagagaagtgttggttgccacctctttgattctttactgcttgccttcttattttgtagaagaaagtggagtggcctaacaaatcctgaattctcagttccatttcccaaacatcagctacaacaatctgggtatcacatctgctttgttggctatctgtacaatgattgggggattggggggcttaattgtatcatcagattcacattgccctccattttattttttgtgaagatgcatgcaaagtaaaaatccttatattgacatggaaggtgcttccccctctcccgttttgtagttacacaatgctgcctgaatttttatcaattaaaaataaccccgtgcaagagaagtatttcaaaaatccaaacactccagttgtctataagtgcctgttgcagtttttgaagtgggccagggattaagtggatggggcagatattgtagaatttccctctaattttggataatgaactgcaaagtaactatgttggtaaaagcaggtgagtctgttcaaattcataacttaaagacattgtgaaggatgcagcaacagacttttgtttgttgtgctttggatggaggaaggaaatcccttcattagattgcccaagacatcggttgatggcattctcatcatttactgtctaagtcaaatttctcaccatcattgtcttcctactgtttcacatctcctaaagtttctttcccattctttttcaactgtctttttcccaaccacctttcttcctgatcatgtttctggcccactgatgagatccaaaagtacaaggggatcaaagagaatactgatcactaaaaggagtgagtggcccaaaactcttttactctcccatggttattgcgaccttacctttgtcttatatttgctaatacctgactgttgaaaaagattaaaattttccccagttttctttggggaaactctttggtgctcttggtatgtaattgagtttgcagattcttagtctaacccagagttgatctttcttgattatagtggccccatctttcatatccctaggttgaggatctcaataagaacctttctgcattttcttagctacttatatgattacttgggttggctgttttgaaagttctttacactgagaaaatgtgagtatgtcctaaactatgaataattcaaaaatctgactaaaagatccagtaataccctactgtcctgaacatttcctttatattatatatgaaaactgttttctgaacagtgtaggaatggagaggtttgtgttttgttacaggcttattcatttacttttacctatgtagtacctccatttttatttcataagttgtcttggggaatgcttctctttgtcctactcccccaaccccacaaagatctagcagaagaggaaagtcccagtacattggtactcctggatgcagaggtccttcccgccctcagcagaagtcctgagcaatgcatggatgcctgaatgtgggcccacgacctcccacctcatgcagctcttaccttccaggcagcctctatcttgcccacagtgcacgacagtgcaggaactctcctggagctgagccaccgctgggatggccgcagttgaactggttttttgtgccttttacctgttcccttgatcatgagttttagctcagataaccaggtattttgaagacgtgattgtccttggccctgccccatcccttccctttaaagttttaaatttttttcatgtcttttctttggccagaatttctctatcccctgcatgccttcctcggttaccataaatctgcattatcctaggaaagatgaagcccacagattgtacgatttcagagtacttcctgggcccctgtgtgatccgacagaggcctggtcatcaagttggacttccctatgtgaaaccataaactaacctgaggaagatactgaggggagaggggctgtgtaacggtgactgcctctaggccagccttctgccaggcagagaacaggaagctggcatgcagggtgtctggcactggtaaaatgacaccatgtttgtaagtgcattgtcctggcttttggtgggccgtgcaggagttcctgcctgaattatagtctttccatctcatatcttcatgtggagccctcaagctttagacaagtcttttatctccgttttcaggtggctcccattatcttgagacctcataatgctgctttcc

SEQ ID NO: 127303 - DNA, 1029 bp, Homo sapiens
acaggcatgagccaaccgcgcctggcctggccatgctaattctttcatgtattgtctataactgctttcatactataacagccgagttgtgtagttacgacagaggctatatggcttgcaaagcctaaactatttacgatctgttcctttaccaaaaagtttgctgactactgctgcatatggtatgctgaattgggtttaaatggcttgtaatagccctgaaaatttaagttggctctcctgtcccctgccgttgaggctggactgcatgagattattgtatctgttggctgtagctgtgactatgagctgagtgccatgtcccattggatagcatgtacttggtgacccctgacccacatacagctgactctttaaggcagttccctgccacacagtcaaggacaggaagatctggtgtgatttcccagatggggagttgtgcctattactagcatcccccagaagtagtgagagatagcattagctaatgggtaaataactggcttaaaagtgtaaactcctaggttttcacactccagtttttatgtggtcctggatatgtgattcttttctgccttggcattcctgtctaaaacactgatctagcaatcccaagccaccctttcctttttgcggcccttgttctgaataaaacagtgatttcatgtctcttctcactttcttccagaaggcagctagccagcacatactcactgaccagttgctgcctgcacagcagtgttttcactgctgtgttggagaaacccgaagtcttaaagggccataaggtattatttaaagagatcagtgtcatagtttaactgtcttcacagttccaggctgtaggaggtacagtttctgaggacaggggcaatgtatgtgggtttggtgatcatttctaaggcctttttcgatgacccctttgtcctttctgacacattagaattgctctttgctgctgcctgaaaaatgatgtcctcatgctggacagccccagctgaaaactcaggctgctgccttgaccta

SEQ ID NO: 127304 - DNA, 2047 bp, Homo sapiens
ctgtcttaatagcgatcaaaccttaattttatatagcattttctcattttaaaagtgttttcatgcataatgtttcattttaatctcacagcaaacctataagaaaaatattaaccctgtcttacagttcaggacaccaaaatgcacagtaacttgcctctgttcacagagctaatggtaagacatatactaaaactcaaatatctgcattccaaatcaaatgctttttctcctcaaatcatgccagttttgcttttagaaggcaataattcttttagccatattttaccatttttcaaccatagaatatctggaactagttaaaggaatagtagaggacttccctgaaggtcccacattgactaagagtcagtcttctatagggcatggattctgatcctgaatgcttccaagactgcagaggaatttgaagaatttgctatgcccatgcctcccctaaatatttactctgctcttcccacagctcctgtgtctgttgtctgattcctgcttcatctgctgtttgatttttgtgggccttacttttcccatttgctcatgtatgtctatattcctatatctaatgtttcttaaaagacaaatctgactgtgtaggtgcatttgtttaaaaaatataactccccattgcctctgggataaagtcttatctcagtttacatatattcttgataacctctccaactttatgtctcaccacccccactcacttcgtaattcgtgccttatcagaatggacctgttatactggcagttcaccatatataccattacattttgtttctcccatctctcaggtagacttacactttcggcccagcacatcagtcatcgcccttgcttgctttcctattcactcctgttctggaaggtgcaccaccttttcttggaaggcttcccttgctctcccaggctagatgagatgtccttccatcagttcccacagcaccctgtgcatgtatctgttgtgcacttaccaatagtatacaagggatctatgacccaagtctctccccactagcttgtaagctcctcacagacaggaaccatgttttgtctttgtactccagtgcctagtatataagagatactcaataaataaatatttgtcaaatcaactaattgattccttgtgacctaattctagagaatgggaagaaggcctgttattttgttgtcctttatggttctttaggaaagctctccaagcttggcatttgtcagggtgggaggaaaactgttgaagtattaagactggacacatggctgctaattcatcagcttatcattgaaaaagtccatagccaaaacctgactgtgcacttactataggaccctgacctgcctgggtctccctgtctctccagccagtatatttaaaggtaatgagataatgatgagtgttttgaaaaatgtttagtgttcaaatagaaaccattcgtgtcccttcactctctgaacatagtctgcaaatctctccctctctggtatgtttctgttttgtggattagactgctaaataagcgaagagttaattttgaagttcaggtcaacaaattcctgtttggagacgggctgttcctgaataccaggttgttatctgtctattacagccccttcacttctgggctcctggccctttgcgaagtacttcagaaagcctagagagaagagagggccctcaaatcccattccagcccctaaatgaaagtggcatcacaaggagaaaagtggaggtagaaatgtaccatgggggacgttgccccattgcctttcttcccctgactactgggcttcctctatcagcttttaacgcctggaagtagctgagtctccagtcactggtggccttccccaagtgagctcagcagcatgtgctaataggtgccaatactgtgctggctccagtgggattcctctctgcaaagctgctggcttagcttgactgtttccctattcctctccttagaactttcatagccagtcaagcatagaattgcatccattcttctgaaataggtactgtgcc

SEQ ID NO: 127305 - DNA, 1050 bp, Homo sapiens
aagaacttctgaacccagagcattggccaacacccatacagacttgagtgtgagcttgctttgcttttgcttctttttttttttttttttgagacagggtctcactctgtcgcccaggctggaatgcagtggcacagtcatggctcactgtagcctcaacctcccaggctcaggtgaccctcccacctcagcctctcaagtaggtaggactacaggcccgtgtccccatgcccagctaatgttttgttattttctgtagagacaggctttcaccatgttgcccaggctggtctcaaactctgggctcaagagatctgcctgcctcagcctcccacagtgctgggattacgggcatgagccattgcacctggcaagtgaactttaatgtggtatgtttggagtgtcttcaggcttcaggcctccctgttccgtttgtcctaaacattgcaagccatgcccattgtctgaatatcccctatggaattacataattcaactcatatctttttagaacacagctcttaatgtataatagcaaggctgcctgagccaccagcagagcacaagcagactgtagatggcattttttctccaggtaatactaacgttgtggtgtttcacatgtgactcgcccaaggacagaggggcaactgttctggtggatgagctgacctttaccctgccctgttcttgccattagcatgcccactccctgtgtctgttgccaaggacttgaagagaacctccgtgttccaaacctggctttattgatgaactttccacttgctactccacccgtgacggtttctggtcagctgcacttaaatggattttgaaaatgaaagtgaccaatggtctgttatgaaatgctgcggtgcatgaaataagattatgagcaagcttgagaattaagaacagagataccctaacctggtcaaaacaacatgtttcacatagtgagaaaggaatagctcattcttagtctcttctttaggacatttaagggcatcttttccttcttaatgaaactctgttagcatgtgaaaagtc

SEQ ID NO: 127306 - DNA, 1050 bp, Homo sapiens
ccctgagtcagtttctggagattaagcaagggtgccaggagcgttgtgaagggctctcattgtttttacatgtcagtgactgcctgccttggttttgccagctgcaaaatggaagaactaagccctcttttgcctagagaatgctaaaaggtgaatactcaggtgtggtggggaggtttctaaggacacccagaccccagatgatgcactaagagtgctgtgtgacctgaagagggacctctggtcagaacatttttttctgtcaccagcaactgaataattatgcccagttggtagaataggagaactgttggcctgggaccctgagatctgaccatgatgttccccattggactaaactttggccaatatttccttttctctatgccatgaaatcttttgcattgcctttttctggacatgagtagagtactgactttggcttctgataagcagcatatcctaaagagaatctgtcccagaggacttaggggttccttcagtctttgccgctctggttgcactattcctgagctaaagatgaaaacagacatcagatgttcatctttgtgttatgggttgttatccccagccatcataaccgtgtgtcttatttcctggttgtctgcataaggccgtatttacatagagtttgcaatcttgcctgtgtggtcagtatccgtttcaccctaggtttacagccagacctctaacatttggacccaggcctctgatattcatgccatgtcttttgcccagagtgtttaaaaggacaggcctgtgccctagctgccgtaatctttgttattttcaagtacgaagcaagatagctttgccttatttgctgtctgtctatattttctgggcatgtcagccagggagtgaggttagtaaggtatagctagagattgcccttgaagcttttgattcttgctttcctgtccagaattatagtcagttgttgagatagcctatcccaacaccactaacgtgtgacaacttcaaaaattcatgaggccttgggattcacagcacctctcaataatctag

SEQ ID NO: 127307 - DNA, 1674 bp, Homo sapiens
gaaggcaaagcaaatattatatgggaaactcaatctagttatagacgtttctttgtcaaacaaactaaaatagagcttttcctttgttggttagaaaaatttaggaatggaaatctacatttctccaaagagcattgagtgcaaagataaaaaccaaattataaatagaagtgagtatgacccattcagtttccaaggacttgagcatacagccttcataatactgaattatagcctttcatagatagaagggatctagaggttatatagtccaatccaaacatttcacagtaaatgagaaaactgaggcatgaagaagttcatcacttgatgtgcactttcacatggtaaatttcatggtagagccagtctccacattcctactgtattgctcttacctttatccccacagtgcctcccagacaacagcctcatcatccacctgaagtacaagtaataatttgagaatatgacagtggcatataaaagggagtaggtgatgtgatggaggcagacagaagaggtaagcgggtgcattctctttaaattgtattattttagtgagaaaaggatgggagcctaagttagagaagtcatccagggctttggccttctgtaaggaaactcctcctagacagggttgcaaagataactgcacacagattgagaacgtgtgctagaggaggagtacaggtgtctgacagacctggaattttccatcgctttccctgatatgtagttgtagaaaagctgctgtctattcgtgccaaatccaagcttcagataagcccggaggaaaccaaggagtgctaaactcttacaggttgggggctttttctttcctttttttttttttttggaggggggttgcattgttttgatttttgaattgagagagttgtggggaggtcaaaatgcccatccacgattgccctcgaactccctaggtgggactccagctcaagcactctgttctggtcaagttgaggcagggcacagggtgggcccatgagtgccatccctttcctctggtatcccatgcccctggacccactccctctactctcccatgaggctgatgcaggactcatgccatgctgtcagggtctgggggtttctcccaccctgtagcagaggcaggttacccttcttgttagcagtgatgtctgttcgtcttttaaggggttgtccaagtgggggaggaacaaatcatattttccagcaatttaattttattaactctgatttttttccccttttccaaagcacagctaaatggagctaaacatagacatgagggctatatttagtcctgatggtgtggtagagtagagaaggcacaaacacagaggtttatctgctacctagtaaatatggggaggtgtcaggactgtagaattcaatagtaataataagcatttttatggtgcaatgacagctttgatacagggcataattttctcaggattgctattaattgtgcttctgcctatgagcggccccctggtgaggggcttggaacaccacacaagttaagctatattaaacatcaattaaaacagcataaaatagaaactgaataaaatatgcaaaggtcagagtggctgtgaacatgcagacaaggtactggggaaagaagggttagggcctggtgagcctggtgcactggcggat

SEQ ID NO: 127308 - DNA, 1078 bp, Homo sapiens
acaaacttccacattttttcataagggtcacacacgatgccaagaaatgagaaaggagtcaatgccggatcaagtcagacaaccttgtccttatccttgcctccttttctcctgagagcccctagtcaatctaataccaagtgtttcccactcccagagagaaaagaagggaatggctttggatctctggctaaagatcacagactgcggagtcgtcactgttcccactgaacatctgattaagttgctgagtctgacccttgagtttcccagaacttgccaagattcagaattcccagatcatccaggcagcacgctcctgacagtctttggtccttttggcacctgaactgaaaatcccttttcccatagctctttcaacacttgttgaatgcttataatgaatccattcattaggatgacacagtatagtggaacaaagcactacacctgtaatcagaaatcccatgtttaagtcctgactcttccatttactatctctgtgaccttgacaaaatcatttcacctccctgaggcttcatcttccccaataaaaatgagtgttttggactaaatgacctgtgggtactaagaggatgaagaaaagagagccagagaaagaggcccttattgcaaagcctgtcttccacatagcctcccccttctgatgtcagcctgcatttaaagcagccctttcctgaggccacggagaggcttccagtgagtctagttaccactcaccccacccacaggttgttcagcaccagagacaccatgagccagactgcatggcattactgcctctggtggttattgtactcatgtgaacctcagggaagtcaagactggtcccctattactttggcatcctcagagatgccgtaagaaggcaagaggttccttggcttaggcagtgggtccataaagcaagaggggttttgtagttacctgaagtatgcagatctccatgctggctcaagggctgtttgccagccttcctttacccagtagtcactagtcactgctccaaggattggccccagccccccagagcccctgtggagccgccaacactgca

SEQ ID NO: 127309 - DNA, 1033 bp, Homo sapiens
ggagagagtgcccttgtagtatacaaaggattcagttctatgccttgctgacattttaatgcttttgttttccttctcttcatcctgtctggcatgtcacgttttccttggctcttttattgtgtaacatgtgatcaggggctaaaggacattcgcagagcttgcttcagatcccagagcaggatcagggtagtggttcttaccccagctgcacattggaatcatggagtatggaggcttaggaaagctactaatgcctgggcctccctccaaagattctggcttcatcaagcaccagctttttaacttccccagatttattagttgataccaaggaataactttgataattttggtaggcataataatggcattgtggttatgtaagaaaatgaacatattttttagagatacatattaaatgaagtgtttaaggttgaaaatggcatcatgtctgggatatactttaaaatgcttccacaaagaaaagggggatagagatgaagcaaatatgacaactttggtagttgttggatctggatggtggttatatggaagttcattagtatcctattttcagtattttgaatttttcacatcagaaaagggttttaaatatatacatacattttatataaatatatattaatgttgaagctccccaggcaattttaatgtagaactaagattgagaaccactagttagtttaggggattaaatttggatcaccatgccctaaaagatgtgttttgtctttggactttgtctaacctaagcctgatttttctggataagttttcatgagtaatctggactcttggtaggtgggggacaggatggcacaaagatcaaattagacctgtatctggaatctgacttcaggagcgtacaactagacaatattgtctcttccactggatgaactcactgtaaccgccctgagagctattataccttggagtttacctgcctcatcacttgccagcactgcatgtcccatcctatggacctctctggctacaccagggcaat

SEQ ID NO: 127310 - DNA, 1838 bp, Homo sapiens
gttcttgaggtataggtcccaaggacctgaactgacaatatttgtcttagtccttaaagtaaccatcagattcactgccagaaactttagccagcaacaaaatgtggcagatacactaccacccccacaccccctgttatgtcagagaacatccctgaagctgctcagcacagtgtagaggggacagcagagctccaagagggatcctgctttcctcatcctgcagtgaggtgtgattcagaagagcacacagcacgccagagccttggaggttagggtagggaggttcttccccctgttctcatgtggcttacctgcaaacctgcctagatggggacttacagagggctatcatcaccccagagtgcttggactgctcagatcaactaggtagctgcttgctaccaggatgtccaggacatgagggggctacgtaagtacaactattaatcacccaggaagatgttttcctgttgtcccagtacagggccacctctcaggctccatgtgtcgcattcactgaagttttagacatgagaggtggctctgttctctctgggggacaagtcaggaaaagattgcctagctgactcttccctggtctcagttccgaatgaaaagcctgccatgcggccttcagcatctgctactccccgtgccacacctgatcccatctcaagtcatttcacaccagcagagggaagccctgttccaactccagcagcagcaccactcggggagggggggcaaactctttacccttgtggtattttgtaaactgcagcagcgaagcctgaacttccaggagggaaatgaaatgaccttggcaggtaacaggttcaggacagccagcatttgtcttggttgttggtttccacatgttaaatgcttctagttgctcctgaccttccttgcctgcctttgttggtcaagtcctataggcactgtggcatttgtgcagggagcaggggagaggaagcttttctgctttactctggcacctgacaagggctctctatccagcattggcattgccagtggggaactgctgaagtagcactctagagtatcacccgggagacccctctgtctcctgccaagctaaacaaaccctgcccatgcactcttctgaatcacacctcactgcagctttgttccttcttccccagtactgctcagggcaccgccttatgggaaagtcctgtgtgtcagcaaaagaagcacttgaggagaaacaaattgatataggaagggggagtgccacccagtcatcttttaagtacaaagaaaggtcatcggagctgtatggggtccaggttggattattgttgactctgccttgctgtggcaaaagggccagctctctgggtccaaccttgggcattgccaaccccatccagctgctgacagcccagcacaaagaaaacacatgctgtgtacacacagatgggtttgcatgtcagcatgagcccatttttagcctttggccaggaagggcagttcacaacacagtaatttaattaaatttgcctccctccgtggcccacatatttgaagaggtttggggggaaatgaatctggctgaggaacattaccctgccgctctggcactgccccagagccaagccactgtaccataaagggtctcaccatcctgaatacgacccaggacatctgtctgcactgcaggctctctggccgggctgcctgctggcacatctggcaaggcagcctctggaagcagtccgtctctatcacaggcaagccaccaggggcaaaataagggactccctaccccctactcaagacctgctggcaacaactttagcagtaactca

SEQ ID NO: 127311 - DNA, 1184 bp, Homo sapiens
gcctgctagggaagagcattctctttggttatctttctctctccccatcaatagcacatcctcctggctaactaatgtctcttgtgtaatgatagcagcacctctgagagaaagggaatttctctggcacagttcgtctcaacaccagcataacacaggctgttgcttaggagtgggaatcattagagtcaggccattattggaggggaccggtctctaggggagctagcagaaattgccgctccttaatggatggaaactcatttgcctgaagcccctgccctcctctttattttctctgcattcctcacctcccattgcttcccagctttgaagttgaaaagagaggtaactccacccaatgcacatttctgctaaattaacttggttagaagaaatccttgcctgaaagcactgttcttttagaatgtttctattgggacttcacttgaaaccatcatgaagaagacaaattctaattaaatgtatgtgataaaattatagccagggccactctgttcccaagagaggatttgagatgggaggaagaggggacaatttcctagctttctggaccccagtttcagggtagacccctgagtcaacctgggctgccagagctttccctctgagggtccccttgcttacacaacactaggaaggccagggaggtagagcgggactccaggcttctctgcttctccaagggtctgcatgaccttgaacagacctctaacatgatttagctttctgcaagccctcctgtcatgttgggatagatgttaccttactaccctgcactcttgtagagagaaggggaaggccatggaagcaacacatgccccttttggtttattagccatggggctgccatcagagcacacatgccctgaagagaaaggaaagttgcctgatttctcagctcttcctgtttgaatgaaatcatgagtgggcaccatctgtctcagagcattaagcacagataacagtactggtgggaaaggccttcccccctcccaaaagggaactataaaggattgcatcaaactgcaaactccagggggcactaatcactttgccatttctgtaaatggcgccccctggagttgtaagtcatggtggccctgccggcgctcagcaattgcgctaggtcgcgaacccagagactacaggtaaggtctctg

SEQ ID NO: 127312 - DNA, 1062 bp, Homo sapiens
gtcgtgtcagaaggatgccattgtcagttcacacaggcagacactaataggataaagtattatctgacttcctttaagtccagaaattaagtcttcttgcaatggcaatagattataacttataaccactgtggctggcaggctgcagaaacaggctgttagtatctgaggcctcagctccatttctgggcctattgtgagggatgcactcagcattcctccaaacacagctgcatgatccagggaactggcacttggctcctggatggaactgcctctgtggagagctgcctataactcattcagttcacctgccgtgggagaagctgtctgaatggtcttaatgaacctggatgagtgggcaggtaaagggaggaagccagggtcttgaagactgggaagaagtagcccgaggcaaggaaaccaaactttgcacagggaacacttagtgtgtgaaagctcttctcagtcatccttgctgactcattgagcaggtagtaacttatctagtgactaaatcagcaccagcttagagacacagggaaatgagggttgagaccttaaaggaactgtaaaagagactacaaattaaggagttgccctggagaggaaatatcatgagaaatgttaggaagaaagagccatcattcttcaaaatggagggcctcatgcaggatttcctaggtcctgttatggcagatgagtgtactcaaatggggaatatgggacaggaaacctgatacaataattaattgaagggtatttttttattagtggggctataagaaggtaggtgggggctgggtacagtggctgacgcctgtaatcccagcactttgtgagcccaaggtgggcggattgcctgaggtcgggagtttcagaccagcctggccagcatggtgaaaccccgtctctactaaaaatacaaaaattagccaggcgtggtggtgcgcacctgtaatcccagcaactcgggaagctgacgccaggagaatcgcttgaacccgggaggcggaggttgcagtgagccgagatcacaccactgcactccagcctgggcaa

SEQ ID NO: 127313 - DNA, 1242 bp, Homo sapiens
tctttttgtggacaaataccgagttgctccctctcttctccccagcacaccccacccccctccccatgactgtgttaatagaaatgaggaaatgggtttagagcagatccctgagtgagcctgtcagggtcaggattaaattacatccctgaaggctgggttgcttccccaagcagtggacagcctccaggatagggaacaggactgttgtgggtaggtggtttggcccaagtactgacagcaaagctggcgtgtaccagaggataaaacctgtgatcatcctaaaatctaattctagcctctcattaggaaatcaaaatgcattctttcttcgcctctcttggaaagttgatctccctgcttttcttctcctctgtttcatgccatgaatttcgcactaacagtcctcccccatccagggtccagccagcctcttgcttgctaaggcagaggaatctccctggctttcctccttgactgcattgcagccccttagcctgtgtatctgccatagagctccattcttctctcatttgctccaattatggtgctttttgtctgcctttcttttctcctagctctgcaatactgctcggaagccccaccggccctttcagtgctaccttcttcctcctagtgcctccccactccccactcccagtcctggtaacacttaatggtcagggaggatttcatcactgacctgagtaataaggctatgactgctctgtgccagagaaacatgggtaggggagaagacattaggaagtttaccttcttggtaaaggacctaggcttcccaaggtcccagccctcagcttatgcatgactatcagcacctttactttcttctggctcaccacaaggaaaggtaatctattcctggactaaatcagtgccttgggacagctatagtgctggtgtagggatcagagcacaaggcaaggttttcctgggaggataagtataaccatgtttttcacagtgatcgggcttatagatactattgtctctgacttctagatcatcatccttcttctctggagtagcacaataggcatgtctctctttggacatatacaatgttcaagaataggggtggtgatgggggcttctctgttgatctgtgtgtttgtgtgtattgtcaaataactgttatctagcatttgctatatggtgtggagcactaagtgtgagatctatgtcacacacatacatatataattatatatgtaaaatttc

SEQ ID NO: 127314 - DNA, 1033 bp, Homo sapiens
tggcttgtaccccacaacgttcccaagattcccccccaccccctttaaatagaacttacaagttagaaaatatttttgttttgactttttgtctttaaattttaatataatctgttttttttaaccagcccatagacttaatatataagcatatacaagaaaaagtctctccccactctgtacaaaagttgctgtctttgtgtgcattctattgcattttataagttttttgggggaggggagtcatatttgagtttcctgtaccttgtccttggtatgggtctgaattatataaggttcagagatagtggtgactgtggggtgcagagagttccccaggctgttttctgtccagtgggccccatgtgctggtttgtaggtgttgtagttaatatggtcatgaattgtgggcagcactactgccccctcacctgatacaccggacggagctgctgttgctgctgcggatgttgctgctgggatgtcttcgtccacctggattatctcaacagtccgggcggctgtgactgtactccgctgctggtgccgcttacgaagtttatagaagacaatcaacatggcggcagctagcagagtcactgccacaaagcagccaatgatgatcttggtggtcttcatgacttcatccaggctggtctgcatcttgtcagtggtgtctgtcgcgggtactgccacctgcttgggcacacgggtagtctgaatgagcaccgtggtagaggtggtatatgccggctggtaaccagtggacgtggtaggaacaggcttgtactttcgcgttgtgtcctcaggcgagatctccgtggtctccactgttactgtggtgaagaagctgtagttggaggtgttaagctcagccgtgctcacattgaggtaggccgaggcgttggagttgcctgcaacattggtcaccatgcatgtgtacaccccagtgtctgaaagcagcacgtgggaaaagttcaaggtgccgtcgttgaggacagagatccttgggtggcgggaggcgtggctgagc

SEQ ID NO: 127315 - DNA, 4099 bp, Homo sapiens
tctccagtccgccggctgccggcacgcggggcggcgctccgtccggcccccgaggaccagcggcgtggcggctgcgctcggacccggtccgccggccggaggagcgcgcggcgcccgcggtcgcgcccgcaccgcaggccccttcagagagtccgggggcgggcgcgggtccggcggcggcggcggccgcagcccccggcggcgcgcaaccgcccgtcgccgcccgccgctgcccggcccccggcgcgccgccggctccggctttgtgcggagggagcgagttcgcggcttcggctcccggcgccctcagtggccgcgccgccagcggactgctgcagcggcgtgagcagcgggggtcgcggctgcgggaaacgctccggagcccaggaacatagtccccgctggctagcggcggcagcagcagcagcggggcccctgcgcgcggcgcccaccgtctcctcctcgcgccgggctcgcggtgttgcaggcggcagccacgcagactgctctctcatccttttgtccttcagtcagaacgtgaatgtactgctgacgcatactgttctgggagaagattagcgtgatgcagtgctcttatgtattagcgccgctccccctccgtcgcctgcctcgcggggttaacgccggcgccttccagcgccgcgccggccggcgccgcgcagccccgcgcctccggccgcccgtcttcctctttcctccttccttcctcctctcttcctctctccccctcccccctcccccctccccgggccgcttcctccccgccccctctagacgagcggagcggggccagggcgagcgggcgagcgagccggagtgagcgtcaagtgaggggccgcgcgcaagtcgcaggcgttcgcagctattttgggccggtcggagggagcagttgggtggccgctgataggctggagcggcgcggggctgcggcgggagagcccgcgccggcccccgccctccggcccgcacccggggccccctggctctgaagagcggggctcaggggcccggcggcccgcggcggggctgctgcatttggcctgcctctcgcccggcccgcgtcatcctcacccccgctgactgctgacggggcgcggactcgcgttcggagttcggaactgcgtggtggggactcgggggacggcggccggggccacgaggctcccaggaccgagagcccgggcttcgctgctgcactgccgccagcccctccttcgctttgcctcacccctcctgtgctctcactggggctttaaatgagggtttccttaatgagggttgcgggggcgggaaacagtggcaggaatgaccaagtgtgatgagctggggaatggcaacctgggacagcacagaggccggcaggaaggattgaggtgaactcccggagcccacgacacagcccgttcattcatggagctgcagccgcggcttctcagtcttcgctggccggagtcgccccttgctccccgctgcccccagagaactgggggaagggaggcgggcggctgagccccctgccctgtgagctcgccagcccttccttggctaggactctgagaagaactgcgtagcagccaggggtagcgattgggagtgggggtggaattcttgctcctatttctggtaggagaccctaaggcatttgacagactagtgtaggagaaggggactaggtcagctttttcccacccccctgaaaaaagactgcccctttctctgccgactgtgggtgaggcaatctagctgagccctgggaagccggtccagtagaatatagcatggtttaatatcccttcccttcaagagctgcctccagactcctcaacccacccctctccccgtgtgatttctggcaggctcgcttgataaaccctcatcacctgcgcgtgggctgttgcttaagaacgaggaggtcccagatttctcagctctctggtttctaccacacctatttctgagtattgtcttttgcccagtaacctgaacctctttaaatacgccatggaatacttgaagtcctggaaacggttcctttgtaggcaagttggagtccccattctttgccaagacctttctgttatcatttgctgtcaaataataaccttgttagtttctgtttattgaacccttactctgtattccactgcaaccctattattcattttatatgagtcaaacgttgcctagggtcactagtaagtgatagtggatttgagcctcagcacgtctcagatgtcaagaaacttgggtgtggaagtgattccccaaagtattctcctagtgggatgagaactcaggtttcattcatccacttcaatagtcatttactgggatgcttatctactatgtactatccaccataccaagaacttatatctgttcttgtttaatcttcatttacccagtgaaagtaattgccacacttgtctccatttcacagatgaaggcacttagcttaggcaggcaaataacttgcccaaggtcacacactagaaagtaacagagccagcctttccatccagccttcaaaccctgagtccgatgttttcatcactaacaggaatgcccgctgtgtctactcttcatagagtaaatggtggaggcaagtggaggggggaggagagagagactgtaggaaagttcagtgaaggatgtgtcagagaagtaagatgaagggtaggagacgggctgagaaaatgaactctcatcaagaaaaagaatgagggagacatggaggtaagtcaaaccctgatactggggtttagttccatctgggcactcagactttctggtgagaggttctgctcctttatagctggcaccgacctagtagagtcatctattgcctgaggagacccctggccagggtctggatggcagcgattaagtatgactatccttccctcctcaggcaacagggtctctgcctgggctggtcctctgctactgtaggcaaactcaaaccctgtctgttcagctccaggctccacaaatgaaagctgctgccccgcactataaaggtagatgaaagtgggggccgagttgggtcagaccagtacttagtaatgaggttgtctctcagtaagtatttgtgactgccatccatgaaggtgactatgcccaagctctgtcgagctctacatcaggctgctttgccccctgtaagccagctgggccaggaaagcaccactgaacctactaactggactacagaggaggctgtggggccgtcgttgcacacagcccttctgagctgaaagtgggattgcagcctctcattttggtaacccaagtaccatctagctatggcatcttgctcctcacagcccgtggctctgactgcttcttggatttggaatggtgccaccaaagaataagaaggaaagaaggctacttacaccctaagaggaagagacagtggattcagattgttttcacttgcagtttcacacagggagactgctgtgataacgccagagagagctaaaaaagccagcagtgattggggaaggcctgtgtcagcagcctggtattatagaatgagccctgtgctaagattgggatacctgagttctagtcccctttagacatgtgacaaatcttaaaatagctctaaacatcagtttttccatttataaaatcaaggaaatggattagaaagtttcttaccgctctcttagtccatgattcctgtcccatctcagatatgtagctctgtgaaggttgatcctttggaattgtagccaagtcttggaaatgggccacaaagttaagtgagaatgctttcttcatttaatctagagatccacagtgctggagcagagcaaatcggactgtgttttcccagctactaaaaagacacatagatcacagaatgttaaactaaagtggaccttggagattatctggatttaacctctcactttacagatgtcactgatgaagctcagagaggcacagtgacttacctaaagctacatgactgattagtatcagagtctgtcctttttgacctcagttcctctaagtaacaatgtatggctaattggcatttaaacctgggccttgaagatatttc

SEQ ID NO: 127316 - DNA, 1080 bp, Homo sapiens
ccctgcctgcacctctgccctcaggttttatcgtcttcctcctcattccctgcccttcagctacactgaatttcttttcctggaatactcttacatggttctccccattaaggcctttactctccccacaacctaaaatgttcccccatatcttcaggtggttgtcctgtccagagtagccccactcatcacagttatatcactcagctttatttttctcattttattttccattatctgaaattgtcttgtttatgggctgtctattgtgcatccccacaagagcagaggcccctgcatcttgtttccaatacttagacctagcagtgagtttattatttcagagggatgaggactgtttttgatatcccacgtgggtaagagctcaggccttcctaattttatcgatagccctagccctaccctgctctacttacattctttgaagaagcaggtgagaaattactagcctgatttttttttttaatactggaaaaatgaaggagaatcctagtgaccttaaggtgtctccagttctcaatttttagaattcctagccccttgctgacagatttatgaaggagagttttatggaggtatcataaaggctcacgggttcttggcagttgtgaatatgtgaggagtgagcataggtgcacaaatacacattatctgtgctcatgtacacataagcctgtcattttcaaattggctaaagtgcattttctccaaagggagtgggggctgttgagcctgaaatagggaacaccaggacagtaagatcaaatgctttgaaagtggctgtgccaacgctttttgctaattaaagaatgttaggacaatcaccactagcagcagtaaagggcgccccattacctcgctttatggagagctgggtaaatttaaaggcagctataaatatcccactgagtgccagagctatagcacagtcggcgggtacctgctgggcaaggagaggagcccagagcttctggtcccctttgtctagggttctcatctctattacctgtcagtccccaaattttgcttgaccaaggaagaattccatcaacgaaccct

SEQ ID NO: 127317 - DNA, 1128 bp, Homo sapiens
ctctcctctcttaactgctctttccccgaaactgcccccactccatccctccaaggcctcccgacaaggacagtttcctcttcaggtgccattctgacatgaagcccaccagttccccctcttcctttcctttcctctcaagtccatcatagttctaagagcactcacctccccaagcaccacctgtcattgataagaccagaaggcttgaggagcttcaagtctagtgaagtgtcagtgcagcaggatggcattatggtcagcagcgtggaccttggaatcagagacctgtgtttgaattctggccctgtcacttaccagctgcatggccttagacctaaaccacttaatcctttaaccttcagggtcctcatccataaaatggggatgataatattatgaagaattatgggaagaaattggctagagtgtcccagcaacgtatgcaggagaggatagaatgatgaggtccagggtacagtggatctctggggcagtgtgaaggtaaaagagattctgagctaatgtcttagaatcatcaagtgaaagcttggctggaattggggaggctggggtaaacgcccacaaaggaaagggttctcagagagcactgcattctgaataaaaacagaagtgacctcagtgacattctctgtctaaggcaggtagcctcagagactgcatggttgtttccactgggttttcgtaagaagactgaaccagacatgcaagcactcgcttacatgtatgtgtgtgtaaaggagacgttaacaggacaagatatggagcacttaatttacccagttctccctcttctttctcacctccctctttttagcatgtggatggtttttctgtttgaacgcctctatggaggcatttgcaaaagtcactgttttctggccatctttaatgcatgtttatgtcatttgcagacaaattgaggcagaaggatccagcaggtcctacagaaaaaagtacagtagaaatcccatacctcattgttcttctccttacctcttttccccagataacttatcctcacagcattgagtctgatactgagaaaagaaagcctctgcaagtttagcttcactgacgtgagcagttcagttactgcactgtagc

SEQ ID NO: 127318 - DNA, 2107 bp, Homo sapiens
ttttggtcttccatctcttcccccagtcttagggcccaaatctctcttccatttatcatgtcacctgcaaatcaaatctctgttctctgcattcccacaaccatctacctatgacccagccagccttttccagaaacattccatacttatttgacagaaccattgttaatccaagaagataggcagagctgccgtgatgaagggctctgggaggcagcagggctaagtcagtcctcctgagctgagaaagagcatcatttcctagatgcctctgagctcttttctgtgtcgtctccattttgaccgtagactccaccaaatccaccgctgggcccatgcgagtggcagtagcttcacttgcttgagtgaaagcctcagatccagtaactgggaaggagggggctcaggctttccagagggtggagtgctgactgctccttctctggttctgccctgtgtgcttgcttccagagcttcccacagcttcccagtgcaggagttttcctcctggacagtgtcaccaaatccttcccatggggtatcttggagccactgtgcaagttcatgtttctgcccctgagtccaccctcccgaagacaaaggcagaggcccaggaaagacatttgagatgaacaagactttttactgttagaacagaaaaatcaaagttcaatatctcctgtaagtatgagagagagagagatgggctgcagcttccaatgtgagatggccacaagtcccatgtttaagttcaaaaatcagttacaccattacaagatgaaggtgacctagcttgacagcaatttacatgaaaattaccccacagggttttatttaccaccaactgtagctaacagtgtgaagtgactgataaaaattgcattcatagagaaatcatatagatcaaaggaggtaattattctgcactgcctaaacagcatctgagatactgtgttcagttctaagcagtgtgtttttagagggatcctgataaatggaggggcattcctaggaagggacctgggtggtgtagaatatgggatccaggtccaggtaatggaattcactcgggatggaaagaaaggacaaacactgataataccaatggttgtcatgtggaaggaggcaaggaacgaacacttgtgtacttactgttgctaagtgctgtgcccatcctttgacggagcttctctcgtttagtcctcaaggtagccagtcctctgagctaagtgatacttgggttcagagaactttctaaaagtcatccactggtaaataaaaaaaatggatcagatgtgtttccaattgctccagagtacaaaactaagaccagtaggaagaagttcaagttagagggcattcacttgaaagaggacttttctaacagtgaaatgggcttctttgaaggagatcgaagttgatagacaccgatatcagaggtgtaaggatgacatttgctttggggaggaagcattgggacagatgaccttcagttcagttggagtgctctggaactcactagggctttctgagggcaacatcaggcccagaggagctgccaggcaggacggaaggctggggctgccagtggtccatttcttctgcctggacttagggattacaggccatttatgtccagctctagctcagtgccccagctttagcctaatgcccatctcagctgtctggacaagctcccattctggcagcttgtccatcaaggttggatctgtctctcctcccgtttgtgactccacttcattgccacagcttgtcttcccgcccaggaaagggtatttggaagaagctccatcctgtctccttttccccattggtgcaatctcctcctagcagcatctgctgaaaggggtgtagtcatcctggccccagacagagctgtcttccaagtcacggatgttgacgaggcctgtgtgtgtatctgcatgctcacaccgcagcctgatcgatgcctgtcagagctcagcatcagagtgacagctgcataccaggctgtttgctgaacacaactcgtccgtcaagggaaatcagatgaaatccatctccttgtccaaagcctggcccgatgggctgtgtctggaatgccagt

SEQ ID NO: 127319 - DNA, 1023 bp, Homo sapiens
aaaatcattccctcggatttcagtgttacttcgatgggtcccttggggcagaaaaattatagttaagaaaattatgtgaaaagaccaatagtcagccctacccttcagggacttctagtttagagctggtacctactgtatggatagtgcaagtctagaacacacaagaattggcatatgattatcttaaactggttggtataaaaatagagcataaatcaaatgcattgaataaaaaaatttgcttacatatattgaataggcattagccagattaaatagtgtgttgcagacaattggtggggaagggtctctttagagagtctcattagagacacaattatggggttttaaggctttcagaattgacaaggacaagttttggcagaggttctatgtttgtaaaccatttaggactgcaggaagctctgtcaccccatgtcttggcagtaagccaaatagctgcttctgtttcctcttcctaaagcctcttttatcccatacaagcatgtacctgaaacttcaagaagcccctctctagcctcagccactccagcacttccatttcccaaggctttgggcacttaagtggagaattgccctgttccagctctgtgagatgctgtgagctaattctctccccttagcctgccctgtcttcaggagtctgagtgactctcagggttcaaaaaaaatggtgcaggaggccagagatttcggaaggtaatattttccccccactacctggaaaactgtggaacacaaaattgttcaaaagacagaagtgagatacctgggcaatgggggaaagaaatcagtccaggagcaagaggatggaacatagcagctgagagagagtgttttctggggtggaaggggacttacaaaacccacaagcagaggatggggatcctggataaatgggagaccagggaaaagccctagtttcagagcggcacctttttcctgctggtcctcaaagggcctttcagactagggaaggattctctggtattgcttccc

SEQ ID NO: 127320 - DNA, 1057 bp, Homo sapiens
gaccaggcacaaagcattttgcttctcttttatgcagagaaggattgaaaattcatgcatctgaccacatctggtaaaggctgggccttcagcctttttctcctctttctgactcctttgatcgctcttgtaaacattctgactctagttcagcgtggtccattcacaagcttccacatgcatcatttcttcccatgtcattctcccagccatcacaggatttttatacatgttgttcaggttcctctcgttccgtccctccttccctcccctccttccttaaaaccagcccctgattcctccatccccgatctgtctcagcaggtgggtgggctctgactgttccccttgcccatccttcaagtcagctctctccagcttttcctctgagctgcttgcaccttctcctggcttctgttctccccgtcatcccgtgtttctctaatgtctacttgcacctccactgacctcagcatggctttctgtcccaaaattctaccctcgttccttcttctaccctgccacttatgcactatttctaaagtgtgaccctagacattccctatgctggaacatgtctgcctttctccccacctgtgaagtcccatcctttaaggtccgatcctacctgaaagagtttcccgactcttcagtgctcagagctggctctctcccttgaacccccctagtacctgctgcctgtaccactcagcagtcatgtgttttacatggcattttgtcattgactgacaggatgtggctttatcgtgtcttctcatctaaatcataggctctttgaagacagaagtgaattctctctccttttagacctactgcagtgcctaatacagtgcttttctgcttagaagataacaaaaacccatttcttggtcagttgattaaagtgaatgttaggtctctttacatacttactgatttttatacatgcacgttctctcaacatgtgtcttctcactttgaggaaccctaatcattttttgaatgttgtcatatgtttcatcagctcaactaggcatcccagtccttctctagccct

SEQ ID NO: 127321 - DNA, 1056 bp, Homo sapiens
tccagttatagtcagtacaggcaaagccaagtgcaaaacagccccttctgttcatggcgtctgggctgtgctgcctctgagtcatcactgctggcctcactgactgaagccagtttctgcccctctgggtcccacaagcatgcttgtcgtggcaggggcagctgagggatggtcctctcaccttcgaggagttcttgaaataggccttctccagtcagtttggtgccatgcatgtacccaaaggtagtattctgtccagggactttccttctcccacgtcactgctggcgatctggagaagctagaatattttgcctttcctcatctatttattgaatgcctaccaggtgccattaataaatgcccattgtaatactgtcatggtgatatgagtaaagtgctgtgagaacaagccctacccagataagtaatggagtggttcaaataaaatcacatctgtgcagaatccaaggggtaagttgggtaggagtttacaggtgaagtcataggacggaacattccagccaaaatgaatagcatgtgccaaggcctggaaccatgcaacttgtctgtggagctgggagttgtgtggcctgactaaagcaaaataatgaaggccacaatggcaggacttgagagcaggaagagcccagctctgaggcgcttattctgtgctgtactgaggaattccaacattagtggagaacaaggaaaggatttcagcagaagggtgaagtgatcagattgggaaatttttttttttaagtaacaacatttattgagcacttactattcgccagactctccttaagtgtttaacttgaatcagttcacttcctcttcactgaagccctttgaggtaggtagcattcattattatacccatttgaccacaaggtaaacctagacccagagaggttaaaaaaaaacccactctagattaagccagtaagtagtagagcaagcgcagaaggaggtggtctggccctagagcctgcatctgaccatggtgctgcactgcctgtgatgagccacaccctccagtatcatggaggg

SEQ ID NO: 127322 - DNA, 1053 bp, Homo sapiens
tggagattcacctggtggagctgaattctgaagtgagcgctgcactagaggcgaaagttgagttctataattcagagagcagtgggatgcagggactgtctacagcttaaaatagcccctggggaacgttcatattcaagggccatgttgttggggaagaattcacaattgctactaagaaagcagggagaaaaagccaagattgggaaacacaggcctaaaaaaagaaagtttccaaaaggaaagggggtgcttgacttttacagatatttaaaaggtcaaaaatgattaaatctgagaagaaattatttaaatggcaattaacaggtctttgaagtaatagtgacattggagtactgactggtagccagctgcattggctacagaagtgaaaaggggctggcaatgtgcagagtactctctgggtaaagagaaagaggtagacttgatgggatatgagtcaaagcaagacttgctaagatgggcaagatgtttgcaggtgaagagttagatgccggtgaaaaaggaaatcgggaaggtgatgacagaaagaggtaactgatggaaatgggtacctgaggaagcagaagaggttgtgatctggagccaagttcatttctttttctgcaagatggatggaagggaatgaagtaatcatggatgctaaatgcttcttaacagcaaagtgtgggtctccgtgggaaacccactgtggttcaggtataggagcctgagaatcaaggtccacaaagcagagcggactggccccattgggggggtcacaggtcagctacttcctgcctgggaacagggcaggggtctgtaccatcccacagcaggccttgaggtcagttatataggtacaggtacctgcagaggggaactgacacgtgaacttgacctgattggacaacatttggttactttcagaccaagtcagagatttaataacctcatgcagttactccatagatcatacaccgattttccccaagaaaagaggccaactgtcttctcacacccctagctccatccctttagggcttgggtaca

SEQ ID NO: 127323 - DNA, 2149 bp, Homo sapiens
tgctggttactccagaacactactcacattcttgaaaaaagctgcagccaggatgagtgggttgggaagaggcaggagtaccttgggctccgagtcattattcagttcccgtctctccatttcccgcgcccccctgcaagttctcctacaggacttgatcgttagcaaatggggcttccctgcttgcccttctctcctgtggaactgttgcttttcatctctcctgttggcttgcaggcacagtctgtcagctttgctgcccccattctctgacctcagagaatgcagagcagagagaaccttggaaactttgttcaactctcatttcccagatggagaaactaagcccaaagagaggtgcagtgtgcccagcccataagaggcaggattggcacctggatcacagttctagcccagggcctttctctgctcctcagctccttcttcccatccaggccgcttgctgtgattgttgctggttgctttaggaatattgaaagcaggaatatggccagacagcacatggaaatgatggagaattctgcctctaaagcctgtctgtggggactctgatgtcaccttcccacaggtagccctgagcagccccaccctgctacctggaagaacttacagccagcaccccactttgtgcagtgacttccttcccagatgcctcagggcagtggcgccctgtgctgggctcttttctacttgggacctgcctgtcctgcttgaggcagcccaccttccttggtacgggagcatcctccacaactgttttcaggcaacctacagcctcgcaacccagggctctgaggttggctgaggctcagtaattttctgtactgcctcaggcattgtgcactgcagtaacgcctgtgcacttggggaagacagtatctcttctccatcctcccagaaagtaaaaagggaaaggcttgtatgtgtgtggggtctccctgtcctccccccattgctagtaaatcccctgtgtgaacgctctcctttgggtgccctgagtcatcaaggggaatgtgcatccccctgctgtctttctctagtctccatttcttaattattttgcccccagtgccctcggctcccttatttaagccagccttaccagaagcagcctccagtgcaccttctcccgcctcaccctccccgcaacttcaccatgacctggaggaggctttaggagagggacctggatcttcagctttgcgcctacttggaagcactaggcatccagcttggctgcaggctccaggcgagttaaggacagacacagctaaatcaacccccagggcagtcagaatttcctccgtggtttgaaagctgagttcttaaataatcttccccacacttaccacatgcatgcacatgctcactctctccctccccccaccccaaacccttctttctttaggaaagatttcagaatctgaagtctaattgcagagggctagaagaagttgagaatgttgacatttctaaagccatcatccattgcctggctttcacttctcttcctttctccagacccctcagccctgcattgtaccccaggccaagaatatgcctcactgcttagagaaggagaaggacttggtccccactgcctgtttgactgaagtagtttctgttttaaggagctgacagaatccagacaatggggagaagaggaacagtttggggtggggacagggaccaagtgtatatttctggagcccagggcactgagactgctcagaaaggggccgcaggaaatgaaacaagttcctggccacccccttcctccatgtttgatttcagccacggagctgggggctgctccatgctcttcttttctcctcccccttctccccttcctcatccctgggaagggtgagaccacagctcggctgggtgatcactgaggtatgtgtgttgcctgggcatggggagctcttcctcggtaattaggagacatggaaattaacagcctgtgccgtttgtattaatttggtaaataagccagaacaatttcattagtggcatattaatgtgcttgggagcaggaggacacgtcccactgtgaggcagcagggcccactggctgctctagcccacagtcaggccaggtccagcgtcgagctgctctcctgca

SEQ ID NO: 127324 - DNA, 1497 bp, Homo sapiens
gccagtcagtgtgctcagctctggagaaatttcacagtctggaacaagcttccttccccatggagctgacagtctacttggagaatgaagacatttagaaatgaaataactgcccctaccaggaagtaaataatttatgatgatcgtgttgaagcatttatgtgctaagcacttttctaagtgcttaacatatttatattagttcatttaatcataacatccttgaggtagatgatgttgcaatcccagttttacagtaaatagaggcacggagaacttaagtggcaccccagaattcatgcaggtctagatagtctggagccagagtccacacttataacctccatgctgtacactgccccacaagtgccaaagggagggtgaacccataggcattcagagggtgattcatggtaggccagggatcagggaagccttcccggagaaagtggcattgaagcgggcaaaggtgcagtccaggtattcagcaacctcaaaatccccacccactctgccagcatcaagagcagagagcaagagatgctggcagaccagcagggctgcaagtgaggcagactgcaatggctgtcaacatctgaaggtcacattgaccttcaagcctctaggctgttcgcttcttaaccagttaccaccaagccccttcctcagtgtggcaccacctgccccttcttatagtctctcgggaggtacccccctcccccagaaccatgtgtcttcctaggtctcagcttcagcatgggcactaagtagaggggaatcgagaggagagccctcatctgtccctcgcccatgctgcttgtgtacatgcacacacatactctggtgccctcaaggccatatccacccacatgtgcacgtcagtgcatgctctcatacgaagcctgctcccagccttctagcagcctgtggtagtcacctaagtcacctaaggcctaaagtcacctgccattataggaggcctcctgtggaagctattgagtccagagctcttcctgaaacactccaagatgcccaagagatgagtggctatgttatagcagtttgcaaattacacaacactccaccagtaggatctcatttaatgcttgcagtagccagttggacaagaagaaatttcttgtctatttacaggaatgagcctcccctaacgtgtcttctgtttgaggcaacttgtgagacatgtctctttatagtctccagtttgaggcaacttgtgggaattaactctatgtgtctatacagtatacagtcgatcttcattattcaccggttacatatttgcaaattcaccaaaatctatttttgtaaccccaaaatcaatactcatggtacttttgcagtcatttgtggacatgcacagagtgacaaaaaaaattgagtcatctggcggggcacatttccattttaggtggaacagggtagaacaagacaacactctgccttcttgtttcagctctgatgatataaacaagtgtc

SEQ ID NO: 127325 - DNA, 1028 bp, Homo sapiens
ttttcatgcaaccactttaattaccttcattagacacgaattcattcagctctaccaggaaaagcagcctccctctccccaggggttgcctcgctccctaaggacctgcctgtcttctagcacagagctggggagggtgctgaagagtgggaggcaccaagacctctgcctgcttcttcacttgctcctgaccttcagctgcgctctctctctctctctcaggttaaggagaatcccgtttgccccggtagctttctgccgcaaggaggggaaggggctctgagaagagagtcgagttttggggtgtgtctgttcccgtgagaggctgaaattgaagggttctgggggttcccagaggttggcagcggctgccaaggcctgtgagcccaaggcttcggcgctgctgtcctccccacgggcacagcccctgcacactcaggcctggcccccacaggcttacgcctgtctctctgtcccaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtacatgtggcagcccagctgtgctctccctgccctcccgtcctcctcacacactaatgctgctgcctccagagaacaggaggaagttctctcatccccacagagtagcccaggaaggtgttggtctcagaccccacaccaaggccacacacaggcgaggagaggctgccagctgaggtgtcctcggccacagcctgttgcagacctgaggtgggcctgggctgccagcccagaatgtcatcagtgatcccaggcctgctcaggtggtcctgaagcagaaatctgtctaggtgactgtggagccatgggacaaaatgcccggggcgcccctccctccccagccctgacccttctctgtca

SEQ ID NO: 127326 - DNA, 1769 bp, Homo sapiens
cacagtcactcgcccagggccgatcccatttgcccaaaacccctttcccagtgtcttttttttttcttcttttttgagacggagtcttgcactgtcgcccaggctggagtgcagtggcatgatcttggctcaccgcaacccgtgcctcccaggttcaagcgattctcctgcctcagcctcccaagtagctgggattacaggcgcccaccaccgcacccagctaattttttgtatttttagtagagatagagtttcaccatattggccagtctggtcttgaactcctaacctcgtgatccacccgcctcggcctcccaaagtgctgggattacaggcatgagccaccacgcctggcctcccagtgtcttttatgacttcacttcctcgccctcttctcacctctgccgactgaacatgcaggtctgggcccactatgaggagcagcccgtggaggaggtgatgccagtgctggaggagaaggagcgatctgctagctacaagcccgtgtttgtgactgagatcactgatgacctgcacttctacgtgcaggatgtggagaccggtgagtgctcaggccgctggctcgtggttcctggcttggtccagctggcgctgcctgggggtagggggcctctgcccagtgggtgggaggaacaatgcctaggcagtccaggagcctcccctgaagagctcacgttgccgcccctgtctccctgccttgtcccactgctcctctgggcttggagttacttcaggagccttcacatgagccctggcttgggctcaggcatggaggtgctgccggacaggtcctctggacgcaggtgagataaccaggtttatctgggtggagctctgagtctcttaggtgattgtttgttcctacatacccctggctatgctgggcaggatgatttgtagcccccagaatctgtcaggcaccagccaggcattgctcagcccgtttccctctgggggagcaaggagtggtgctgggtttgtctctgctggggtttctccttctctagaggttaacatagccctgagtgatagccagtttccatggaaacaggcagcgctctaggggaagacatccccgggcagtctctgaaggaccttctcctccttccgtcctgagtggtgtgcactgtggccagggtcccctgggcagagacctggggtttctggaggccaaagggcaggagagagctctggcagccgctagcccgactacacctccaaccgcttacgctttccaccctgacctcccttttctcatggccaccctgtgcagggaaacagttgagtttggagcggaaggaaaagctcttagagctgcttctggatcccaggaaacaaatcatggtaggcacaggtggacagagggggctagaagtgtcagcagcacttgggcagtcccccagatggcaggacacagctctgcccagcctcctcagcccaccccaggtccgctccagccccgtctcagccacttccctctaatgctgtttcccaggcagctgcctttgtggcagtgtcatttcaccaggaaaaacttgaccattcctggccctgggctggctgtgcttgaaaaaggaaaaacgcaagggggaggggtagagatggagcccacgagcctgcgggattaggttctcttgaggtcagccacagtcctgctgaaagctgctccagcagttgcctgaatgaaccggggcggtggccagcctttagggctgggtcatgtgacagggaaggagtcttgtagtggt

SEQ ID NO: 127327 - DNA, 1048 bp, Homo sapiens
gagccgttcctgggcagaggaaccagctggaatccaccaccccaaaatccccgccagcccaccagagaacttgagcaaaaggatgcgatcactcccaggcaggctctactcagcctctgggtcctgctggggaggacccgccttgactcagaacaagcccctgaagtcttagagagcagaaatctgaggcagaaaacaagagaaaagagaaaaccatgtgtccttagaatgctggaagagaagggagtgaggcccttcctggcaggccacctggggatttgtggtgggctccagagaggaaggcccctgccctctggtggctccatggtatccatggagatgaacctcaggatccacagccccctctctgctgaaacctttcatcccctcttgggtggcatcctctcaccctgtctcccttctttcaattagagtctgtcttcaagagggatctgacgaaaacattgccattagctgcaaatgaccagtgaggctctgtaaggacctcccagagggctttgcctgttggcaggagacaaagtcctgcttctgttgccttggagcaaaaaaaatgaaagtagaccaagttagggaggaagctgtctgtcaaggcttcttaatccctggaatttcactgtctatggcaaggagcactgtctaaagagaattatagagggctgaccactgggtagggagaggggcggctgctaccttcaggcctctgtcgtgtggatgcaggaccagtggcctctgcagcagcttaagagtggacatacatccctgcatgcttatgcagtttattttcaatgcagctgaattattaagcaccctgcatgcattggggattctaccaggctttgtgcaagtaaacagaaagaagtgagctatgctctatgccctgaaggagctcacagtatagtagcagggaacttataaggctgactgtggcaagtgtaacaacagacatatgttgcgccctccttacagcactgccttgggcctgaagataaagagaggagccccacacttagaccacagatccacagtc

SEQ ID NO: 127328 - DNA, 1049 bp, Homo sapiens
acagctgctgtttagtgcactgggtttaaacagcagacatcaatctagtcattagtcttgttgctttatgccccaaggacacattaatctgctccacatgctcctttctccctcttctgctcccagctatgctctgattccattaggtggtgaccacagtggccgaggctgggcctagatggagtgcagttactgtcccctgtgacacccgttgaacccaggcagggaaatgctgtgcccctgccccgccattgctgaggctctgggagcccagagtcctcagggctgtctcttgagctctgcccatgatgccattgcaggtaccgtgcccgagtagagaaagtcgagtctcctgccaaaatacatgtcttctacattgactacggcaacgtgagtgttggggaccagagtgttggaggggctatcaaacacagcagcccccgagtcaaatccatctgatctctccaaggtccctctgagcttaccaatagaacaatgagcattggggcatctctgctgtgcgtgtaacaggccaggccccctcagtgacctggcaaaactggggtctatgaccagtggctgcaagcactgataggtcccgcatccagaccccacggatgagtgtccagccacacccacagttcctcttctgcctgaggtctctgcagaatgggggcagggcctctgtagcacatggagggcctttacacccacagttcctggtgttcaagccaaactgggtgtttgttccatgcgctaatccccggcacatccccaaactcaggtttgctgggaagggacagtcacaaggtgacagtgactgactggcacccttgggagaaaaatttctccggctgggcctgggagtctgttgacaactcctgggagattctcttgaggaacagcagccagctggtgagaaaactgtcattcaggagggtgacgctcctgagtcatggcactgcttgtctgcgtacctcccatgccttcctcaagtactaggactgaggatctgttagtagagagcccagagttgggccatgctccca

SEQ ID NO: 127329 - DNA, 1224 bp, Homo sapiens
ccctccagatcacagaatacctgaatgcccaagagtcagccaagagcgccagggtgagttcttaccttgggagcccccagagggtaccgagttgaggggtttggccctctgagttccggtgggtcccgtatccctgaagagctattgtctgttttttcttacagctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagcccttattgatcacagtgtggtccagagcatggagtcttggcagcttcacccaggaggagacctggacacttgaatgacccccaagatagtcatccaaatgcctggacattctccctagaaatagagccagctggggaaagcaaggcagatcttcagagtctgagcaagcaactcctggacccagtgggcaccacttggcaccatggccatcatgcaggaggctacaggtcttttttgacttcttgcacatggctgttttcaaggaccttagagagttacagcagcttggccagcagcacccaggacaatttacccactgtgaattgctgggtctggccttaggcagaccctgccagatccccaagaaaggattcaaaaggaatcagctgagagcaatgaggtgatttccctaattcctgctgtgtctgggatagagtgggttagaacgcaggccccc

SEQ ID NO: 127330 - DNA, 1172 bp, Homo sapiens
gaggtgtgacctggatagggctgggaccagggtgaggcaagccacgcgccaagggtgcagatttgaaggaggcactcacagagtgcgcacacattggcatgttctattttcatctgtagctgtccactcagcaccagcccttgcaccagtagccagaaaaagctctccacaggttcctcccactccccctgagttataaaaattgcaccttggcctcaggattgtgggttctgcttctccatccacctttcctgttgaatagtgaagtctcttgagcacctgttatccatccatttaggcttcctccaagcagggattaagacccagatagtgccaagcacagtgttgggtccagtgagtgccaaggtcatctctctgggctctcgaggaggcagcagatgcatgctatctataacaagccacagcagtgggtggtgccctgggactttaagggacagaggccctggcccaggtggctgggaagtttcccagaggaaaggagaagagctggggctagcagatggtgggaaggcatcgcttatctctgggcagcttgaggagtctcctggtctccgagggtggatgcagcagagcccagggcttgggaaagccaccagggaagtattggtggctgagactcctccgcagcgacctcatctccctcctcttgctggtggacaggattagtagcgaaggcgggcagtggagagaagggctcccgtgactgcctccattttatttattggtttgattatttttgcgtcctggggagagagtggaccccgttttttgcattagcccatattgggaagcaatggggatgggctagaaagctggtgcctcaagagtggttattgatgtcctaattacaagaggatgctaatttaatttgaacctaattacagtgcactaccctgggtggcatgtgttttaataattaacgtccttcagatgcgtaggagtgtaataatatttacactaggttggccagcagcctgtggaggcggactgggggcccatacaccaccttctccctggacagcttggctgtgagcaggtggggaagaaggcacatgggtcctggctggcgagtatcttgtcatccttcccatgtaacatgcttgggcctcatttccagccacttccttgacccagcaggcagctttgctctg

SEQ ID NO: 127331 - DNA, 1935 bp, Homo sapiens
aggatcgggggcgctgcaccgggctgggcccctcaacgctcgcagaccgggccgggctgcagctggagatggcagcaatcccgggaggtctccgggcctcttcagggtgcgtccaggaggcgggttccgtgcgacgcggcgcagcccacccccacgagaccgcttaacttcgcgggggcagcctcgggcgctcggagacgcggaggcccagactgcagcctccggatgctggaagcccagactccctggggtcaccggctctcccgccaccccagctgcaaagagtcccattgcttcaccgtccggagcttagtctccttgttcctctaccagtccctccctccgcaggtctctggggacttctgaccgcctgttcttactctccccctgcccccatacttcccgcccttgtctcaggaacggtgatacagtcatcggattgctctccatctcctgttagtctacactgcacacaactcaataatccgctcccttcatccgggtgacagagacacagataatctgagctagtggtgctcaaagtaccggtcccagaacagcagcatcagcatctcttgggaacttgttaaaaatgagaatttgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaatgcgaatttgggggccccaccccagatctactgaacagaaactctgtggagcccagcagatgattcccatgcacactaaagtttgcgagccactgatctaaacattctttcatccattcattcttcacctggcccacccagcattgccagtgggagagacacccgcaaagcaccaggctgtgagccccaccgccgtgcactctgagacactgtccactagctttgggatggcaggcagaggtactccagcttggtctagtgcagacctgggaatcaggacctggaaaggaggccccaggtgccagccggcaggttagctaatggcggccaagggttaccccggagtggggagtggggagaagctgcctggtttggcccgtgctgctgcactcaaagcacctacctttcaaagtgcaagaacaggaaagtgaccctcctctgcccccagtaagtgatgacggagtctctggaaggccagacagatgggatcttgctctttgcagcagtgagctatcctgactgggtgggtaaccaaggagaagggctttctgcaggagaggaaattcattcctctcttccaaagtaagggcttctatggctgtctgcctggaaggaaaccaaggcaaagagattaaatgtggaaaaggtcaacgttctgaaagggaagctttatggggtccttcccatacaacgaaggaactaggggcagccacataagccagatggatcaggccagtggggcttaagtagagcccagagcccagctttccttggctgcattcctacaggcaggggccagacacttagagatacactgcaccttccctcaggtcggaagggaggggacggagcccctcctggaaggcttcaggtgaatataaaactagagccctcaccaccccaatctgtgacatcacatggaatctgatgttgtttgatggcatttcgggtgtcccacaaccatgcctgccatgaagtcatggctgatatttatgccctggccccactctgatctcagggagaatatcttaccataaatt

SEQ ID NO: 127332 - DNA, 1113 bp, Homo sapiens
aaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggtgagatgcaggagggcagaagcacagaacagtgggtgggttctaagcgggtttgtttttgctgagttattttctctttgtggcatttgtttggttgaaaaggatgtttggtgctatgtattcccacacatggggttaacacgcgagtcttcaacaccatcagagatgtcactcttagatcaatggcagaggggcctcctagggcaggcttttgtgccccttttctcctcttttgaagagcttcctcttgtccagatggccatctctgccagctgagaccacatacttgaggttcagttgtagtttctgtttgggacagcagattagtgctctacaaaagtaaatctttacaaaatatttgttaaataaatgaaggtttttgagatatccatggggttttatttatttatttattttatttttagagacagtgtattattcagttcttccactgctataaagaaatacctgagactgggtaatttataaagaaaagaggcttggctgggcgcggtggctcacgcctgtaatcccagcactttgggaggccgaggcgggtggatcacgaggtcaggagatcgagaccatcctggttaacatgctgaaaccccgtctctactaaaaatacaaaaaattagctgggtgcggtggcgggcgcctgtagtcccagctactggggaggctgaggcaggagaatggcgtgaacccgggaggcggagcttgcagtgagccgagatcacgccactgcactctggcctgggcgaaagagcgagactccgtctcaaaaaaaaaaaagaaaagaaaagaggcttaattggctcatggttccacaggctgtacaggaagcatgacagcagc

SEQ ID NO: 127333 - DNA, 2201 bp, Homo sapiens
cttgtaatcccagctactcaagaggctgaggcaggagaatcgcttgaacctggaggcggaggttgcagtgaactgagatggcaccactgcactccagcctgggcgacagagcgagactgtgtctcaaaaaaaaaaaaaagaagttattgccgtagagatgtcctagcttccaggtagggtgcagatgattccagaatgcctgttttgattcctgatagtctaactggaaacatagttctaattctttatttttttactccatcttatcccaggtgtggtggctatgtagaaaggcaaaatttctgttcattgataaaaaggttaagggttaaaaggagtaggcagtgactaggagctttattttaagaccagcattccctgaattggcagtttctttgtctccactggttccattattgtctgtgatgactaggggtcatttacagaggtagggtttttaaaaggagagcctttctgatgccacttttctgcttgacaggccggacagtggctgtggattgggccgtggcaaaggataaatataaagatacacagtctgtttctgctataggtaagatgtggtagtgttgggtgagtaggggcgttgtataacctgggtgagagtattgaaacaactcctgtgttcatgataaaagtgtaagaaaaaggctgggtgcagtggctcttgcctgtaattccagcactttgggtggattgcttgcagtcaggagtttgagaccagcctggccaacatgcaaaaccccatctctactaaaaatacaaaaattagctgggcttggtggtgggcgcctgtcatcccacctgcttgggaggctgaggcaggttcttgaacctgggaggcagaggttgcagtgagccgagatcaccccactgcactccagcctgggcaacaaaacgagacttcgtctcaaaaaaaaagtgtaagagaacctgcttatcagagtaagactattgtggaagattaaccaaaagaatgagactgggctttcagggaaaactctgaattcctgctggctcagaagtgagtccaggtctgtttgtcaattcatattgtaccatttggtgctctggtcccaaaacctaggctcttttgagtctaagccccttcctgggagtggctgtgagtgagcctgagttcactgtcccctttacttgctgttgtttccaggctgtgcataataggagtgatggaacattaagaatagagaaacttaaaacttgaggtttatttagaaaacaattggctggtaagccaccagggtctcagagaatagaacgcactgagattaaagttcatggcttggctttgccccctagtgagcattttgctggctatgatgtacgaatggtagactgcttggagaggctcagttgccacttctttcagtctgggccagatgaaccttcagactgatgaatgggacaaactctaaaggaatctgggtgttgagagttttgtttatttctgtttttgctttttcttttctttatactttctcctgttatatgcagtaagaaaaatatacgaaattctgtaaaaccgatgaaaccaagaacttggagtattggttacttttgttaaaataacattgttttggatattaaatgaattcctcctttctttacctccctccataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagaggtaagcagctcatcctgttctgagacagcagaggaagattcaagattgtctccgagaggaaaaattctcctttttctgcctgcatcattgcagaattgacatgtgtaatgaaattgaataggccctctgtcagcccacctccttagttctgatctgtgccattgcagagcagtcaagagaccagcccctgcaaaaagcagtgatcattctgaggaggacagtgacctagaggaaagcgatagtattgatgatggagaggaactggctcagagtgataccagcactgaggagcaagaggataaaggtttgtttggattttcataaatgtctttagactttaaaaaag

SEQ ID NO: 127334 - DNA, 1936 bp, Homo sapiens
gcagacttcttgatctgtccttttcctttttgatgcaataaattatttaaaattttactatacaaaatgttaaaccaaaaagggcaaaggtgggttacagttgatatttgtagttttcatctccttggtcctaatattattctttgtggagtcctatggaagaacatgggggctggtgaggaggagttaattcagctactaacaccctgtgtgacattaaccaattcacttactgtcttccatctcaaattacttacttggaaagaaggggtgataatatttgctttacctattttgaggtgttctaaagataaaatgagacaagaatgcacagctgctttggaaaggtttaatttgatatcgacagctaaggcgttggtaatagtggtcataacatctgcagtctctctgagcagtatttattgtttgaggttcttttgtctgggcctcaggcatttattgctgatctattttgaggagtaactgcattattgtgttctgatttttgaagctaccatactgtcttaattcattttctgttgcttataagagaatacctgaaactaggtactttgtaaagaaaaatttatttcttaagttctggaggctgagaagtccaaagtttagtggctgtatctggtgagagccttcttgttggtggggactctgcaaaatgcccagacagtgcagggtgtcatggcgagggggctgagcatgctaatgtgcttgctcaggtctctcttcctcttcttataaagcccccagctccactctcatgatagcccattaatctattaacccattaatccataaattgattaatccattcctgaagacagagtcctctgatccagtcacctcttaaagactccacctttcaatactgctacattggggattaagtttccaacacatgaaatttgggggacacattcaaaccatagcatatacttacctttcctgccttctttggtgatgttttgttctttttgatgttgagttctttgagggcctcatatgtcatggattctctgttttcttgggattatcaagaaagggggaagaaggggagctaacagcaaagacactaaattaaaagaggaggaaggctaacagtttctaagcaaagtggggagggaaccactgataccacccttgtttctcgccctcctgagacttttggcaaactgatagcaagatgggttggcagtatatcctctagcttaggctttgaggatttactcatttagtgctcttggcttatgattctctctccttttcacactgcccctccactccctccccactccattattccagggagtaaggcatgtcgaggctttggctatgtcactttttcaatgctggaagatgttcagagggccctcaaggagattaccacctttgaaggttgcaagatcaacgtgactgttgccaagaaaaaactgaggaacaagacaaaggaaaaggggaaaaatggtgagtttctagtaattgaaggaagtttttctcccagggtgaggaggagcactatgaaaatgaaagagggaggcatggaggtagcttctagaacttaaagctttttgcatttctttttgatctccaaaatcatccagtgtattgtgatactcattttagttctttggaaaaatctggtattccttggtattattgccacacttaaccctgtggtaaatgccatctgtcgccagtagcttttttttctgtgatgttctggcgtagaagtgggtgattttcgagtacttattccattacctcttattttttagaaaactcagagtgcccaaagaaggagccgaaggctaaaaaagccaaagtggcagataagaaagccagattaattattcggaacctgagctttaaggtaagtgagagagaaaatgaacattgcatgttttgaaggcttttagagcca

SEQ ID NO: 127335 - DNA, 1096 bp, Homo sapiens
tgcctgggctcggactctaccgcaccgcctcgctggggaccgggggcagggccagtgagagatcaggggaggcctctggccccgctgcgcccccggagctcccctcccctggggcttggcccgcaggcagcagcgtctcatctggctcgttctgcggactctcgcgggacagctcgtccatgctgctgtgttccagccccgacaggcccccgcgctgccctctggtctgcgtcctcagtcccccgcggccctcaggaagcagccccagcctcccggcctcaggatcctaccaggccctgtccccaccctctcgcgactccccagagcctgcttctgagctgcaggccgaggaggccttgctgcaggagcagttcctggacgcctgccgacagatcgacgagctgagcgtgggcagcgacaccatagacctgtgaagaggtggccaccttgctaccctgcgatatgcccctttctggcgcctgccctgcccgagacctgcacactgtaatccttccccaatcctccctggctcagatacctctccagattccttccccatccaggggtccctgggtgggtgggtcagcagccaggctctatcgattgggaatcagtgccaccttctctggagccctgggtgctgatgccctcagctgcaaatctaggttggcaggggtcccattttccttggcattcaccagcaataaagctccaaggtgctccactcctgaccaccactccccactctggtgctgagtgagaggggctgtcctcagaggaccctgggacctgcctcaggcccccctacccacctctgccatgcctaggaatcccacccctgtgtgaatgggactccctttcctccatgtgacacccacaggggtccatgacccatctaggagactttatagcagttgggtgggaggggaatgctcttaatttatcaataaaatattttcagaggagcaaggtctgacttttttgggaaaactcaattgagcaacagcaccagtgattccatcactagtggaagagaagcagctcttgggtggggtgggtccattccagaccccagggaccttcatacaagaccaac

SEQ ID NO: 127336 - DNA, 1085 bp, Homo sapiens
gagtgcagtggtgtgatctcagctcactgcatcctccgggttcaagcgattctcctgcctcagcctcctgagtatctgggactacaggtgtctgccaccatgcccagctaatttttgtatttttagtaagagtcgggtttcaccatgttggccaggctggtctggaactcctgaccttgtgatctgcccacctcggcctcccaaagtgctgggattacaggcgtgagccaccagcccagcctggattcttatgaatgttgaaatttgctgtagttgccatggagcttaggtatagagatgagagataaggtttcctgtggcccatgggtgagaagtaaagatggaagagggtgaattggagctaacctctgacagctgcacttacctgtacagtgaataaagagggtgtggtaagggggtgacaggctggggcagaccgtgggctcctaggtcatgtcttcctgcccctctgcagaggccacagaggccaaagagagatggagcaaacccaatcactttgcagaggaagtgggttgggcaagggcatctgaagggaccaaagaatgaggggtgaggtggtgtgtgcatttgatcctgccattgccagacctatgccacctgatcagcaagctctccattcccagctaagtagtttctcgtttaattgatggctggtgtctttattagtgttaaggggtgggtaggccatcagaaaagtattatttggccgggcgcggtggctcacgcctgtaatcccagcagtttgggaggccgaggcaggtggatcacaaggtcaggagttcgagaccagcctggccaatatggtgaaattccatctctactaaaaatataaaaattagtcgggcatggtggcacgcacctgtaatcccagctacttgggaggctgaggcaggagaatcacttgaacctgggaggtggaggttgcagtgagctgagatcatgccactgtactccagcctgggcaatgaagtgagactctgtctcaaaagcaaacaaacaaacaaacaaaaaacccaaagttattagttaaacagagttcataaagtgagacaatgtgttgatgt

SEQ ID NO: 127337 - DNA, 1151 bp, Homo sapiens
caaactctggggaaggacataattttctccaaactcccagaggcaaggctggttggtggggtggcacttgagccccatgtgctccctttgcagggttccttggtaccactctgtccctgcccccatactccctggagaggaagctctccagcccaagtcctctggacccagctgcttccctaagttttgcctcgattgcaacaacatcattaggtaagtatccaattcatttgaacttgacaattatttattgagcacttactacatgctagtcactcatcagtgttctgggacccttttatttcattgtcatcataatcataatcatcattctcttcatcatcaccgtggagatatatatgaatggtctgagagaaagtattgctggagaaagtcccacacagagttaagtaatggtcccctgagtgttttgcaatgagaggcagagcaggatgtagacagatgtatcagggacaaacagacacaggaacttcttcatgatttccacagccctggcactaaccccaccctccactccagtctgcctgacctgactccccaccaaccttggggctctttcctttgccatctgatctgacatgacatgctgtcagatatgggaagagctgggtttctcattgggaagacactgaggaggagaccttgagcaggcagatgccaccttcgttcaagaaagcctttcagaacatgcacacggacaagctggtggtacgaggaaagaccacaggctcgggaatcttgagacctggctttgaatcacaatttatttactcactagctagtgactttaggcacgttatttaacctctctgaacctaaattttctcatagacccagggtttaataatagtacttgctagttattgcaaagctcttagcatgatgctgggcacaaagtagaggctcattaaatagtagctattaaccttgcttctgtcccccactgcatcccaaatccacttccagaccctacctctcagaaacctcagccttggccccaggcagtggtgggacaacacaaaccacacagcagagggcacaggagctggaggagaggttctggtggatgaggcagggagtcatggagagggactgaggggctttcaggcccagctttgctctgcaaaagg

SEQ ID NO: 127338 - DNA, 1048 bp, Homo sapiens
agcttccgctgaaaatctggtggaagttctgctccctctgccagaaaaatggacagacacacaatgttgcaaatatggcaggggaatcatagatcctccagagcccacttgtcccacagcccacaaaatcctctgtttccttctactctgatggtgcctgagtgcctcctcctccactccccatgccagggctcctctgcctcagggagcttgtaggccagaccaagatgcaaacccaagggaagcaagccaaagcagagggtccatgggggagctccaggagggaggggtttatttccaatctgggaggcaacctagagattgcaacaaggccacaggctttggagtcacctaggcttgtcatctgtactgtggggatccatgctgcccacaaggatagcatgagatcatggtaacgtgttcagaactacttcctctagttagggaagaggtcgccatcctagctaggtgtgacccccacaaagatgtccataatgcaggacctgtgaatgtgttaccttacatgccaaaaggaactctgcaggtgtgattaagttgaaggttttgagatgaggagattatcagagtttatcaggtggtcccaatataaccacaagggtctttataagggagacaagagtgtcagagtcagtgcaggtgtgaaaatggaagcagggtagaaagacagggaaatttaaagatgttatgtagctggttctgaagatggaggaagggacagccgctagaagtcagcaaaggcaaggaaatgggttctcccctagagcctccaggaggaatgcagcccggaggacccactgtagacttctggcctccagaacagtaagattgtacatttctgttgctttcagctgctaaatgtatagtgatttgttacagcagccaaaggaaactaatacactgggccttgtcaggtagaagccagagcctgctgtggggcagctgtggggcaggagggaggtcagaggggaattttgcagaagggcagggcaagggctgagcctgcaatgagagggaggaggggccaggc

SEQ ID NO: 127339 - DNA, 1052 bp, Homo sapiens
agccgctggtccaggacgccccctcccagcctcaccacgagggcagagggtccccggagccaagcttaagcagccgcttccgcatggccccaggagaggcccagccaggtggttggggtggcttcttttccaactgtctagtccagcgctttttccagttgtgtccctccctgcccacaggttggtattggtgcccctcccaaggcgcgaattattctgtgactgctacccctaagcccaccctacatggggttttggaggaggacacagacccacccgtctgcctctggcttcatttgccttttccgtggtccctaggccagttgccctgcgtgctgcaggcctggcactagctctgcctcctggctgcaggactgtgcccctgccaggaaggagcatcagaaggggcagagtggggatgctggccagtcaaaagcatccctgccttgtctcctgccagccctgccctggcttgtaagcactcctgcttggccagcagtttccctaaacaccaggatacccagtcactcctgaggagtgtctcctcctgcctgcccgtaggcgacgggtgtatagaacacctagaaaatgctatgaggcccagactccagcatttcttctgtggcctctttgctatacagaagaagggctgccaaaggctgggagcagccgaaattctttgtttttttggtggtctttggtgatgagattgaaagcccacctttgatacagttgtcattgaagtcttctaggagaacaccctaggggaacgcctaggagtttctctaggccttagggcagattaatgacccacccccctccaccctgtggcttttccttcctgcgctagggatgcctgctgctttgcttagctcagttcatagtgttcctgaagtgtgggatatttgcttttgggtgtgtctctcaaggcctgctgtgattttagcaggttggggcccctgagctgtgaccctgcacctagatgtacccatgcaggcctgcacttcccttgcggagtttgctgtgaccgtggcccaccctagtgttggtag

SEQ ID NO: 127340 - DNA, 1062 bp, Homo sapiens
catgaagtttgcaatgtaaaatattcttggagagttgctgtgcaactccctggtccctgtgtccctcactggctaagcctctccttcagccctgtgagaggacagaagagtcagggctggatgcatgcatatccccaaaaggctatagattcatcctttcctcttttttctcagggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatat

SEQ ID NO: 127341 - DNA, 1007 bp, Homo sapiens
ttgggattgttcaataaagttggtgactgattcagtcggattaattccgccctggtggtcttgtgggaatgaagataactagcaggatagtctaagaagccctgtggaagcagagtcatgagctgtgaatggggacgtggcggccacacggccgcgcccacgccacccgcagtacggggctggggctggggctggggctggagcccgccgtcccaacaatcccggggacgagagttgggcgggaatccgctccacgcaactcggcgcggtcccggggacgtggcgctttccagccaatcccggctatgcgattgttagaccaatggctactcggggacgctatgcgacagcggcgggtttgctgatgattggtcgggaggccgccggcgaggcggatgagggcggggtgcggacccgcttccggttgggcggtgcttgcgcgcgtgagctgagccggtgggtgagcggcggccacggcatcctgtgctgtgggggctacgaggaaaggtaagtacggtgatgcccagccccttcaccactgcctcatctttattcgctttctttctgtccccggtcttgttcttggcgcggcaggggactgcctcactcggtgccgctgtctctgctggcgcccgggtcccaggcctgatgctgctggagatcccgggaccctctgtgtgcagcctgggatggaggccgccgcccgtcttaccgcgcgctctgggaagggggctggtccggtggaactctgtcccgttgggtactgttctgtgcctggtttgctgcgtcctggtcctccatctctaggtcacgccactcaccgagtctctggcaccagagggtcattttttgcctccggaaggtcggagggcatttggatagtgttattgtaagagttccttgccgcctccactcaccatcctgcttgtatctgccagctccgccccaaggccacatcccgacagtagggtgcatctgccaaggtcgtgttcactcacctaaagggt

SEQ ID NO: 127342 - DNA, 1809 bp, Homo sapiens
tttgagactggggcacttgggaatgactgccccccaacccccgcccccattatctccttaggtacttttctgtttgtcttactgtgttgtcgtatttactctagaacactttccactctctactgatatgtcctcctctgccatttcaggacctcccaccctcccccactgagctgccttcccagtgatgaaagaaaaaatgtaaaagcctgaaaacccttcttcttgatttttaatttttttttttccctctaagaccttaaccactctggatagtatcacggggtatcagtagagtgtgctaaacagatgtgtactctgcagcttctttgcaggttttttgtcacatttttcagtcaagtgttccagctttgtgcttgttcattagagtcacctgtgactacagagattctgaaagtttgaatcagggcctgggaatctgtactttgaacagtactacaggtggtatttatgcctaggcaagtatgggaaacaactgtgcagaaggataaagacgttcttatctatgactagaccatctgaatgatttggcctttgaaggtgactcaaggttgagcctggatgttggagacttggtgctatagaccaaggaagctgccaagtatttcgctggttcctaatctcatgaacatcagaatcacctgaaaaacatttaaagctacgaatgtctgaattcagcttcagagactctaaatcaataggagaaacttaaagcttcctagatgattctaataaccagccatgtttgaagaccagaccaccaatgcgtacaagaagtaaaggatttggagtcaacatttaaaccttggttctttcacttttaattcttatgaacttgggcaaaaggattaaaattctactttggtatcttttgaaagaaaacagaaagtggacattttaactataagtttcttatcagcctacaatcagatgaaggaaactggtaaaaatttctcactgtaataattgaagagtctgatattccaccatacttattttatggatgaagtaatatttgggataatataaaagacttgcatagatatgtatatcaaattaatagtttaactcggatgtgagcttttaatttcttatttagttattaagcatactgcctcctgaattaactgcttttcattttcttcaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttgggtaaggtaccacctctcaggggtctagtgtgggtaatgacattctttataaaggctaattcttttcttttctggctcagttatgagtaaagttatattgaactattaatacatcttctgaaagctaaccatggaattactacctctaaaatttcattaaatgcctgatttcatacatttttaattgaataacagttggtgcctcattctacaaagcatcatttttgcataaaagtaccaagtactgcaagacccaacttgaactgcattatcttgctaccagaagaacatagcatggggggatttctcatctcttctcatctctactgcttttaatttttaaaaactatctgtgccctactgacctggcacaagccaagtctttgatgggctaataaacggcacattg

SEQ ID NO: 127343 - DNA, 1954 bp, Homo sapiens
gacacttataaagcttcataaagccactgattctttagctttgtggttttgctttataatctacatactaaccctttcagcttattaacattcttataatcagatatacattcttaccacatcatttcctcagagttctctgttttcatgtaaaaatccaattcaacacagtatttaaaagctgctagccattttttagacaagcatcttcctgtctttttatctgttttttaaaaataatcttgccttgagatataaatgatcccagaacttttctgatatctttgtatttttatcaaaagtgttactttttctaaaatcagctaaatttttgaagtctgatgtaactattttgaatttttagaaaaccatgattatttaccaagaattggagtttctcttctgtaagcaataaagaaaaataaagttcagccacatcttcgctagagaaaataaaaatgaaaacaaggaaaaacaaagttttacatgttgtttgatgcaaagagtggagaacttggataggaatggatattcactcctgaattctaaccataggctgaaatctacctccaaagagataggctgagtttgcttttggatccaagtgcaccagccatgactgtgttgaccttattcacgtggcttattacagaccagtaatggaccatttttttcagttgctggcctggcagttttgttttggagacaattttttatttctgtgcattagccctgggcacacacctggctaagtccagagttctgtgtctttttaaccttttgctggatttctctgcattttctacagaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttaggtaggtccctactgtctgggggaaaaagccttgtggagctggcaccttgaaacgtaactgttttgtcttgtagaatgattgtagataaaatagacgcggataaagatgggtttgtgacggagggggagctgaaatcctggattaagcacgcccagaagaaatacatatatgacaatgttgaaaaccaatggcaggagtttgatatgaatcaagacggcttaatctcctgggatgagtacagaaacgtgacttatggcacttacctgggtaaggggcaagatgtcagcctggcagggaccgtggtcttgagtcaaagaaacaaatgggtcacacagtaaaggaaaggaagcttatcttaaatagttcaattcagtgctaagctgattccctttattaattttaaatttgtatattatgtatttttaaatttgtttaatttttgttttctgaagtctggaagtctggtatcttctacatttttagcattttacatatattttaccattttttctttatgtcatccctcatagagacaatttttggagtagatttcatttaaaagaatacattgggctgggtgccgatagctcacgcctataagcactttgggatgctgaggcaggaggattgcctgggcccaggagtttgagaccaatctgggcaacatagggacaccctgtctctaccaaaaaaaaaaaaaaaaatttaaattagccaagcatggtggcacacacctgtcctagatactcaggaggctaaggtgggaggatcacttaagcccaggaggttgaggcagctgcgagccatgattgcactgctgcacaccagccttggggacagagcgagctctgtccaaaaaaaaaaaaaaaaaaaaaaaagaggctatgaggctacatacttccaacagtgcaaagcaaggggctttgagatgtttcttgacatggtcccagta

SEQ ID NO: 127344 - DNA, 1067 bp, Homo sapiens
tgcttcttgctctggctgagacccaacaccttcctgatttatttggaattaatgataaatacaaagcaaagagtaggctattggtgatctaaacaaaatggtgtgtaaataaatctcagctccgacctaggcactcacttgctgcccagaatgattcttcggtgctgtgtatgattatgtgcataaaaatctgttgagagctctgttgcctcacaaggcagatgattcaacgtaatgggtatttctgctgcctgagactgcataagctgaagcactggctgggaagcaatgtctttataaggcatctttccccagaggcatgagggtggacagcactgagggggtcatgagtcggcttagagaagtgaggagtttttgttactgtgtgttcttgattcaatttggagttcaggtataaatcatcatagctcttagttaaaatctgtctcaatgaatccgctatccatgagagaaaggttaacactgtctctgccacaaggaaaatatgaaatactgagatctaccctgcctatagcaaaactagatcaagagcctacctaaagctgtatacaggccagctagggccaaaactggtgcttaggataaatacagcattccaagcagagctataggaaaataggttttgtcattaaaaataaagttttggacaggcacagtggcttatgcctataatcctagcattttgggaggccgaggcagaaaggttgcttgagtccgggaattcgcgaccagccagggcaacaaagccagaccccgtctttacaaaaaaaatattaaaaattagccaggagtggtaatacttgtcagtagtcctagctacttgggaggccgaagcaggaggattgcttgagccccagagtccaagactgcattgagctatgattgcattgcactccagcctgggccacacagaacaaggacctgactataaattaaaaaaaaaaaaaattgtatcttcctgtttccctccttatatatatatgtgcatgttgctattaggctatttgagtccagtcaccatttttaccttttaccccaaggagggg

SEQ ID NO: 127345 - DNA, 1844 bp, Homo sapiens
tttacagataaaagagaccaagacacaggccaaacagctagaaaatggtagagttcaaactcaggcagtatgggacttgagagccaccactgccttccagatgtaactagaaaattcaagccttctagtagccttaataccaatagtgaagcataacagtgagttacatagttcaggagccagagttccatgtgaacttggagctgactctgagatctgatgcctggagctgtagcccaaaactaaatgtctttgtactgctgcagttttacctgtgtcatcaattatttcttccttgcatggttttatctttattggaaattgatttcccaccccacacattttcatgttttctgaaagtcttttaagatttgacctaaatttttgttttctagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggtgggtgagatgaaggattctgaacagggactcagtttctctttttgtggcttattctgtctttcccctttagccttatatagcatatcttatatatatatatgctatatagcatatcactgtatatgctatataagtattggccagattcagaatccaaggtctgtcactgtttttctgtgaccttgatcaaggtgccttgggcattctgtttagtatgataataccttctgtcatataatgtattttgccatttcattggtagcttcatattgtaagaatggggggaaatcccattatttaaaatatcccatgaccaatagtcagacattgagtaataacagtgatactaaagaactctcacagaaggcagttactgacaacatagactatctatagctaaacacataatcactggtcacatctcctgttagtgtgactttagcatgactaaggctaccaggtagatcatcatgggcttgatgggatagtttgtcattaagcagtgtcagtgttctgtcaggaagactcagttattttagattgaagcataggaaattgctcatgttttaccatttcttggctagaaatggttttaaccatacagacacacatgcatacatacatacatacatacatacatgtacaagtgtgtttaatgaataataaatgtttacctaaactagatactttactttcttctggcaaattcagagaccaacttaatagtctcttcttattctttcctgtttaggaaacaatggaagatatagataagaatgctgatggtttcattgatctagaagagtatattggtaagtctctgcttttagtgtttttcttagaaaagctgagaagctttgaaaggtgtatttgctggctgggcacagtggctcatgcctgtaatcccaacactgggaggccgaggcgggcagatcacctgaggtcaggagtccaagtccagcctggccaacatggggaaaccccgtctctactaaaaatacaaaaaaattagttgggtgtggtggcgggcgcctgtaatcccagctactcaggaggctgaggcagaagaatcgcttgaacccaggaggcggaggttgcagtgagccgagaacacgccattgcactccagcctgggcaacaagagtgaaactgtctcaaaaaaagaaagaaagaaagatgtatttgcccatagaaacaatttactccaagggtcaattctcactagctcattagctgtcaccagatcattaaccagaccagtgtgatagtgggttgtgat

SEQ ID NO: 127346 - DNA, 4968 bp, Homo sapiens
tgggaaaaaagccttgatggccagaggtacattcttatgaagatcaatttttggaaaaatctatatgtggaactgagtatctggaatttgattctctcttgactgacctttctcagtgtactccttgacagtgttcctgtttccccaggggcgtgcttgtcccaactgaaggccactggtataatggactctttgtagtaattggctacacctttctaaaacaagtggtcccgtttaattagctaccttagggtgaaatgaaatgtagggaacgagtctaagtctttcttgatggtagctctctcctcttatttctgcatttattaaggtataagaactctttgctctcatgtgacttaaaatcagcagctggaaatattcttgttgcaagataagtgattaagcctcaggaaaataccttgctttctaaggtctgtctggcctaaaatacccttgtagctgctgttgggttccaaacaaatggatgaggaaaaagggttaggccagattagcatgaggcagttttggggaaaagacaaacccttcttttgtatgtatgtctgtgtacccaggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggtaagtctggcgaggcccacacgctctatccttgattgaagtatgcttctaggggatcacctgaacagtttctgttaaggtgcatagagcatttaaggtcttaattagtctaagtcagccaagtatctgaatctggcgattaaaacctttcagggcagcactagctatctgatctcattttagaaatccttttgcccagtgctgatagcattgtaggaaatttggcttcagaaaagagcctttgtgtgtagcctgtgcccagcatgcatcatcaggtatttttagatccccaggaatttttttttttctttgttacttcatttgttcctttacctattacaggcccattctgtctactcaaagctggttgtttccttcttaaatcaaataggcttttttaaattgggtcctttgtatgggctataaatcagcttttctctggagcctgttcaaattgtccttgatcaattaattatctgaggtattttgttaaaagtattgttgtccctaagcccagtcacctgcttcagagattactcctgccctgcttggagtaagctgaaaatcggtctaaagatggagattttcagtgttctgagtatatttttgtctaagctaatcttcaatttcaaattcagttttttattttagagcctttttaagtgttgatctgctttaagttcttgctcaaagtcactttagtagccaggtgttgtgtcctgagatgtatgagaaaaggaaatgcatgtagtcatccctatctaggagatgttccatattttcctctaaaaggagagttttctcctcatgaaacaaacctttatctctagcattgagttgttgtgttatattctttccacccttccacttttaactttcttgataaaagaaatgtttaattggcctggcacgatggctcacgcctgtaatcccagcactttgggaggccaaggcaggcggatcacctgagattgggtgttcaagaccagcctgacaaacatggagaaaccccatctctactaaaaatacaaaattacctgggcgtggtggcgcatgcctgtaatcccagctactcgggaggctgaggcagaaaaatcacttaaatcactttaacacgggaggcggaggttgcggtgagctgagatcgcgccattgcactccagcctgggcaacaagagcgaaactccgtctcaaaaaaaaaaaaaaaaaaaaacaaggaatgtgtaattgctgttttcttccctcttcgtatgtatgtagggggaatgagggctgagtagttcacacttaatttagtagaaatgagaatcttaacttctgattaaccccaattcttctataacagtgtttctgaatttttaatgggaaatatgttcttcttcaattcattgctatctctactttcaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcattatggggtatgtatgaccttcattttccaagaaatagaactctagcttagaattatggatgctctaaaatgtcagaatgggaactctcctcgaagttctcccaaactcagagacagcactgccttctcctaaatgattattcttttctccctgttttctggtattttctagcatccttctcaccacagccataacccttttttacttccattaggccgtataactggagagacctgctgctcgttatataattatctgataccaaacacaagcgattctgaatgtacacacacgtttatctatagagcataaggtaaaacaattttgtttaacattttggtattgtttacaaatgttattaaaacatgcaaattca

SEQ ID NO: 127347 - DNA, 1057 bp, Homo sapiens
catcttatgtttcagagcactcttccttctcatgtggagccccgaaccccttcttccctgactatcaaatgccactcacagctttcagggccctcagcagctgagtgtaggagaagcagatgagggagagaggcacaatgaagcagaagatgaagaggaaccacgtataggactcgctgcggtatttggtgcccacggtgtaccagtcagggccacaggaacactgcaggccctcagggatgaacctgcaaaggaccaaacacttgctcactggactctccacaagagtgcagtgggagctgagatgcctggattgtgttctccacttagaacccacggaatgccctaaggcttcaagcaggggggttttctgtcctgactgggagaagctacagcaattccaactgcagagtaaacgttagcacttgtctcccactgccctttcgcctcatattgcaactctttaaaagtagaggtcaaagactaaatagttatacccaagctctctttccacccacatcaacctgagctcctagttaactcagcaccactgccctgcactctcaccggctccagccaaagaagggtgggatggagacgccaataccaatggtccaggtagccaggaccaccgtcagtgcatgcttggagctgaagcggaagttgccgaagggcttacagatgacaatgtagcgctcaaaggccaggaaggccagtgaccatcctgtaaccagacctgtggtgaaatgtgaggataatgggctagacagagccccacccagcctggctggcagagtggcaaacagatcgggtggagcaagcacagagagacagggctggactgacatttggagtgaagactcaaacatcctattttagccaaacttctagtctgggttgctttgtaccccagtattttaaaaagcaccagactcatttcccccagactcctctttaggaaccccctccagtggagtagcaacctttgccttcccctaacccctttttcccctgcagtacctgctacagtgcccaggaagccctccaaagcacaaac

SEQ ID NO: 127348 - DNA, 1050 bp, Homo sapiens
gcagccccggagactcctgagcgcggggcgagggtggggtgggcaaggtccagcgagagaatgggaggagaggggaggggagcggtcgcagccctaccccttcccgcacgccccccactcctccctccctccatctgtaggccacctcagcctttcagcctcttcttcactggctcccgccctctttcagtcttggccctctcctccctgtccccccggactaaatacgcacaccccctctttctttctgtgcaagcaagagggtcctggaacagcgggttctgaggaggctgggaggcagggctgagaggtggccgagagagaggagtcgcagagccgccagagtgagtcaggcacctccactgggattacagatcccagagcctcgaggagctggaagacatgtccccttctttcctctgcaccccagcccgcagccagccccccaccccccagcccctcctttctccctgctctcaggacccacagtgaccactctaggctcctatgaggcttccgagggctgtgagaggaagaagggccaacgctgggggtccctggaacgacgggggatgcaagctatggagggtgagttttcccaaaaggcttctttctttcccctcccctcctcccttaattcccttctttcctccctctgacccccaggcctctgagccaggacacagcccttccctcagttcatcttagcccctcttcctgcagctcagagctccagcccttcccagggctcaggctttgacagaagttcaggatgcatcccttcgggaccccaatcaccccccagctaaccaggttatgtgtcccgagggagctgccagacagagaaagaggccttgttggacagagctttgaagcagcctttcagcagggggtttgtcctcactgcctgccgacccagatcccaagctgtctcttattttaaaaagcaaggaactgggcatgtgaattgtctttctggggccaccaacattaacttcgaatggaagcctgtggctttggttctttaggataccttattgcctgaaagag

SEQ ID NO: 127349 - DNA, 1182 bp, Homo sapiens
tgattctcctgtctcagcctcccaagtagctgggattacaggggcgtgccaccacacctggctttcttttttttttttttttagcgaagactgggtttcaccatgttggccaggctggtcttgaactcctgacctcaagtgatccacctgccttggcctcccaaagtgctgggattataggcgtgagccactgctcccagcctatcatcaatttaaacaatcccttatcgactgacacttagattattatcccgtgtttggttattatgcagtgaacttatatttgaatttgagttgtgaactctaaatgcacattgttttaggtccagtacttaccacaggtaggtcatgggaactctgaggctctgtaatttctgagctctcaggatgaataggtgaaaatagtctgtatacattttttgagtcaggggatttttagaaagattcagggcatcaagaaaatactataaatgaagttaggtctttaactgtcaggtgattccttagaagcatgaaatactttttgtttacagtagactaagtgattgttttggtgccaggcctcaaaatctacttttctattggaccttactacatagagtcactctcttttcccttcttaggtactccttttattccgtccggcatgatgctacacttctctgatggggtagagacaaggttttcaggactttgcagacaagaaataagtctccctttaattttgtgcctctagaacatggtaggttagttcacctgccctcttgatcatctcaacctttggactttgcaggtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaaggtatgagagccatcaagtgggtcagtaaagtcaagcagaggaaaggagataatatataggaaaat

SEQ ID NO: 127350 - DNA, 1097 bp, Homo sapiens
aaaggatacagataccacctacaagcagacatggggatccgacccaattatctcaagactagagggagtgagttctgaagtttacttctgctctaggcactgggttctggtttgctctgccctaaagtggatcagaagagattcttttattgtctgcatagacttgtttcagtctaatggcaggcacaatgcttccagattggagtgggcttgactaggcctagcctcaaaactaactggactggcactctaagggtctcccagagccaaacacacctttgcagattgaggggctggagactttctgtagtcttttaagcatgtttatctgagcggtgagtcacaatagaaggccccttactatctttggcctaaaatgaaggtatcaggacaaagcctgcatggctggtgatgccaggcagaactcccttcaagcatagctctgcggttctgaattgcaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaaggtagggcacagagggtggggaaggcaggcacatttcttgtctttctttcaccttctcccagcctgtggtagaaacatctccataggcatccactgtggagggagatagtactctggggtctcacttgcctgatgtaaatcttccagtcaaagagcgccatgctttccccaagcttgttcttggagcatatgtggtatctgtagtaaacaagcctccctgttccatttcccacatagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccaggtaaacactgcccggggaggcatctggggtgggggcagaagggcctcatggaggggctgcttcaaccggggtgggcacagtgagtatggctgt

SEQ ID NO: 127351 - DNA, 2546 bp, Homo sapiens
agccacccaagaagcttaccttacagagtaaccaccccctccacacccgcccccacccacagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaaggtaactctgccacaggcagctgctaactgcggggaagctgctctgagaagcttccctgtgtgactagggaaaaataaaagggtggggattgaactttttctcttaccaaccactccttactttctcaccactctccccaaaccaaaaagctccatagagccaattagagtttttcttataagggctttaaatcttaaaataccttttatactcaggaatctgtgcagcagtttatatttaggtatttagtccatctggagaaaatgcacctgaagccactttgtaaactacaaaatatatcccaacacaagagaccactgccacttttagcaggtctccatagaagggctcccccgtccccagatgggctctgtgaagtcaaccctgagattcttcagggaattgttcacaacggggatgaggcaccaaggaggcatcagacttcctgtgtgaccaccaccatcccttgcctccttccttctactccgcctcagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaaggtaaccatagcaagaggtagggagacagttctcctgagcacaacagcatggcagagagagtgggcaccgccgaagggtcagagttgggaaggcgtgtttggccaggggtaaggataaggcaaaagccctgcctttcaccagctgtgaccactcacaggctccattaagaggtggcttttagatacggcctgaggacctcacctagatgccattatcctttatcacactgatattcacagtgcccagttgaagcactatgagcactcagggcagagctgggatgaccagaagtctgtcatcagatcattcgactcattcccagtaagatgtataatatcagtttggtgtttgtttggattcctttggactgactctaaatgtcatctttttcttgagtggaaaagtacacttctcagttatcaaaatctatcacctttggtgttctctatgaggcaaatttggggcctttcatttccaagagaagaattcctagcatatggggttcttagtactgaccacactatcttcattggaactttggtggcagtaacagagcaaggtcacaggggttagaccagaaaattgatgcctctcaagtaccagcaagaggtcattcagatgaggtgacacaggtggagatcaccatacaattctcttcagggttgggggataaagttgttctgaggtctcagcgtgggcaaggaggggcaggtagacagtttcggtttaggccaaatctattcattcagatcttattctgaacaaggagaaccagggagtagcagaagtcaacactgtgaggctggatcatattccaggggcatcagatgtccaggctggaggcctgggtaacacagctgggaaccaggtataaaatatttccttaactgatcagatctcatcctggacatcagcagccaagaagccaggcccaacatgcccagaggccagattcagaattggggcaggagatacaggaactaatagtaagactttgattccaattcttcatattgccgcattcaaggccggggctgattttagaactaggggtgggcgaggggactgagcctgaaggtcaggataacaggtatacctgactgagaagagggtgtggtagggagccagggtgttctggaaacccactcggcactgctccaaggagacagggatgtaccaaagtgcagaaaccagccgaaatgggagcccggaaatcatggagtatctgccctggggagattttcccaaatgagcaagaaactgatacatgccagttacctataggctaagtcagagacataggccggggtgaggtggaaatgtaggtgtgccattctctaaggtgtgctctcagacatctgtaccaggagaggtgcagctggaaggactgaagtgtcagagtaatgatactgtctccccacccctgcccccagcaatccaagctgctcatggagcagatgcaggccctgcaggtgatgtatgacgccggtcaggcgaagcaggagctcttgcagcaagagcaagggaggctcctagaggagcggaagaggctgcaggcagacttgca

SEQ ID NO: 127352 - DNA, 1044 bp, Homo sapiens
gcctcttgaagtgctgggattacactggatggcaagtgagccgctgcgccctgccgtttttttcatcttattagatggacatcatcaggtgcctcaagttaggagaagctatttgtaaaactatttgagaggctcattttccaccgttgaatattttctttattgtctacttcctatgggctttaacagggagatttctgagacagtgacccccaagcagggctgagtttggttgcgtggtcagccaactggttgcataaccagccaactctgggtaactggccctccactaccaacagatcaaagaactgcagaccaagctgcgggagctgcagctgcaataccaggctagcatggatgagcaggggcggcttctggtagtgcaggagcagctggaggggcagctgcagtgctgccaggaggagctccgccagctcagggagaagaggccttctgttgtcaaagaagcccgggggaagaatgctaataagaacatgaacaagaatgccaatggggttaaaatgaaaaaggtgaccaagccatgctcggatacttctgagagcgaccttgagaccagaaaggtgagtagtaaccttggtagccagataagcagaaaggaggaggagatcctgggaagaagcattgcctccacaaccctttcaaccaggcaagggatttgtagagaagcttctgggatctctgaagtgtctacagtggttcccatcttaatggaaagtgggtgctcccttttcctgtgaagttatggggagagtggaacacagacaactcacatcgggaggtgcagccccaaaggaccacagcccctaggctggacaactccttcagtttgcccagccccatttgttggggctcctgttcttcctgggttacatgcccaagagaagaaccaaatagatgaagagggaggaatttgttcaaagtagttatgtactaataagtgaaagaggattgggtaaaagaagagtcactgtaggggtgggaagcaacaatttaggtgcagagcccaagactctttagttgtgg

SEQ ID NO: 127353 - DNA, 1034 bp, Homo sapiens
tgtgaacggaatgtagcttaatgcacagggtggcaactggaggatttgttggtggcacttctctccatttccttttctgtccttcctcctgctccctccccagctttcctgttactcatcttcaagcctccacttttcttcttgactttaggtattccctttactccctggtccacaactgctttagtgacggggcccctctctatgactgtttctcccctgtcaccccccagaagtcttaaggcactacgggtgaaacccaaagagttcagccacagccttccactacctcagacccagcccggcccaatcagagggagaggaagaactgctggtgaagggttctcctggtggggcctgttatccccagagctccaggaggccccaacatgcacctgtgcagccaggacctgagggagcacagtgtggtagaaagcgtggctgccaggcggtcagaagaacttggttgagtctgtctctactgacaggcgttgtcccagggagcaaaatgcacactctgagctctagtttcttcaaatgtaagcaaaggatgatcgaacctctgccctcctcacaggtttttgtcaggaccagatgggttgaagtagatgaaagtattctataaattataaaataccccatcattaataaaaagagcacgcacttacaaaatgcagtcttatgtgtcaggcactgttctaatcacttacgtatattaactgatttaatccttgcaacaaccccatgaagaagctactcctatttttttttatatatgattaaactaaggcatagagaagttaagtaaaacagccaggaagctgcgagtcagattataaggactcaatattagcaacaaataagattccagtcttgcttccctttattgtctctcctcattttgagcagtttctcttcattggtcccaagtaggaagacaccatacttgtgtttaggcaacctcagatcacattagctctttaggtaactaatatattatttatttatttcatgtattttttataagcccctct

SEQ ID NO: 127354 - DNA, 1048 bp, Homo sapiens
ggccagaaagaaaccaggtaattacatagacaggaggcagactcacttgctgtagctgaggtgagggtaccttccagaaccacaggaacacagagaagcagccttctgaccggaagggccccataaagaacttggcatctgagtggggcctcgcaggagggagagggtcaggtaggcagagactagaggcctgaccccagagctctggcccgaggagctgcgcaggtgagggagggtgctctggggcagtggagggtggggcgcccctgagcccgtctgtgccctcccctctgcagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtgagtgggccagtgagcacagcatggagcccttagctcccaaagacagaggggacaagctggggctgccaaggcgtgtggttgtcagaatgcacaccctggggcctgggggccaggatcccctgcagggtttgtcctcctccagctgtggctctccgctggctggtggcaggccctacctgatgagtgtgccagattccgcagaggcaggaagaggtttaaaacccctcattttacagacaaggacactatggcccagagagggctggtgacttatccaagatcacacagcttatctgtggcagaaccacctagagcccagggcctggactccctgccccatgaattttttactgtgccacgaggcactattcctgccgagctgagagagaggcagtgtggtgaccaggacttgtagcaagaccaggagttagatccagagaaggctcttctctgggagaccctgggatgactttgagaaggggttgaggctcaggatgatg

SEQ ID NO: 127355 - DNA, 1044 bp, Homo sapiens
gccagcagggctggtgccaggctgcgtcagccagggcagaaaggcttcattgttggtggtggagagggctgtcctgctcctacgtggtgaggggcctcgaagctgatggggtcagcaggaacctggctggtcaaggcctagagctggtgggaaggggtgtaaagccacagcctctgagggtgttgggtgaacaaatgccctgcatcctggccggctggctgcccctcaccatcgtctccctccatcacctctccaggtctctgccccgactgggaggcctgggaccccaaccagcccgtggagaacgcccgggaggccatgcagcaggccgacgactggcttggggtgccccaggtacatgcgcagatggggcaggggggaaagggggcaggggcagaggttgggtctgtaagtttacctggccagggtgcagggggagactggggctgctgggaaaagagggcgccatgtgacatcactcctttccatcgcaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggtatgtgtgagcccctggcggccctcctgggcagctgggcacatgtaggctctccctgagtaacctgggctctgctcctgccccgtaggcatcgagccacagggcaacaccgtgctgcagcctgcccacttcaccgtgcagacggtggacgcgggcgtgggcgaggtgctggtctacatcgaggaccctgaaggccacaccgaggaggtatgcagaggccgctggggacagagggattcacttgggattggaaccagagagcgtggggccaacaacaggaatggcccggaggtgactgccagagccacacactgtgctgtgcagtctggggaaggtgtcaccatgggggctgagtggggctggggtgcataaggcactgtggggtcaggaggggctatg

SEQ ID NO: 127356 - DNA, 2065 bp, Homo sapiens
ttaagcacaccatcatcatctcctggggaggcgtaaacgtgcccaagagccccttccgggtgcgtcctcccggcctgccccgtgcccaccaccaggggtccctgagggagggcggaaccctcgctggagtccctgttgtccctgggctcaggctgggactgaggcttgggctggtgccactgaggctgggccgggtgcgctgggcaggaggatgagccttgagggagggcaccacgctgagctgcgacccctcccgcaggtgaacgtgggcgagggcagccaccccgagcgggtaaaggtgtacggccccggagtggagaagacaggcctcaaggccaatgagcccacctacttcacggtggactgcagcgaggcggggcaaggtgcgcccagccggaaggggtgggtctgggagggggcgggggtgagtcgagtcgggggctgagcccaactcacagcagtgcccgcttctctgcaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggtacctaagctcctgggtactcacagcgacatgcacctgccagctccagaaggcagctggagatgctgtcactgggaacagggagggatgattccgcagacatggtggagccctacctgtgtgaggcagggtgcctcagaggaagcaaagggggcccttttggaggctgcccctgtccatgctgggtcccctgggtgtgtcctgagccagcatctagctgagagcaggggtgtgttcccctcgagagccctgactgagcctcctccacatccaggagatccccgccagccccttccacatcaaggtggacccatcccacgatgccagcaaagtcaaggccgagggccctgggctgaatcgcacaggtgagtgtctgggcaggggctgggactggctcgaggttggggttaggtggctgccaggccctcaccacatctctgggtgggtcctcaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcaggtgcgctctgcccctcccatgctaccgcccggccggcccgccagagccctgggtctccctcctccagtcccatgggaccagttctggatcctccacgcctttcctgcctcctgccctcactctcatggtggatctgagcttcagagcccatattcaccaccaggatgttgtaggaccttgccttatatccagttctgacctaccattgtacccaacagggcaacatggcagtgacagtgacttatggcggggaccctgtccccaagagcccctttgtggtgaatgtggcacccccgctggacctcagcaaaatcaaagttcagggccttaatagcagtaagtggggcaagagccaccctgggagtgaggggtattcgggtagggtggaccggagtctcctcatggtgtcacttgccctccacgcagaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtgaggagataggagctggttggggctgggagttggggacttgttgggaagatagatgagtcatagggggcagaggccagagggacttatgtgcctggagtgggcacagccaag

SEQ ID NO: 127357 - DNA, 1283 bp, Homo sapiens
tctgctctggacgggggcacggggaaagctttggggtagaggatgacaagagtcagaagacagtaagtgggaatgggccatctgccaggggccagaccctggctaggcatgggccacggcagagggatgcaagacccaggcccacagcctggtgggtgactcaagtgaacagagaatgtcactacatggagaagggagtgaaggcagaggctggagctcacagaggtgcaggggagggtgtggggcccaggctccgattagaggagcagcctgggagttggggagtgggagaggagggggagaggagggtgagaggaggggaagaggaggggaagaggagagggagaggagagggaaaggagggggagaggagagggagcatctgtgtgaaggctgcccccacccctgctgaacacgccacccctgggctccaggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggtgagggccggtgggccaggctagtgggcagggctgggcaagtgggcagggccgggatctgatgatattgccctcggggcaggaggggtggtgggggcgcacactccctgattgatgcccctgtggctggcttccaggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggtatcctccccctttgctagcctaaatctgtgaccaccctttcccagcccctggccctcctcgctcatccctctgcctgggcctcagccccaccccatcctctctcaggggtgaggcaggagcagaccccctccaggaccccagattggcccctgtagctcgtttctcctcagctgggtccccagcggcctgccctctttcctccctgtccccccattcagctactccctcatcctcactcactggtcttatgaagctgatggggggatgttatctctcaggggagcgggcaccgggggccttggcctagccatcgagggtccctcggaagccaagatgtcctgcaaggacaacaaggatggtagctgcaccgtg

SEQ ID NO: 127358 - DNA, 1024 bp, Homo sapiens
atgacccctcacaccttgaagggcctctgccctaatgtcacgagtgacttgaacgggctgggcttgcacatgagtgcactgtatgcggtgtgtgtgcctcatgggctgtacatgcccatacacccgcctcacctgtgatcttggctgtgaaggggctccccgggatgtgcttgtcatcgaagcgcacgatgatgctgtagtctccaggcgcagtcggcagataggacacggtgcaggtgccatccttgttgtccttacaggtgatctctgccttggatgggccctccacggccagtgacagaccccctgtaggtggaggtgtggccaagatcagaggtcctgccctcacccctgcccctggtgagtctccaccccagcctgcgacctgcagctccctcaccttctccagcatctttggtgacaatagtgaaggtggctggcttgttgaccatgccatggctcaggcctggcccataggcactgacatggcggctgttgatggcatccacatagaactgtaaggggctccctggggatacagagaaaaagggggctgggtcagcatcagggattatctgagcccaccttggccccagcaccttccagcagcctccctgccaaccccctccgtctgtgccgtagggacccagctggtggaggtctgcttcccaccagggtataagcctccctggggcctcgcctggtgtctgcacacagcgggtgctcaataaatatttgttgaaagagggaaggcaggactgaagctacggcctgctcctctcacccaagccccagcccagcccagcccctaactcaccagggatgtggttgccgtcatacttgatccccatctggtgcaggcctttctcagtgggtgcatacctcaccgtgatggtgccgtccttgttgtcggtgatgttgggccgtgccgtcttccccgagggcatccgcacctctcctgcagggcagacacagttacgtggagaccctggtttcccccactgcaacctccctgctgtcccag

SEQ ID NO: 127359 - DNA, 1058 bp, Homo sapiens
tgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgcagagggttggctgttccttgggggtgtgctctgtgtggctggctgccctctggcctgccacacgaaaaaccgggccctggggaggcagaggcggcctggctgttccctggaagattgacccagtcgagggaaaggtcctggggcagaagtgaggtctgggatgttggcagagtgcttgaaagaaccgggggtgggggctcggggatgtgggaaggggtcccagcgggagggttcgtggacagtacagggtgtggatactgtgttctacagtactgtcccaggacccctgggaggccagtttcagttcagcttgacctcaa

SEQ ID NO: 127360 - DNA, 1050 bp, Homo sapiens
gagagagagggagatgggggtctcactatgtggcccattctggtctcaaactcctgggttcaagcaatccacctgcctcggcctcccaaagtgctgggattacaggcgtgagccatcacagctggccttcagtatctgcacataaaaagggatctgcatacatataatcttatccttcccctttctgacacatcactgcatattgaatacaccagtgtgcaccctaatcaatcttcattaccagttcacttggaagccttccgggcagtgttgtagaagccaaccctaatcagcgtgaccctccgctttgggatgaaattgattctaggtagggttgacagagggttgagcgtggcagcctttccccttgtcctctgtgccctctgggtcatgctcattcccctccacagcccagcccaacaactcggagagggctgcctgggtaggagagacggcagcccccagagctgtcctggactcccttctcatctctccccacaggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggactccatcctgcgcagggccaggggcatgttcactgccgaagacctgcgctaggggactcctcatagccctcagcccttccctcgtttccaggcctctccccaggcttgccatcagccttctttactttttgagcctctgatttccaattccctgctccttcccactccattaagaggctaggtgaggcgcttctaggttgctggggctctgctggttaaggaacaggaagcctgaccatctccctccactacctcttccctgtgctgttacacagtgtcattgttgatgttaaattaaagtcatattcttgcttctctccagatgggttgggtgctggaaaggacatgtgtggggtgaggccatggggcagattcggttggcaaggatggaaaaggtgc

SEQ ID NO: 127361 - DNA, 1037 bp, Homo sapiens
agccagagcgggtaggggatgtcattggcaggaagcctgtccatctcggctgagtcttttttctgtgaggttgagtcaaggccatcagcggggagggagctgagctgaggcagtggagtaactagagatgaagaggaaaggtgtggaacaggcatgtgccaggcagggctgctgggcgatgttgctgcacgtcccattgctgtctgtgctcatgaatgtcaagtgagactcctcagccctgtacccttctccagctgcttgagtgtcttgcagaaaaggtggatggttggggattgactcagttgagattttgcccccaaacatccctttcccccaggcccctaaaggggaagtcagggaaataactttctaacaaaagcaggaggcgagccctagaagcggggagcaggaggccgaaggaaatctcatctctccacagtctgtccctgtgacaagcaggctagggtggcccccctccctgcaggtagaggatcctgaagctagggtaatgatggcagatggctgctgtatcctggcatccagccagctcccagtatttgcccatagctcccattcctccaaagcactttctatttcttcccacaaagtggctactccactgacggattcctagggctgtgcagacagacagggctcccatgctctgcgtgtccctccctcaggaacccatgcttggcctctgacatcttttcccaggccccccagtgaagcaagaactggtctcctgcaagatgtgccgcattgagtcattcttccgcaagaacggggccttcgcactgcttgatccccgagacctggccctctgaccgtgggccaggtgtgggcttaggggagggaagaagaaataacaggcctcctggtggggcaaagctgctgtgtgtgtctgtgcccctctgctctccctgtccctgaggttgcattcaggcctttctgaaactatcagacctgcaagttgccctcttgctttttccgtaaccctcatcactttaatcatccctttgaggactcagcaatga

SEQ ID NO: 127362 - DNA, 1052 bp, Homo sapiens
gggtgcccaacacccgcccacccagccctctgcgggagccagacctgaagcctcacagccactggtgcattacagaggagccgagttcgctgcatggccctgaagtgcccgcctagcccctgcccagagccagtgctgaggcctgggcactgctgcccaacctgccaaggtgagagcccctggcccctccctggtagagccacaggtaggttgtcgtgccatttcttgaattccagagcccaccttgccggcctccagtgggtttggtccgtggcggagctggaatgcctgagctcaaattctgccattgccacctagtgcttgtgtgactctcttcctcaatttccccatgtgtaaggtgcagataatgatattccatgcctcatagtgcagcttaataaatgtttgctttctactttgtgctccccaatcatgagacatggggtcagccctcagggatgacccctagagtgtgacactgagtcatacactaatgcaaaatcttgtaacagccaagggcaggaatagaagcaggcaccagctagtgtgcgaattcagaggaaggagaccgaatccagcctgggcacaggagggaaagcgtcctggaggcagctggtccccaggtggcccttaaggataaagaaaagttagcttggtgaagggctgaggaaggcagtgagccttctaggaagaggggagaaatcaagcacaggcgtggccctgacacggagggtgagtgtgcaatgttggctgggaaggtgtgagaggtgacgaggggccagagataggtggggcacatgggtgtggctatgctctgtccacggaagaccagaaagggcgggctaaggaactgaggcctcaccctgcctggggcactgggagccactggggaatctaggcagagatctgaccccatctagtcttggctcgggagagagccctcagagggcatgtggacaaggaaggcgggcaggctgaggctggggtccaggccagctcccaccaggcctccctcttctcaacccctcaaccctaggctgcacagaaggtgg

SEQ ID NO: 127363 - DNA, 1749 bp, Homo sapiens
ctgaggaaatatagaaacctctgccttaaggttgattttactaaatgctctattttctggtgcagttattgactgtcttatctcttttgtcaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaccagtgtttctttgtttttactttcattcactgccttgtagctcggaaatggttcagctagactagctatggaagcagcctttggtacctgatagacatctggggatggagttgaaagggcaggcccctgccctgatgccacagacccttcagacttcagggaagtggttcattctgcactttttattctcctaattcacaccaaagctcatcacgcttacattttacccttttgtgtagcctcagtgggaaagggagttgggttactctttcagttaaacagtgtggtatggtttttctactatggccacccaagtagacagtttcctgacctgcagatttattggtctttaaaaaaaaaaactttattgaagtatcattaacataatttgcatgtgtttaaggtatacactttgataagctttgacataagatacatccatgaaaccgttatc

SEQ ID NO: 127364 - DNA, 2172 bp, Homo sapiens
actggtatctgagttagttgagccagggagagggctacaggaaggcaagcatattaagaattgcttcctggctgggcgcggtggctcatgcctgtaatcccagcactttgtgaggccgaggcgggcggatcacaaggtcaggagttcgagaccagcctggccaacatggtgaaaccacatctctactaaaaatacaaaaaaatagtcgggcgtggtggtgggcacctgtgatcccagctactggggaggctgaggcaggagaatcgcttgaacctgggaggcggaagttgcagtgagctgagatcgtgccattgcactccagcctggatgacatgagcaagactccatatcaaaaaaaaaaaaaaaaaaaaaaaggaagtgcttccttctccactgctttagcttttagcttagccttatgttcatttagcaaaaactgttatgaagacagatacagtagaatgaagctggcatcagctggtttcttggtgacagttttggacaaagggaggtcggggggcttttgaaaaaacagggtcagttgaatattgggctattcatatcacataggcatctcctgctttgtctctctttctacatgctttaaccctttcctctctccctcctcctcccacaggaggaaatcctgagcagcctgttcaactagaaaatcaatgactggtggagacttagttgctagaccggcctttgtaaacaaaatctatctttggaagagaatgaggaaacttatgagagccgtagcaaccaagtgttgttgtagcagcctacatttattgaatactattttgttcactgctctattttcataagcactctgtatgtggacgattttaatcctctaaacagtgttatgaagtagataatattaatagatgaggaaactgagacaaagattggtaacttgttcaagggcacagtggagccaagattcaaactcgggcagtttgtgtccagagtacaccctttgaagaccaccaagcttataacttttctcatatataataatttttgccctgaattacagaaagatctgaagccaggatcgctcaggagacgatggagagagctcctagcagagttgggacggttctcagtgtgccccaatgttgcagttgtttttcagcatattctgtctttctcctcagtcaaggaccaacctaccttttcttttctagtgctgaggaatgtaaacaagtttgctgggccttgcgagacttcaccaggttgtttcgatagctcacactcctgcactgtgcctgtcacccaggtgaggatacatagttcccagcttttgtccggactgtcggactgttggggatgcctgggaatggggataggttttaatgcctatcatgggaccagtcttatagctagagtcagggaaggactcagcagtttaactgtggtgaacagctggaatatacagggcccggattttcttgggcctgggcagccagtaattgtcagtgtctttggggtaccattttcacctccataagaaagtaactgttacacagtgcattgaaacattttcttcccccttccccttacagacacttctaagatggtaagtgtacatggcaacaaacaaataagtatttttaacctggccactttggcgaaaacaacctcaagttgactgttatatgtggtgccagtctcctaaaactgaccctccagatgtaatgagcaaagagcttattcttatcacttttatgacctgaatgctgaagtgccaggttttgaccagggcaggaggtatgaattgaatatcccttatccgaaatgcttgggatttcggaggaaaaaacactttcagaagtgtttttcaattttggattttttgggattttggaatatttgcagaatgcacaccagttgagcattcctaatccaaaaatccaaaatccaaaatgctccaatgctcattcgcttgagggtcatatcagcgttcaaaaagtttcagctgttagggatgcttggcccttacaggagaggaggagcatctttggctcccgatgagcacttttctccacgtgctttccgtctcctggttctgaagcaaagcaagaagcttagctgaaaggagtgggtagtagaatttgggtgccagtttcttgatggagagaagaaaggtagctctcctctaag

SEQ ID NO: 127365 - DNA, 2134 bp, Homo sapiens
tcagctacattttgtagttttcagtgtataagtttttcacctccttggttaaattttttcataagttttttttatgctattgtaaacgaaccaacttgtactttaaagagctgttttattataaattatacacatacacagaggctactttctgcacagtaagttttcagaaagatatataagtgagactaggaggggaagggaggcttttcttttcgtttcataactttctgcactatgtgcacttttttatgagcataaattacacttttatgggtaaaatcagatatagaagggaaagaaaatgaactttaagcagtggtacaagagctagttgtcttttctcagaattgatttcttaatgtcactttccaaaatagtttactttctcatcttctggaatgtctccagcaattttgttaatgttaaaatcccaaaccatggaatgctattattttatagttcactaagtggcttaagtagtaagcccagtatgccccagaaataactcacttttagccatagatcaagtgacatgcatgactgaaaaatagcatgtgacccttcatgacacattttgccagaagtggggatttcccctccactgggtaggcatatattgactggggtgaccttaaaaattctttgattgcttttactatgaatcttctcagtagaagtagtattctgtctacaagctgtttcaggggaaagaagtgtagtagttgcttctctctgcttctgttttgcattattccattcagtgctggttacagtataagggcaggatcgtattggctctaattttcctaaagcaaatgggaacctaggggaaaccctccaaagatggggtttggagtcaagtatgttggtttgaatcttgccacataccctattactttgaacttcagtttatttatcaagtgaaatagggttagtactaccagtctcataaggttattatgagataccaaatggaaatctaaagaagatcttgcacatagtatgtgatcagtgaatgttaactcctttctccttggaggagaaacttctagaatgtcattatgtacttgcaaaactagctggggcatgtctcctgttgactctaaggcagccacccacacattctggaatcccacacattgtagaataagtctttgtcaagccctctttccctcagtgggactaatatatgacagataaaataatatggtaagtctgaaatcaaggtcatagatatcctttcctaatttaggataaatcttggggcaaggaaaagagacctaagtaaagcagtgctgtgggggaaaaaaaaaacctgttatctttgtcctgtgatatgggaaaataaggtgcaccaccaacctgacctacttgatcttccattgctaaacaagttttgcagctcttcctatagcaggctgtaacatatgtaacatagtggtgggaaatgaacagaagtaagagctaatgtagaggtgctagagaaaggacttgagattgctcatcccctcttagtaattctcttcctctagaatgcctgtagtagacaagacagaaagcccttgaactttctgtcccatgcatgactcagtctcccttttgattttaaggtccgtaacacctgcctcaacatgctactttgtttgccattctggcagagagggtgaactggtttagtttcatttcagcaagtccaagcctgcttttcacatggtactggtaattaattccctagcttttttttttttttttttttgagacggagtctcgctctgtcgcccaggccggactgcggactgcagtggcgcaatctcggctcactgcaagctccacttcccgggttcacgccattctcctgcctcagcctcccgagtagctgggactacaggcacccgccaccgcgcccggctaattttttgtatttttagtagagacggggtttcaccttgttagccaggatggtctcgatctcctgacctcatgatccatccgcctcggcctcccaaagtgctgggattacaggtgtgagccaccgcgcctggccaattccctagcttttttagttggtcaacttgaagaaagctgggacgtttcagtctaaaataacattcttgctttccaaatgccagat

SEQ ID NO: 127366 - DNA, 1031 bp, Homo sapiens
atagcctcatcccgaagaaacttcacttctaaggtgtagaaagtcgttttctgaaatgatgcccgctgcccctttgaagggaagtctaggcatgcatatgcagactgcatcaacccagagggtttgaagggctaatgagagcacttttgttgattcctttacttgctcccaagtgtagggaagtaaatgctactaaggaaaatttgtggggttttgttagtatctgtagggtctcaggtgagtaagctatgcttccttttaaaactcttacccctctttcctatacagactttttgtcgatggttagaaaattccttaaaaggtttgccaaaggaaacaaccgtgggagccgtcacagtgacacacaaacaacttacagacttccacaagcaagtcactaggtgagtgatactgggggttcttaaggaggtgtgggatgtgggaagaaacatatctttatttcttatgtgcccttgggaaatggacaatttatagtttgtttaaccttgaattgcacaaattggcattggaagccaatctggtgggaaaacattcaccatgctgtgtatgtatgtacatatatttaacatatgtgataactggtataagattttttaacggtaagtggaggcactgtttctcccaaaggaaaatgcactgagcagctcactccccgtcaggagatctgtctatatttttctaagtccttctgagttttcatccacattcgggggtcaggaatgtaggtacctgagtaaggcaaagcattggttataaaacatcagaaagtgatgtagatgacagtgaattggagaatgttcaccatgcctaaagatagtcaaattctaatttcaaagaagttgtgtagtccaaacagaacatctgcctgggatacattaggcccatgaggaacttacaatctctggattacagcctaaaatgtaaagtgtgtgtgttttttttactgtgaacatataaatatttttaatacagttacatagtcttcctaattattgttttatagccataaa

SEQ ID NO: 127367 - DNA, 1049 bp, Homo sapiens
gggttcaagctgttcccctacctgcgcctttggagtggctgggactatggtgtgtgctgccatgccaggctgacttagtttttaaaaaaggaaataggaacacaagttatttttcacattaaaaaaaaattaataccatcacatagaagatgaagagaaaaaaattttaaaaattgctaactttaattcttaaccatgttttctgccttcaaatcatgaaaaatctaagcattaatctctgttgaaacccatgttcattccttggatactaataaactccttcattttctttctaaagacaaaaaacttctggactttgtgaatccagctgtcattttacacacacctgcatacacacacacacagccacgcgtgcacacacacacacactttcctattaaagagaaattactaaaggggaaagagtgcttggtctttgggaagttgagactagaatttatctgatgttcctgctttcctacatacagcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccggtaagattgttttcatgaggaatttatctcatagtccctaaatgtaataggctttggttccttaaggccaaccctaattttgaaactagccctgttttctgtccatggaaccaaatttaggcatattgccaaattagattggtagatgaagaggcccgtaaagatcagtaatttattattgagttctttaaagcatgtttctatgtcactgtcatagggggtatattaccagaagtaagtatcaagcattgaattcagttgtgtggctgtccaatgtgaaatttgttcacttgtgagagatgcccaaatgtcagttatattagttacgtattactcaagaagtatttaatcctttcagacttattctatagcactgtattatttcttggtgat

SEQ ID NO: 127368 - DNA, 1061 bp, Homo sapiens
actgttatagtatcatacagaatactttcactgccaaaaaaaatcctctatgttctgtctattcatcccttcttccctgaaaccccccaccaaccactgatcttttttactgtcttcatagttttgcccttttaccctggctgcttttatagcctaatcttgtcatttatacctagtctcactttccacaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatgtaagtataaaaatgataccatttctacttaacagcttttatctcctatctctttgtcattccttaggagaaaaccagcatcccagtatttccttacttgatctatattggtagacatatatcatagtggatcattcactagccaaaatatcaactaagacacttgtgctgggtgctttaggctatataaagcagtctaaaactgttcatgctcccaaatcatttggtgtctagttgaagagagaaacaagtttaaagagttaagtaacaacaagatgccagtgtttggtgtttttcatttgtttttgaaacagggtcttgctctgtcgcctaggctggagtacagtgatgtgaatctcaagggatcctcagctactgagtagccaggactacagacattcaacaccatgcctggctagtttttatattttttgtagagatggcatttcaccatgttgcccaggttggtcttgaactcctggcctcaagtgatcctcccaccttggcctccagtatttgattgtcagatgagtgataaaagtcatgattggtatgagatcagacgagggaaagctctagaccaaaaagagttggaataactttatggaaggggagggatttaaatgaagccatgaattagaggtagaattttgatggattagagaggcagatagtcatactgcctctaagccaagatcagagcaagtcag

SEQ ID NO: 127369 - DNA, 1083 bp, Homo sapiens
tgactagtttacttagcagcagggagggttttagaattaataatagcattggaaacagctcctcagatactgcttttccctcccttccagccacagaggggaatattgagttgaagaatgttgtttcttttcccaagatgtcttttcatttaaaattgatatttcataattattataaaaacttccactcccttagtggactatacctaaatagaatctttgctttcagaaatttctaaaactttgagatgacatctgttgagttttatcagctaaaatctgttttctcaaccctttcttaaatgtggacttcataggtgaaaactgtttatgtcaactgggaaggatttatgtgtttcttttcctgatcagattctcattacaatctttttcttttcccagctgtgcttttcttctttgttccttttgtacttattgtaataaatatttggcaagtctgaatgctgtggcatttctgaaaaagcatttcttttaaaatcactgttttgttttaggcactgtgcatccccacctttcagctcctagaacagcagaatggtctccagaatcaccctgacactgtagatgacctgttccggctagccaccaggtaaatccttctgaagagcccatttcttaattgctcatcctatcactgcttagtcttgccatctgacccttggttgttttattcttgtaaaatgaagtcactggagtaagtagattaatgattcataacccaaaggtaaattgcaagctgatatatccccagcagtgacgcagagtattgcgggaagcaagggataaaggagctgagttcctgccaggaaggagggctcacacacaagacaatgcagtgtgcctggcaaaacacttgactagatcatctctacagtcctctgtaggttttaactgttcgtgctgttgcgatttcatgtttcacctcaaccttctctttgagaagcttagcatcctttagatataatcagtttcggaataaagaatgtttgggattttaagatgccttagcagttatctcatactgtatttctcagctctactcacagcctactttatcagtag

SEQ ID NO: 127370 - DNA, 1964 bp, Homo sapiens
caccaccaccagcctcccaagtagctgggattacaggcatgcgccaccacgcccggcttatttttgtatttttagtagagacgggttttcaccatattggtcaggctggtcttgaactcctggactcaggtgatctacccgccttggcctcccagagtgctgggattacaggcgtgagccaccacacccagcccatatttgggtttataaagggaaaaatggaaaagatagccatagtgcctcacagcccatctacccaaagttggattgaatttgcgtgttctattggaagtgacttaaaggtggccaaaaaatgataggatgatttaaaggatgtgcttataaaggtgatgtaagtaaatgactttatcatctggttttctttatttggtgaaaatgatactaagtaagcaagcagggatcagggctctgggtcctcagtgaaattggtctttgttcactattttgggctgttgtcttttcccaggcataccaatcccattgtggaaaatggacagactcatccgtgtcagaaagtcatacaggaagtaagtgctaatggatgcttgtggaatcaaggcttgcttcttttttccttacagggctttgggtaactcacctgagaagatactgtcttccaagttcatagggagattcagtttgttgatgtggtttcaatgaaatgagggacagagccatccaaatgtcttttattttagatttgataacaaaacaggctgcaagggaatgccttgaaagaccagagaagtggtagaaagagattcactgtgtgactcctagagttactaggaggcctgatcaataccagcagaatatttttgacaaagctagtgacttcgttttcctcagtgatgacatacttcccctctacttttttcactgaaggttatgtgaggatcaaaagtcatgttttaagaattgcttttgagacttcagaggacaaattacatcaacactaaatactcttaagtgtccaatggtctcaaatgatgccatttccttaactctagtccttttgttcaaattcttccaccttccaggaactatctttaaacatctcttcctatatagctcgtaccaattcttttcatagcctttcgggaagtctgaagtttaggaaattgtgtatctctgtcatttagcaaagttagacatgctcttccagttctaaagaggcactgttttctcttgttaagtgatagggttttgtggtgggtagtctattgaacctgagcatgctggccatgtgtgttcctatacagaaagttttgtcccagttatttaaaagctaaatgaggtgttaccaacttagcagtttttcaggtcctagttgttgattattttctttcttgtgctcttttacttttgacccagatatggccagttttatccgagactctaaataagcaccgagctgataatcggattgtagagcgttgttgcaggtgcctgcgctttgctgttcgctgtgtaggcaaaggatctgcagcactgctgcagccactagtcacacaggtaaagttatctgttgcggggggacgtgttccatgtacagaatttgaaataggcagggtgcggtggctcacgtctgtaatcccagcactttgggaggcctatgcaggtggaccacctgaggtcaggagttcaagaccagcctggccaacatggtgaaaccctgtctctactaaaaatacaaaaattagccaggcatggtggcgggcacctataatcctagctactcgggaggctgaggcaggagaatcgcttgaacccaggagctgcactgcactccagccagggtgacagagcaagactccatctcaaaaaaagaatttgaaataggagcctttagaacaaaaactttgctgatgaaatgaaacacttttgtatttattaacaaactaaaaaaacacttgaaagagattagtgcctgtgataggtac

SEQ ID NO: 127371 - DNA, 1029 bp, Homo sapiens
caagtaattcatccctcggtataattgtaactccctgagctttgcattctttcttacattgccatattcttaatacctggattgccatatatgctcttaagtcagtggtttacaaactgctctgtgaatccctgggagttaacgttgactgccctgagggaagaaatggaagatgaaatagatgggtctcagggcctgttgacaatatgtaagtgagatcagctctatttttatgtgttttatttattgtggttctgaacacatttcactttttaaaagggttcttttgctttaaaaaaagaaaagcaagtatacctctgttttaataaactagaagttttcctttagtttcagatatgtaatctctgcttggcttttcttcttagaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaaggtactcacttgatgttaaccactaatagtcacctcaaagccactacctggggtaatcttacatctgtcatatcccagtttttcagttgcaatgtacttagtgtttaagaatttataagatgaggaagatggcttttccactagaggggatagtgttgactatatgtacatgcattcttttcttggattatcttaagcctatataattaattaatactacttgcggtatatatagcaccgacctagatttgggtagagacaacatattcaaactaaacacggctgctttttaagttggaagaataaaaagggagaccaaagaagcattgccataccaaagaggtaaatgggagttgaaaggtagtatacatggatcagtgccatgagtagaagtcaggggtcctggtctcttagcagcctttaaccattactgatcagcttatactgagtga

SEQ ID NO: 127372 - DNA, 1179 bp, Homo sapiens
gccatgagtatataaatcgatgttaatatctgccacgctgaattgtgacctgatacctgcagtcaagctctgtattcagtcttgattggagagatggttaaggcagatatttataaaaagcacaatgcttctttcttagctgcctttcagggcctcgtcagtggcatattgtttctaatccagtaaatattcaaggaggtcgaataggtttatttttctctgttaagaagtcctggtccttaattatgtaccacactatttactcttaaaccaattttggtgtcattttgaaccttctgtgacaagtctgaagattattaaaatcattaatgttctaactaatatgtcttggtttgaaaaatgatggctagatagtcttcgttaattgacttagtgtccctaggaaacataagtcataaatgagagatttgatattttttttgtttatatgcatttcaagccaactgcatgattataattttttagtgcatataaaaggacttaatagactagtttattagcagagggtggtcttgctgtaatccaggatattatttacattttaaacatctttcatttctggattaagttctgccactttaggggtatcctccactctactcaaaaggccgttagccagtatattttgtgggggacagagggaggagagggaacagataaactcatggagctatggaaagtgtttggttaactttaattttccctcatgttccaaatcggggcaacttaatctattcctgcagcttattttcttgttctttcaattagtgagctgcctacccatacttaacctgttcttaaagtttccaatatccagctataagaaatcttttggagcaaaacaacagagaatggtctatgagaattattcattcatctgtttagccattcagcaatatttattgagtgcccactatgtgccaggcactgttctaggtgctgcagctataggactaaataaaatagattctttagaagaagacattcatccacagtaaatgtctgcctctccaatttaaagagcctgcatttgatagcttgatgtgtctgtaggcactttactggcattcagaagattaaggagcagtatgcttttcctgaaacaatatctttcatttctatcttttcctcttttttgaagatttgaaaatctttcat

SEQ ID NO: 127373 - DNA, 1020 bp, Homo sapiens
cctggccaacatggtaaaaccctgtctctactaaaaatacaaaaattagtcgggtgtggtggcgtgtgtctgtaatcccagttacctgggaggctgaggcaggagaatcactggaacctgggaggcggagggtgcagtaagcagagatcgcaccactgcactccagcctgggcgacagagtgagcttccgtctcaaaaaaataaaaataaaatacaaaacacacacacaaaccaaagattttctcctggtaaaggcagagaataggttgtcttgacttggcatacctcacaatttaggaaaccctctgtctaaaataaaataccctcgtgatttaggcaacttttgttcattgaaacttgactgcttaatggtttttttcttcttcttgattttatagaggtcattgaaagccgcagtgagtttaaagcagatgttatctgatttgatattttaggagggggttcctgaggagactgatgactttggggagtttcgcatgagggtatcagacctggtaaaggacttgattttcttgatagggtctatggagtgttttgctcaggtaagcctatttggagattgtttccagttttactagtcaccttaattgtattcacttctgtgtcttctgtgaatgttccatcttatttcttcaattttagtggctgaatgagataatagatatgcaagtgcctagcacactgcctggcatatagtagctatgtttatttaacattttacaagtcagttgcagtttatggatgattcggttatggtttactctgtatgcttgcactgattgctgttccacttgtacagctggaatagaagatcatagataagcattaaagcctctaggatacttatagggaatttggacctagccaggaacaataggcaagtgtttctgctttagtaattacgtaccaactcctggtaactcttgtagttatttggcattatctttgtccacacttatggttagattcctgtgcagtttcgtcccagaggtgactatg

SEQ ID NO: 127374 - DNA, 1765 bp, Homo sapiens
ttgtctcatggaaggctatgacttgactgttacacatttaaagtacatgttcagaaagaggctataattgaaagaaagaaagaggctctaattgttttcctattacatttatccatcactatcttcaaaggattggttccaggaccacccactacccctgcccctctgtgcacagtttccaagagatgcagatgcccaagtcccttatataaaatggtgcagtatttgcatataacctatccacatcttcccatatactctaaatcacctgtaaattacttataatacctaatacaatgtaaatgctatgtaaatagttgctatagggtaatttttaaatttgtgtttttcattgtattattatttacttatattttgaatattttctatcgatggttgattgaaccctagggtgtgcagggccaactgtagatcactccttagtgatcatacttcttgcttccctattcctgctacctccccagcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaagtgagtaattgtttaagtctggagccctgggtttacctacagtctggtcattcttttaagtcactttttattattcgtctgtcatttgtgattctcagtgattctgtaaagtacagatagtgcttcctaaagatgctctactatgctcttctgaacctagagtggcaaattgggtgcagggtttgtagaattaccatagaaaggtaaggctttaaaagttggagacaaattttaaaatatcaagtgtgatttgatgggagtttttattcaaatgttttaataattgagaatttgaactgacaagtcacttgcgtaggagtgtacgatctaggtaaaggtgtctgtcatggggattgtgatacagcatagtaaataatcactagatgtcccttagactgaggaaccttttatttatttgattaactgtgcctgtatatacttataatatccagatttctgactcattgttctcattcccctgtcttctacagagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtgtttatgctattcaaaggccattattctccaagttgtgtgctgcatattatctatatttcattacctcgtgcccaaatttttattgttgagaaattacagtcttgtttttaattaatgtgatttcatctgttttggaattttttaaaaaaattatatttgggtttctgcattgtgtccatttctgttttcttacctggttggctgggctgttgtaggcccctcaaggaactcgttagaaagcaagcctttccaatgaaccccttgtctagcttgacttattctctagagtgttacagctaaaaaacaccaaattctaactatacctccacaagtcttaacacccccaatttttctccaaatgatggatgagaatgacaaagggattgaaaggacttaagggtctctgtcattcagaatccttgacatcctacttaccgaggtttgctagattttttaaaatctcattta

SEQ ID NO: 127375 - DNA, 1045 bp, Homo sapiens
ggggaaggtgaaggggaagcagacacatgttcacacggccggcaggagagagaaggaggggggtggtgctacacactttgaaacaaccagatctcgtgagaactctatcacaagaacagcaagggggatgttcattcccatgattcagtcacctcccaccagaaccctcctctaacactggggattacaatttgacatgaaatttgggtggggacacagaacgaaaccatttcggggattaagtagataagttgtatttagaacagtggtgcctagctggatgcagtggcacatgcctgtagtcctgcctgggcaatgtagcaagaccctctctcttaaaaggaaaaaaaaaaaacagtgacacttaaacttaaaaagcacttttaaccgttggctgttttattgccatctttctcattattatacttgtaaggtgattgaaataatggtttaaatatatagattaacattattcattttaagtttttttctctattcagatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttggtaagtaatgaccttatttatcaaagtatttctgccaatcacttttcgtaactaacctgctgggacataaaaacgtttttaaatttttgcacagtaactggaaggcgtgtattaagaatgcagcaatgttccttccttgctacgaggtaccaaattagaagtatcagttttaatactcctaataggatatagttatgtttaagaggaaaacagtcttatatgttgatacatgatttacatattaaaatccaaataaccattggtatctttttccttgttttaaaaatataaaattatgtatttcaataatggtcattgaatcctagacatttccatgatataattatgtgtgcatcacaagtttaggaaaaaacagaacaggaagaattaaaaattatgtt

SEQ ID NO: 127376 - DNA, 1597 bp, Homo sapiens
atccttctgcctcagtctcccgagtagctgggattacagatgcataccaccatgcctggctgattaaaaaattttgaatgtagaaacggtctccctgtgatgcccaggctggtctcgaacttgtggactcgtgatcctcctgccttggcctcccaaagtgctgggatcataagcatgagccaccacaactggcccttaaccctgtattttataagcaaccactattaacaattggctatgtagagtttcctttatgcattttaaaataaataagtgcatatatattttaatgtacatatacctatatatttgttcacccatattcaatatgtttcatacatgtttttcacttactacattatggactttttttcatgttaggacatatagatatcatgttcattataatggctatgtttcattgaataactgtgtcctttttttaatcttaactaattatggaggacatttatgtttgtatcttttttctcccccttaacagtggtgggaatgttgcttttgttgttgtgagttactctgatggctgttatcttatgtgattgtgtattttctggctataaataacatatctccacttttttcttttgcagatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattggtgagtaagtttgaaatactaagttgctgcataaaggcagaaagccatggcggttattttgtaatcaattgcattattgtgaaatagctttctttgcaaaatttaatgatgatgctttggtatttatgtaacaccttaccatgacaacatactttcagaaactatgctttttaagtttctgtataatcctctaaaggtgacgttatctcttttatgaatgaaaaatggactttagagttacacaactgttaattcagaattggaactaaggccatctcattatttatcttgtgctcttctactgcttaatgctccaaactgttggctgttaataaaggatcatgcaaagggaagtgtgtataaatctactttactaagaaaggatcctttctttttttttctaattgatacatgatagttgtacatatttatggggttacatgtattacttttattttttgaagcagggtctctgtctcctaggctgtagtgcagtggcatgatctcagcttactgcaccctcctcctcctgggctcaagtgatcctctcacctcagcctcctgagtagctgggactacaggtgtgcgccaccatgcccagctaaattttttattttttgtagagatggtgtctctccatgttgcctaggctggcctcgaactcctgacctcaagtgatccacctgccttggcctcccgaagtgctgggattacaggcgtgagccactgtgcccagtgacatgtattatttttgtccaagtatgtaatatgtgatgatcagatcaaatcaggtgatgatcaaattgagatatccatcacctcaaacctt

SEQ ID NO: 127377 - DNA, 1754 bp, Homo sapiens
atatattaaaacagcttctggattcaattcttagagtgaacaaagctttattttaagcaagaaaagagaagaaacatgcagccatagattaggattggaaattatacagtgacattttagtttagtggagacttttgggacatttttcttcatactcttgacacccacacagtcattcaaatcaacaagattgtatctactaatttaactgatagctctcatgccttcctagaatgagtcagattttaggtaattattttgttgaacagggcctataacaatgtatattgaactgttggctgaattactgggtaatttagcttgtcagatttttctttctttatactttgggctaaatatgtttatataagtattgaggttatgtcattaaaattagaaaagtagtcttctttaagacatctttgtctaatacgctttcaggttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcaggtaaatcctgtgcttctcattagagaaatttgtatggccatttggatttatcaggattgttttaattcgtattgctaggccatgtgaggtaatgttaacttcattacagatgtactgctatgttcttgtaagtggatagaaaacgaaattgttaatcttttgtattaatcttggagttcatttggtttcaaactaacttgataccagaagtggataaggtgagtatgtgttttcacaggcatgctaggtcagaggtttaggtagttgccttttaagaaatcctttcagggctgattggctttagtaaaggtctcatgaatgaaacgttgaactagagcatctgtcctttcccccttggacagggaaatacattagataggaaaactggaaacttctgtgagtacgtactcacatgtgttctctgcctggcatagaagtgcccttaaagaggaggcttttcttaagtcttcaagatgacaaatgcaaagagaagggaaatggcaatccattacttgagaactgagtcaaaggtctgactttattagtagctttgacctttggcatagtataatttatatgtctgtgaagttctgtggtattgccaaataaaagtaaatattgatatattttgaggaatgtctatagtctgttgtttctgacttcttttcttttctttttttttagtttttaaaggttaactcttaaatttcagcaatttgtagctaacccaaaaaagtttacatcagatgtatagaattggaggttgggagaaatgggggaagggggttagtcttagttgtcatattgtttggaagaaatgtttctttgcttcccaattaatatttattgtgaccctatttctgttcatctgtcttcatttatttaatctctcttattcagctggctttagcaatagcagatcttgccctacagatgccttcctggaagggatgtgtgcaaacactggtggaaaagtaagtaatttgtattgactctatattagcatttggaattgccattaacctacacagagaaatttgttagcaatagctagatatttgactatttccctgaactcttaacatagaattatgttattaacctttgttaga

SEQ ID NO: 127378 - DNA, 1069 bp, Homo sapiens
tgaaaaccaaagatctttctcccagagagtgtaccaatgtagctgtgtcatccagtgtagtagccaccagtctagtgtgactatttaaacttaaaattaagtaaaagttaaaatcagtttcttttttttttttttttttttttgagacggagtctcactctgtcactcaggctggagtgcagtggtgcaatcttggctcactgcaacctccacctcccgggttcaagcaattctgcctcaggctcccgagtaactgggattacaggtgcatgccaccatgcctggctaattttttgtattgttagtggagatggggtttcactgtgttagccagaatggtctcaatctcctgatctcgtgatccacccacctcagcctcccagagtgctgggattacaggcatgagccactgcgcccggcctaaaatcagtttcttatttgcacttacccacattccaagtactgtacggtacaaatatagaacatttcatgtctttgaagtattggagtctatgtttgtgattttgtgacagtatttctgttgccatggtagtctgttatgtggtggcatttctccatattttgattagtttcttgtcttgccaggccttgggccaaagttgatagtttgatttaggatgtaaaattatcagggtactactatattttctaattacaatagtttttccaaagtttttcagatatttcttcagcattcttttacagtgattgattgcactgatgtttatggaggaaatggaaagtaggttttatagatttttttttttttgtggcaaaacattcaaaacataaatttagcattttaacgttttttttttttctgagacagggtcttgttctgttgcccaggttggagtgcagtggtgcgatcatagctcactgcagccttaaactcccaggctcaagctatcttgcctcctcagcctcccaagtagctgggattacaggcatgagctaccgtgcccagtcattttaaccatttttaagtgtgcagttcagtggtattacatacattgacattgttgtgcaaccatcaccatcatccatc

SEQ ID NO: 127379 - DNA, 3048 bp, Homo sapiens
tctcggcgctaatgtcccaagctgctagcgaggaacagagagaacaccggctcttcttcccggctcctggcccggcagggttacttccgggagggggcggggagacaagaggaggcgtgccgggaaggaggccgtttgtagtgtaccaggcggaagtgtgccaaaggtatcggtgctgtcgcttccggtccgggtaaacgaaccttaggtacactggtgtgtggcctcccaagataggcttctgagggcaagtcagcgactgaagacgggagcgccagaatctgtggactcaagagtctagaatcaagtggaaaaaccggaaaaaaggccaggaacctgaatacgacctaatagctgtttccgagggggcaacttccacggagagccttctgccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggtgaggggcccagagaggcagttctgtgccgcacggccggggcggggtggaacctaggctccgggggagaacctgagcccggcagttgacctcgtgaggtcctccttggggaggagctgctgtcgtggggtggggctgcgaagctacatctttgccgcttttgggaaactagtcgcacctgatcggtcgcgaactggccctttccccacccggcagaatctgatttgtaggtcttatactcttcgattgtggcatcaatctaatcttgtttaagttctccctttgccgttgcttcttgggccgtgcttttccgttttgtcttcctcccaccaaatccaaccccagtgtttctccaccttccgcttaagaaggctttattcgtctcccctccgtgtccaagacttgcatctggcattttgctcccagtcgtagccttatgcctcactctttttgcctattttcactccagtttgagtctgttcttctcgaaacttctcaggtttctagattcttactcatgcgagttttccccttgctttggagtggcaacataatatgaagaaaaaacagtaattctgctttcagaaaatctttggagttctcattttgtttcatattaatcctctaaccttgttatttctctggcttttagatttttatttataagatgggtatcactgctgctttgattattccatataaaactgtgtgtgcatccggtgagatatttaattgtagcttatatctgttgtatttctgcattctttgattcatgttttatgcttcctgccctaattttcacacctttgctgtgcttcatttctgtgtaaatgtgtattcttggttatctggctgacttaggttctaatgtaggatgtactttaaaaattaagtactttgaaaactaaagaggctttttttacaggctgacaaaatactcacctttacctttatttttgcattttatactcacaaccatattttttttggcccccttccctttattttaactcataactgatacttaaaggtgctctgccttattaaatcagctcctaggctgcaagtgcataatatttaaaaatttgcaactttgactttttaaaaatctggtcttggtatggagcaactttgccttttttttttttttttttttgagacagagtctcgctttgtcgcccaggctggagtgcagtggtcccatctcagctcactgcaacctcctcctcccgggttcaagagattctcctgcctcagcctcccgagtagctgggattacaggtgcctgccctgacacccgactaatttttttttttttttcttgagacagagtctggctctgttgcccaggctggaggagtgcagtggtgctatctcggcacactgcaacctcctcctcccaggttcaagtgattctcctgtctcagcctcctgagtagctgggattacaggcacacgccaccacacccagctaatttttgtattttttagtagaaacggggtttcgccatgttggccaggctggtctctaactccgacctcaggtgatccgcccgcctcggcctcccaaagtgctgggattatagatgtgagccatcgccccccgctgcaactttgactttgaatattaaacctaaaaaactggcacccaagtcctcttcagaaaataaaggaatacgactcactgtaggctacacaagaaaatcattcacatatggtctcatttagtgtttctgtgatctctggagagtcaacaattccctgatctttgtatagttttctaaagtgtaattaggagaagtgctacactatactaaaaaagtaatctctttctaattaaacctgcttgttgtgtgtattttaaatcaatatttgagtgcttaccatgtgccagcaactatgctgggtgtttggatttggaaatgaaccagacaaaaatctctgcttaccacagaaggtagttgtgattaaatgagttaatattctacgaagaggttagaaaagttcttggaacatagagattaaaatgttagcaattgttatttaagtattagtcacttttctctccttactttccaatactctattacaaccttacatcatcttcaccatcacagttaatagtcagagtccagacaggaacagatggcacacttgacaggataatctgagtttattttataaagatactattataaagatttaggtatagtggtgtgacaagaaatagtttggtaacctatagctgaacggttaacatcccataaaagagggaatagttacttgaaaagtatggagttggctgccttgagaggaatggtgactttcagccgaagggacatagctagtttcaggtgaccttgagagaatgaagctggaggaatgaatatcc

SEQ ID NO: 127380 - DNA, 1220 bp, Homo sapiens
cgccccgccacggtgctctccgcaggggtgaggcaggagggtgggtggaggcgccagcctgtcctcagctggaagggcggggcgtggacagggacggtgggcaggtcaccagcgggacgcggggagcctggccactgttacacggcggtgcgcgtgggtgtgccgggctggttcagccccagggttttacacaactagcaggcaaaatccgcttctttcacctcggaccgcttgatgaaggcgtggtttgtgagcatctttaggtccgcccgctccgttgggtttttgatgaggcatttattgacaaactcctggaagtcgggggtgaacacaccgttgggcagcttaggaggcggctctttcacaatatagtccagcagttcgaagatggccatggcgggcaggctgtccatcccgtaaccgctgttggggcgcccgggggaccctggccaagaggagatgctgtgaggctctccttcttccctgtcgaccacgggctggccaaagatggcctccagctccttggcgtcgggcggggggatggggtacctttcgatggccagctccaccagggacaggtccatgctccagatgaccgactgcaccgagtaatgtgtgccctgcaaccgctccggagccatgtaggagcgcgtgcccacgaaggagttggccatggagtcgatgagctggccgctcaccccgaagtcacacagcttgatctcccctctagagttcacgaggatgttggagggcttcacatttcggtgcatgatctggtgcttctctcggaggtacgccaagccccggagaaccgcaatgctgactttccccaggatgtcctcgggaatcctcttggcctctttcagcccctggtccagggagccgccatccatgtgctccatgcagatgctgatctccctgtcacagtagaaggccccgtagaagcccacgatgtacggtgagttgcactcgtgcaggacctggtgctcgcggatgatctggttccggatggccggcttgatctcaaggtggatcagcttcctggccatgatgaggcccgagggtctgtgctggactttggtgaccaccccgccgttgcccgcgtccagctctgaggtcctttcgaagtcatcgtctttgagttcgccgaccttggctttctgggtgagaaaggcttccagccgcttctgctgctcgtcaagttccagctcctccagctt

SEQ ID NO: 127381 - DNA, 1025 bp, Homo sapiens
ttgagcagctgcagcctggatgctttcccttaggggtaggggagaggcagaaccgctgaccctttaacaagttatccctcacagaacaggtgtctcccccgactctcggtggagagggatggctggatacttagtgacatcagccacgagccaatgggaagtcgggctcctgcacggcgcggctcggctcatgcccccgggcgcggggcacacaggccggccggcagccgctgggaaataggcccccgggggcggtggcggcggcggggccatggcgcggagaccccgggcgccggccgcctccggggaggagttctccttcgtcagcccgctggtgaaatacctgctcttcttcttcaacatgctcttctgggtgagtctcggggtcgagggcacctgggcggcggggtccccccgcggggtggaagggtggcccggggtgccccacgcgcgggagccgcactgccgagttttctgggctgacggcactttgggggaatttatcctggggagggacaccccggggacgccgcgtctgcagggggcgttgtagggaggagggtatgccagggaatcagtaaagactgatgggtattctcggggcgtcggaggagggtctgtgttaggctagaaatgtgggtttgagggagcctgttggcccaaggcggacccactgacacattcatgatgggggtcgggggtggcggctgactttcaggcctgggggcctggaggcccggctggcaaagaaagaagaggaaggaaaaacccaaacctctctctccaccacctcagagaggatgggttactggcatcatctcttccttttgcaggcctcatctacccccacctccacccccccaaagtctaggaagaatggcctccaggtgcagatgtctttcccatcccagcactgccccaaactttgtcccctccctgccacccttctcaggaccagacttcacccctggagcctggcaatcaccagtgtctttaaacaggaccccgtgttgggccggagggcc

SEQ ID NO: 127382 - DNA, 1218 bp, Homo sapiens
ctccggggccacaggctgaaagctctttggcttcatccagatataagggtagggaggactgagaaaccagaggtggagaccactgccttgcccacttccctctgggcagggacagggttttgattgccacacagggaaccactttaccctcagctgtctccaccatcaccttcaaaacaggagggaaagagattctaaggagggggtgcgggccctgagacagtggggctccactgcttcttgcagcctggactttggactatggaagacagacaaggctagggctttccctggaggctacgcctgctggtggccccactgtggcaacgccatgccttcccttttcagagtgctgttccagagacttccctctgagccacctcctgggccctgctggcaccctgtccccgccgccagctgcaatcttccttcccctgcctgaaaaccagcccatttggagattatcagctgctcccccaagggaaccacaagcagctgcttcccatctcccatgatggctgatgtgaataggcaaaatcctgggggtactgggaggcagagataggaaggcagccaagtggccaagctcataaggctttggggacatccagacctaggttccattcccacttcagccgctcactagccatgtgaactgaggaaagttgctggaattctctgaacatcagctctataaaatggagatcctaatgccctcttgggtttgtggtcagaattaaatgagacagtgtttagcccagcgcctggtccttagcactcaacaaaaagtactgccactgctgtccctgtaaatgctcctagaggtcacctgctgggggtgggcgtggagagtgaggctgagcgctcctccagggaggaggaaagagagtggcaagcagacagggactggctagggaagggccagcctttgctcaaccctctttgctcacattctcaccataacaaaggaaaaccaaaaacaaaggaagaaaatcaaagagaaaagaaaaaaagctaagcaggagacaatcattattggtagctttatattttttagtttatggagatacttcctatatatcccatgaacagagctccactgttgtctcctgggcttccctagctctgcttctcaaggcttgtcacaccaccttggccttttaaaacttttatttacgtatttatttgtttatttgtttgtttgtttagacatggtgt

SEQ ID NO: 127383 - DNA, 1047 bp, Homo sapiens
ccatcccagccctcagcattgtgccagagtgatacccttaagtgtttgggtttatgttttcagttttgtttgggaaacagcagttgcacagagagttgggggtactgctgctgccttttcaccgaggcactgccaccaccagctctagcagggatgctcctgagcttggcggacatacttagatcctaacgtgccagtgagacctggctgtggagagtagcactggcagccctgcctggactccacttggcatgataccagctccagaagggaagggagtggagcaggcagtgaggagagagcctgggggtcggctggggacagccgtatgtgctaggtaggagtggagggagatatgtttaccaaatgcctgtcctgccatcctcccaggtagtcagagtgagctacatcctgccccgccttcatttccatggaaacatggcagctaggacacggggtacaacagcagccaaattcttccccacctcccttacttcgaaaaaaagtttggaaccctggtccctatactctgcagtcagaagtgggactgagccatacatgcccttgaattcctccctgtctggccctccctctccagcaagcagggttttctttaacttggcagtgtgcagaggagaagtggtaacacccccaccccattcccctgcatcggagctcagtattcctacagggtaagaggtaggaatcttgctgggacgaggggagccagaagtggcaataaaagcgtgttgacctgggctacgcgggactccatgaattttccattctggcaactggaaggggaggtgtagaagggccctgcagaggacggcactggagactctcctaaacgccacacacctcccccttgctgcccgccacacgcgcgtctccttcaaccgatgcattgccaccctcccacagcctcgccctctgctctaaattaggtcgaaagagtcccagttccaatctaggaacagcataattttgttccaaaacctgatctgtgtttttctaattaaaattaatttgtcacccaaaacagga

SEQ ID NO: 127384 - DNA, 1226 bp, Homo sapiens
aagtataagagttgcagtagaactggatcaaagcgtgtgaggggtggaattgtgagagataagacctaaagaattagaaaataaagggatttatacctcatattaagtttggatgttatccaggggatgataaggagccattgaaagattttaagcaagggagagatgtaattgtctttgcattttagctggatctctttgggtatggtgtgaagaagccataggagcagggaaagcctggagcctggcttcttgaccaggggatgttgaagtagcccaagtaagagacgatggcggttgggactgggtagcaggacagagggagtgggcagatcccactaactttcagaggtagtgctcatagggcactgatgagttagatgtggagcctcagtgagcaggaggcctcgggtttcaggcttggatggaaggtggtgccattccctttcactaagatagagaatgctagaggaagaagaagtttaggcaggaggtgtggctttgattttggccgtgtgaattagagatgctcattggacatctatgtggagattctcagcagatctggaaataggaattgctggagagaggtggccactgtgtgcttccttggccctgactactgaggctttggaaggatgccattgactgaggaagtttatagctcaggttggtccaatttctaggtctgtatagacctcaggtctttcctctgtctttcatctctctggcctcaggcttcttcagtcacttagcatctctcccctttacagctggaaatgcctcctcccgggcattccaagctgaccagacaaacataatgtccaggccgtggtccaccttaggccaaacctggtttagtaagtggggcaaaaaagcagagaggcctgcagctggcagtggcgataggtccctgagagccagcacgtagcctccttaaccactgctgtgctctgtgtggtacataagtgtgtggccctgtcaccttgcccacttgcaggtaagtaggagagagacaaaggctgggaggaatttcttgtttgcctctcacacattgaattgagggctgagaggaggaatgtttttggtgatggtgggttattttcagggacggatcaggaagaatttccttagagctatttccaaacttggctggtaatcagagtcagttaaaaagatatatatggccgggcgcggtggctcacgcctgcaatcccagcactttg

SEQ ID NO: 127385 - DNA, 1032 bp, Homo sapiens
atattttattaaaataaaagaagtaaaataatactgataaagctgatatcccctctctttctcgtttcagtttcatatccttcttttctctttggaaagcttccccatcctagtaatttgtgtatttctttattttgtttttaagctcaagttttgtttttgtttttgtttttgtttttttgtagagatggggtttggccatattgcccaggttggtctcgaactcctgaacttaagtgatccacccaccttgggcctcccaaaatgctaggattataggcgtgagccaccatgtccagccttaagcttaattacttttaaaaaataggttatacatgtacatggcacagaattcaaaaggaacaagttaagtcctacttctgcatctagctacccatttttcctctgcagaagtaaccaccaacactggtttttgtgtccttttggaaatatccaacatctgtccagatgtagatgtgctctcagtctctcctctaccgcccaaccagtaccatgctctatagactgctctccactcaactgagtccatgtaacatgacaacattggacatcattccatttcaatgcacatcctgtcatgcaccccagaaggagattttggttaacaatggaccacatgtgatggtgttcccttaagattataataccacatttttactgtagcctttcaatgtttagatatgtttagatacactgatactcaccgttgtgttacagttgcctgcagtattcagtatagcaacatgctgtacaggtttgcagcctagaagccataggttatactgtatcagctaggtgtgcagtaggctataccatccaggtttgtgtaagtacactctgatgttcacacaaagatgacattgcctgatgacacatttcacagaagatatcctcattgttaagcaacatgtgactatatctcaaccctgaatagtgttctattataatggtgtacattattttacttggttggtctcctattgatggatatggattcaagctgtttctact

SEQ ID NO: 127386 - DNA, 1066 bp, Homo sapiens
agtacctatgtactcagaatttctggtgactgtttttgggttttttgttttttatttttttgtttttgaggcagagtctcattcttttgcccaggctggagtgcagtggcgccatctcagcccaccgcaacctccacctcctaggttcaagcaattctgttgcctcagcctcccgagtagctgggattacaggcatgtaccaccacgaccggctaatttttgtatttttagtagagacggggtttcaccttgttggccaggctggtcttgaactcctagcctcaggtgatctgcccgcctttgcctcccaaagtgctgggattacaggtgtgagccactgcgcctggccaactggtgactgaattgagtcaagtgggaactgttgcctgaggacattgcttcttaactggcaggaacttgctctgcaccctggaatatactctgaaggctgggagcagtcagaggcctcagacaaataatcataagagttaacatttcctgagcgcttactacatgacaggtactgtgccaagggcatttaaagcattatatcacttttcacagcagttccatgaggtaaatctatcatccccattttacagatgaggcaactgaggctaaagataaagtactttgcccaagatcatacagccaggaaagagtggagccaagatttggacccaggctgggcagttgccatgcacatgccccttacctctctactatgttgccttcccccgaaaagagtggttacctgtctctaccacccccagcctggaaatgtgaccggcacccatgttggctctcacatcctcatattctctcctaatgcaacttcttgcttgggaaatagatattgctgaagcagggttgattcaggaagggcttctgtgatgggcagggcggaggactaggctggggacgggtgctgggagattgccgcctgtttctgtcttgctgacaacatttttcccctctccgcactggacagagcctcttctgttcctctccatctgacttcctgcttcctcctctggctttggagtgcctggctcctctgactacc

SEQ ID NO: 127387 - DNA, 1094 bp, Homo sapiens
cgctcttcaccctggtcagccgcgggagggcaggcccggggggccctcagcctggaacgtgggaagagagccagagggaaggggggcaaagaggtcttggtgggggtccccagggaagggtcatgatcagaagggtctggggctcagttaagggtgtctgtgtcagcagaataaccctaacctcacagaatggcccacttctctcttctaggccacattcgtggctgactggcggaactcgaatcgctaccctgctgttattctcttctacgtcaatgcgtgcttctttgtgggcagcattggctggctggcccagttcatggatggtgcccgccgagagatcgtctgccgtgcagatggcaccatgaggcttggggagcccacgtaggtgtcttggggacccagaggtgaaggtacagggaggaaggctgaagtgtgcgtttaccccaaagggagcaggtgcgtgtaaaaccgagatccagggcaggatctggctctgccctactgcatactgcatgcaagatctccagtgttaggatcttagtttcagaatcaggaccttcatggtttgtatctgctcaaaggggcggctcctagagcctcctcagatctgacctgggtcctgtctccaagccctgacttctgggaacctccagacctcagcagctgagggtctgggcacagggtggggagaccaggtagagggagtacagagtgaccgcctcaagtgacacctcacctctctgcacagctccaatgagactctgtcctgcgtcatcatctttgtcatcgtgtactacgccctgatggctggtgtggtttggtttgtggtcctcacctatgcctggcacacttccttcaaagccctgggcaccacctaccagcctctctcgggcaagacctcctacttccacctgctcacctggtcactcccctttgtcctcactgtggcaatccttgctgtggcgcaggtatagtgactggtaggaacgggagacctggatggggtgagtttgagggagggggccagtaacccaccttctgtcccaccccttcctgctgcaggtggatggggactctgtgagtgggatttg

SEQ ID NO: 127388 - DNA, 2181 bp, Homo sapiens
cggcagtgctgggagctggagccaaggccataaagacacccacctccacccaccgggcagcagggatttgccaggtccctgctgcagacagcagattcaatggatggtgtctgggtgcataaggcatcagtctccgtagtttctcaaacgtggcaaacaaccttcgcatcccttctcacctctgcccttccctctccacccccttggttgcccagctggtgcatgtgtgactgttaagcagccagttcagcttcgtcttctctgactgacactaagttgccctctaattctgtgtgctctcctgcagagcctgctttagatcctggcacaggactagttacctctctgtgataggttaatgacctgctaatgttggctagtttttgcctgtgcttttttgtgtcataatgaggatggattggagagagtaagacattgctactgctgagagaagcgcagtacccactgttacaaggacagtcgctaaaatggatgctagtccaagccctgactgcttcaggctcttccgtaaaggttccggcttccagtctgggatgctttaaaccacagtgatgcctgagtctctgccccagagattcaatttaattgtctagggtgggtcccaggcatcagtagctattaaaagctccccagttgattctaatgagcacccagggttgagatcagtgctgtggagcttagccctttctaaagtttttggattgattgtctgagtctacccagtagactcagaaaaccccacctgtagtcccagctacttgggaggctgaagcaggagattgcctgagcccaggagttggaagctgcagtgggttgtgatcacgccaccgcactctagcctgggtgacagagcaagatcctatctcaaaaaaagagagaggaaaagaaaggaaagcctcacctgtctacgttccctcactgtagatgtcaggccaatgtgaccatcgggctgcccaccaagcagcccatccctgactgtgagatcaagaatcgcccgagccttctggtggagaagatcaacctgtttgccatgtttggaactggcatcgccatgagcacctgggtctggaccaaggccacgctgctcatctggaggcgtacctggtgcaggtgggcatggcagccagcccctcctgccctgcccgcctcaccctcagccttgggaccccatctttaggttttgtcgggtcctgcctctagcacagccttggtcagtggttcaccgctgccccctggtggcaccttctgtccttgggtggcctgatgcctgggcctgggcctgggccaagggcagagccagctgccatcaccttttaagagcggagtgattggagggctgggcacacaggagctctgcattctggccccacttctttgcagagaaggcctctactcctgagtccttgaaggacttgaggcccttgggagcctccttctctggaaagaatggcatcgctggcccttcccaagatttgatgggaagtggcagcttcttcacgctccttccctatcccttctgctctcaggttgactgggcagagtgacgatgagccaaagcggatcaagaagagcaagatgattgccaaggccttctctaagcggcacgagctcctgcagaacccaggccaggagctgtccttcagcatgcacactgtgtcccacgacgggcccgtgggtgagcctcacccctcctctaccggagccgcctggccccgcgctgcccatgtgctagtctctcccagcctgctgggggcacacagattatttggaagaccgactgtgaggagcaaggcgctccctccatcgctcacacacccattcttcccccggcccctcctaccctctggggggctctcccctctctgtttctgcccctgggtctgcttgccggtgcttgggttccaagaagactcccctccctctcccttctcataaattctccagttgctctccctgggcaagagtaagtcagggttccaagaactggatttctggcctccagttaggccctttggggacgtgaggcccttctcttcagattctgaaggggtagagatcaccgtggttacagggtgagctttctctggtgagcaggagggactggctgtgggaagatgaatggcactgactatgggaggcactgccagggaccgggaagtc

SEQ ID NO: 127389 - DNA, 1130 bp, Homo sapiens
gtctagagacctgggccccagaactaacaggttaagtgctcccaggggagcgggggtggcatggacagagccagggccccaggctcgtgttgtctctcctcctgtcagtgcccccagaggaacaagccaacctgtggctggttgaggcagagatctccccagagctgcagaagcgcctgggccggaagaagaagaggaggaagaggaagaaggaggtgtgcccgctggcgccgccccctgagcttcacccccctgcccctgcccccagtaccattcctcgactgcctcagctgccccggcagaaatgcctggtggctgcaggtgcctggggagctggggactcttgccgacagggagcgtggaccctggtctccaacccattctgcccagagcccagtccccctcaggatccatttctgcccagtgcaccggcccccgtggcatgggctcatggccgccgacagggcctggggcctattcactcccgcaccaacctgatggacacagaactcatggatgcagactcggacttctgagcctgcagagcaggacctgggacaggaaagagaggaaccaataccttcaaggctcttcttcctcaccgagcatgcttccctaggatcccgtcttccagagaacctgtgggctgactgccctccgaagagagttctggatgtctggctcaaagcagcaggactgtgggaaagagcctaacatctccatggggaggcctcaccccagggacagggccctggagctcagggtccttgtttctgccctgccagctgcagcctggttggcagcatctgctccatcggggcagggggtatgcagagcttgtggtggggcaggaacggtggaggcagaggtgacagttcccagagtgggctttggtggccagggaggcagcctagcctatgtctggcagatgagggctggctgccgttttctgggctgatgggtgccctttcctggcagtctcagtccaaaagtgttgactgtgtcattagtcctttgtctaagtagggccagggcaccgtattcctctcccaggtgtttgtggggctggaaggacctgctcccacaggggccatgtcctctcttaataggtggcactaccccaaacccat

SEQ ID NO: 127390 - DNA, 1487 bp, Homo sapiens
cccggtccccggcccgggctcggggcccgccgccgctctcagccccgccgccgggaaggtgcctcaggcgtcggccatgaagcggagcgacccacatcaccagcaccagcggcaccgcgacggcggcgaggccctggtcagccccgacggcaccgtcaccgaggcgccgcgcacagtcaagaaggtactggggccgggctgcctctctaggagaggaagggaggggaggggaactgcagatcctctcggcacggcggcaccaccctccacgccctcctttctgatcgcaggaccggagataccccttgtccccttaaacccactctctcagagatgccccccagccggcccctcgtgctgggagcggagactccaggaggcacggccgtacttcgctctgaataacatggaggtagcgctctcccctactacttggaataggcagcgggaggagagacacctaatagtacgtcccgcggccccaacacgctcccgggtgtgattttccagcctatcggggaagagacctcgatagtatagaaaaaccttaccgctcacgggagttcacacagcaataaggatgaaaagatctttaatacttggagaacgagtaaggtgtagtcaccttgcatagaaatcgtcagagttgtctggtttccatacagttgatgactttctgcctttctgtggccaaccgtggccatacagcaacacgatgctgtgcccttcatttccagcgactgcgatattctctcttccctgaatatgtaaaagggtaatggagagattctcctcactctttcgtgttaagagctttgtcctccctgctgggtatagttggtcaccaggattattaggctgtgtatgaagagaatgaatgtcttattgattgctttattataatctgaaagtgataggaagaaatgctgctacttttgggaaagacgatctttgtggggttttcggtcttaggcgtcagcttctttcagacagttttgaggaggtctcagaataccaagaagtaactgcctaggtggatgatagccctgtattacccgtacattgtctatccatagttgtctgtctctctcaaagcttgtctttctttctctcttaaagctgaatcagcacagaaaaacagggcaagtattggaaaagacagaagtgtggatcatataaaaagggcttacagcttcaatttcgtagacacagtatgggcacagggattaatgttttttttaaattgttgtgaatggtttttaattgctttatcagaacagcaacaaagagacgggaagtgtgcattggttttactgtgtgggaccagctgaattggaaccttggatccaccataactttttgttgtcatagcgtcatgattaaggtatagcggataatcctttcatcctaacgatacaaatttaggtgataagtcagaggcaagactgaaggaatttctgtaatgctttagacaatgtctttgtcgt

SEQ ID NO: 127391 - DNA, 1028 bp, Homo sapiens
tagatgtgcttcttgaccactttccttgtcgttgaaccatcttcctgttttttcagcaccaaatgtatgttccatgattgtagatatactcagcagcctcaaggctattgtaaagcagggctgagcttgccttacaatgttaattgcaccaaaaaaacaacttctctgctgaaagttaagcaggtgaagctctgggcaaggatacagctggatgacgaaattcagggcattgctgagctgcttttcaggtgcccaatctttaaccttcttgatattgaattggctaaatcaaaataagtgcccaagactgccctttccctaagttgaaagtcatctcaccaaggaactgcagtgtgacattttgatttgttgagcctttgttgattcttagattgtctatgtaaataaccactttgaccttgactccttactgtttttcttatagcatatgaaggaactgagaatactagtattgaaatagctgcctttggctgtggaactggtgactgttgcatttgttttttaactttcatgtataaacatttattttaagtcacatttccatagatggttttccttacttcattcacatatcatcagttttcttagttttgttactctgctcagccacacaaggggaataaactttttacaagagccagaattcccaagtgcagtagttaataagaaggaacatatggtgtgcaggttactcaatcacatcttatctttggcacctgcctccgtcctgtaacttgcgatgctctgggggccagatcatgttatgtggctatgatatatttaattatagtgtcctttttcataagttgacatcaagtgaacccagcaagccaaaaatctctataagaagtaatttgggaaatgggaaggtaagttccacagggaatgaggtagtactagctgaaagggatttcttccttgtgttcttgaaaatgagtgataggagtgttggcgcacagcagggaaaacaaggcaggagaggatttatttcagaaatattaaaactt

SEQ ID NO: 127392 - DNA, 1029 bp, Homo sapiens
attttcagtagagatgaagtttctccatgttggtcaggctgctttcaaactcccgacctcaggtgacctgcctgcctcggcctcccaaagtgctgggattacagatgtgagccattagccttttatgtgccaggagttgtcataggggttctgtaatcctcacaaccatactatgagatgtaggtggcattatttccattttatagatgcagaaatgagatcctgggaggttaagtgccttgcccaaggttatacatctagaaagtgtcagaggtagaacttaaatccagggctgtccgtctccaaagcccatgtccttttcattatgccacagtgattctaacttcttagatgctgagttcttgctttctcccagaggtcttttagaatactaagtgaactctaaggcgtgtctgtctggctaaggcttaggtcatcccaagaccaaagtaaggcaggtctgagttagagctttaggaagaggatgggagaaaattgtacaaatgtagaacttgaaagaattgtaaatttagaagaggagaataaaagcatcttatacagaaaagcatttcaagatcaatgatgcagcttcacactggtaatttactgataatctgagaaatttatccatattttaaaagttataaataaatttggagtacctgaggaatataccctttcttcctgttcagctaacactttttccctattctttaagcctcaccatctctatgagtcaatctttgataagagcttttgaaaattgcaaagggaagaatattcctactgtataccaggcattgtacttagagctttacatatactgttttatttaattctttttttttttttttttttttttgagaccaagtctcgctctgtcacccaagctggagtgcagtggcgatctcggctcactgaaacctccgcctcctgggttcaagcgattctcctgtcttgccctcctgagtagctgggactacaggtgtgtgccaccacacccggctgatttttttaatttttagtaga

SEQ ID NO: 127393 - DNA, 1040 bp, Homo sapiens
gctactcaggaggctgaggcaggagaatcacttgaatgcttgaatgcgggaagtggaggttgcagtgagccgagatcatgccaccgcgcttcagcctggcgacagaatgagactctgtctcaaaaaaaagaaaaaaaaaagctgctttaggagctgaagttgcagttgtgtgtttgatgtcttgaggaagacaattactactactactactactagtactacctacattctcagtatccagttaattgaagaaatcgatagttcattaaaaagggagagtgagtttattatatcatttccttggaagtgattccctcccccacgagagaaaaaaagtttgttgtaatctttattcagaccctttgtcaagtttataaagaatatgcagtttgtttcatggtggtttttgtttaaataatttagagaggtacaactgaggcagatgggaagagaacaatcttggcagttgccctgatccactgccctgctgtcatgtttaggtggtagacacaattagaggagctgaaattccattcacccaacaagaggtttagtaaacttgatcagatttctatggaatttgtaggagctttttatagtctgaatgacctatggcctgcgatttggtgagagcagagcagaaagcggcagtggattgacgtttcttctgtaacagttcccaactctaaaattactttgattaaattagatgattatttgtatgggtttcagtctcccttttccccagctgtatcgtgcaacagttcagttagctatttccctcttggacgcttgcactaaaagctggtgattttattttctttttttttttcaagggtctatcagtagaaatctattggtttggggcacctagttcttagcttagaacctatataaaggaagggtatttgaactgctgattgagtttctctgagtataggactttagcctttctgaatgttgcaaacctgaggctaaaactagcttcatcttctctgcacacacttacattctacagtgctccaaggtgaaacttcatc

SEQ ID NO: 127394 - DNA, 1178 bp, Homo sapiens
tcaggtgatccgcctgcctcggcctcccaaagtgctgggattataggtgtgagccaatgtacctggcccagctaatttctgtgttttttgtagagatggggttttaccatgttgcccatgtgggtctcaaactcctgggctcaagcgatctgcccgcctcagcctcccaaagaggcataaaacacagtgcttggccgtgttttaaactaaatgcaaaatgccatgttgtctttaaaaatgtagtaccattttacatatcagctaacgatacacgaaacaactctttcaccatacatttaccaatactgagtatttttccatctttgggggaaagtcttttactggtctttttataatatctgcattcttctgacagaatgaggctgagagtattttcatgcatatattggcaatttatattctttttcttgtaattccctgttcatattcattaacaaattatttattgattgactactgtatgccaagtgctggggatacagcagtaaacaaaacggataaaatctctgccttcgtattggattttttttttcatgttggttttaggaattctttatatattctggatattaattatttgtgtatatgttgcaaatattttttcctactccatttcttgtttcttgtaacattgtttattattttcaaagtttttataaacttggatttaccagtttttttcctttttggcttcaacattttgtgtcttagaattgcctttccaaccccaaatttataaacaacatctgtgttttcttcacctgtttatatggttgtatttattatattttggtcttcaatccatctggaattaatttttgtttgtaatgtaaaatagggactatttgtaatatgagatagctctatttgttcccaaataaaatatattttacctttttctggtttgttctctgattgtttctttaacttgtctttcttaactatttttctttcttaactcttagtttacatgtagaagaaacttgtgattgaagactgtgcctatttattaacgcaaatatgacactaaaaattagcatcctgatactactgatttagtgtttacggtgaattattcatagaaatacttgctattttagcgattttttttttttgtttatgtagattagtttatgttttgacggaaattggagccc

SEQ ID NO: 127395 - DNA, 1657 bp, Homo sapiens
cagcactgaaattgaggtgaaacccaagaggtttcaccatgtgtcagaacctctgtggccgggcgcggtggctcacgcttgcaatcccagcactttgggaggccgaagcagcagatcacttgagctcaggagtttgaaactagcttgaccaacacagtgaaaccctgtctctactaaaaatacagaagttagtcaggcgtggtggggcgggtgcctgtaatcccagctgcttaggaggctgaggcaggaaaatcgcttgaatccaggggtggaggtggcagtgagctgagatggcaccactgcactccagcctgagcaacagagcaaaactccgtctcaaaaaaaaagaacctttgtgaggtttccttgttccagctttacaagtctagaaattcacatttttgtgcaatcagggatcatttacctgttaggactggctcagactaaccaaaatcatgggagactcatatttaaaacaaaatggtaactcttaatttacagtcatgtataacactcaagctaatctgataaacgtgtaaatcagaggatattctggaaaatctatatgggaggtctaattatagttagagacagtttattaagtttggaatcatttagatccttgctattcaaactgatccttgcttttcaaaccagaagcattggttatcacctgggagcttgtgagatatgaacaatatcaggtaactctggctctgtactagcatatatctgtcagaacctcaattttgtattcgttgttgagtagatgttggcttagcaattagtctcatttcatgtttctcatttttattaattttttttttttttttagagatgggggtcttgctttgatacccaggctggagtgcagtggtgctggagtgcaatggtgtgatcatagttcactgcagcctcaaactgctgggctcaagcagtcctcctgccttagcctcctgagtagcttgggattacaggcccaagccactgtgcccagcttcatgcttctcttttatgaaacctcagagtagaaaagcaagaaaataattttagggttttatggaaaggtggaaacttacagtaaaacctgttataagacttataacaaaatactcaatagacacaaagacatagaaaaataaacaggcacagatatatagagacagacacaccgagacccagagggagagttacacacagactccctacacacagagacacttcccccatatatacataacagaacccctgccccaccatgcccaagcctctacccagtcccttcccacacacagagaccccatacccacagagagaaccccacggctggccggacgcggtggctcacgcctgtaatcctagcactttaggaggctgaggcgggtggatcacctgaggttgagagttcgagaccagcttgaccaacatggagaaaccctgtctctactaaaaatacaaaattggtcgggcacatgcctgtaatcccagctactcgggaggctgaggcaggagaatcgcttgaacccgggaggtggaggttgcggtgagccgagatcgcgccattgcactccagcctgggcaacatgagcaaaaaaaatccgcctcaaaaaaaaaaaagaatcccatggccatctccacagagagtcttctccatggt

SEQ ID NO: 127396 - DNA, 1050 bp, Homo sapiens
cacaccctgagacccacccacacacaaaaacacgggctcccacagagagaaatacatacacagacacacacactgacatccaacaggtaatgcttaaaactaaggttttcatggagcgtgaatagtgttctccacagttattttgaggagaaggagcaagtgttctctcaaaggtacttttaactgagccagaaaatgaagcaaaaacagacgggctgccattgggtctgcagaacagtgaatgctacaaagccagtttgatttggattcctgtttctggaactgcttgttcctgggcattgttttcagtttgatgcactcagcatgcttaggtggaaagtcattctcttattttctctcaggagcttgcatcctagattgctggttaagcagagttttatgctcagtctcctttggcactaattaacacactcccttggtgctccctgagtcatataagtctgcccaggattggaagatccagaaacactgtgcccatgtggaggaactcatactgagtcctctgtgggtgcgtgggaccgaggaatgtagggggaagattatgtattagatatagaaagagatgtaattttcatttttttttaacctgtgggtcattcatggtataggtttgcgtagagagcttgatggaacttaagaatgacttaggaattatttagttgtaaattaaatgatttttaagctacattaatgtgggcaggggatggcgctttggattattttggttgagagagaacactgaaactacatagccagatttcttgtgactcgggcagcatcttctgagaattatcttgttaggaaaaagagttgacacatgcagcatgtttgtgtgtgtaaatacttgaaagtttctatcacaccaagggagccagacaccagagacatcagaatagttttataaacgttaagttccaaaaagaactattttctcttgttgcctggcacacgtatatgtattcctttgactaaacctgtttaatttcaaacaggctaggcatggtggctcatgcctgtcatcccagcact

SEQ ID NO: 127397 - DNA, 1778 bp, Homo sapiens
ttaactgaaagtaaatcagattcacagttctcaatttttttttttttttgcctttaaaaggaaaaaaaaaaagaatcccccatccttcactttttctgttactgtgtattctgttggattgttgcttaaatacaaaatactaaccttatgcctaatttaggtactacgtgtataccaggactacatgatatccttcttagaagataatacttagtgacattaataattcattgggagacttctccatgttcttttagataattgccttttctgattaaagcttggaatgccaatagttggaataaagcagtcacttctttgatctgttacccattataaaatttatgttatttatcttgctttttttttttttttttttacaagaatctctgcttatagcagataaaaatactgactgacttccagagagttccctgagataccaggtaagatcttggatagaatggagtgtaggaaacaaacagttcctatcgtaagcaatttttgttgctagaacaaaatccttttgtaggtcatgaacttttgagtagcctgagttttgagttagcctcaattaaggtttttggttgttttaccacccaggctccagattagcaactggagacaggagctgtgatggaattaaagtaaccgtggcaaccattataatgtaaatgagccttcttgggcaggaagttgagagcgtgagcacttgttagggcattcctttattacatctacaactagagctgagtagcattttgctattttaaaatcctgctccttggacaccatcaagtcctgtgttattccaaccttcttttagttttctgagaaactaacaccaaactaatatgtatataaaataggaaatgaatctctggtgtgcctccttcattcacattaagacctcttcttcctttaataacattacctttttcccactgcttctggcaataacactcagcaccaagtctctgataaacaaagaaggccacttaggttttgagagatgtggtgtgtacctagtatactctgatggccaagatttggcttatggtggaacaagtggtgccagggccccttcttaagcagcacaggagcgacaaatctttggtctcaaatcttaattttttatattagtctttaaaattttaaattattttaaaatttttttcaataagtcttttgtactcctaacctttgaatttcaagtcataagattgtaagttttagagtattaatgtaggcttactctttgtggatttagagattagatgactggaggagaataataaaagtgaaactgaagtaattaccaaatgaggttgagttctaagttaagtactgtacttgtttactaccccacaatgagtccagtgattttaacaacaaggcttgtaagcgagaagcttaaggttcctattcaaggttaactattgttatgatgttggtgctaggaaaataacttccctcaacctcagtttttctctttgtaaaggaagagtgaaaacgacgactcactctgttgtggggaaatacttacaaaaggaaataaaatttaactagtagtatggtcaagaatgtcagctgaggttggccaggcgaggtagctcacatctgtaattccagtgctttgggaggttgaagcaggcagatcatctgaggtcaggagttcgagaccagcctggccaacatggtgaaaccctgtctttgctaaaaatacaaaactagctgggcatggtggcatgtgcctgtaatcccagctacttgggaga

SEQ ID NO: 127398 - DNA, 1048 bp, Homo sapiens
agataggtttagatcaccagaaaatttataagctaccatttaaatcttcacaatattgataaacatctactaagataaggccaaatagagagttctgtggcaactgttagttacttctttccagatttacattaaacaattgattaataatcttagaatcgttgttcaaccaattgtaaatctatcacttaactagcataagaaagttaatcttgatttcagcaatatgtattggacctactttatgttatttctctgatctcttagtctaatacttttgtcaaaagtaaaatgaggttagcatgattgtttttcttggtgaaccccattctgactcactgtgttctctgtaccccttccctaccccaccgtaggctaacataggaaatctttgttaaacccttaatctatgatttcaataatctagtctctttttttcctttgaaattgagaaaattaaaattgcactttattgtttctagtcttctagcttctcttccatttttcatgagagatcatggagatcttaggctgtaatttatctggttctagatatttgcatttactaaaagctactgggtgctcttttattatcttttctcctatttcaggcttcagtttcctcttaaccatttgcattctcttttcagtatggaaagttactctggataaagaaaatgcaagcaaaataagagttgaataggtttgattttctgtattattttttaacatggtagaagggcctgtctcatatttttgcatataacatcactgaaaaaagactatatgtttgcacttttcataagcttatattgatattctattatgtgccaggcactgcattagattcttgggctccaaatataaataagatatggtctctgttctcaaggaggtcacaatataattggagagatacgtatttatataaatatttactgtatagcaagagccgctggccaggatcagaaaacatactttgagggttagaaaaataagacagggatttatgctgaataaggtggcgaaatgtacattttcaataagc

SEQ ID NO: 127399 - DNA, 1058 bp, Homo sapiens
gagttctttttgtattccgtaatttttagagttcaccttaaattttacagtgtctatagattgataaatttgcttgatacttaattcatgcttatatccttatcactaaatgcataatatatgtcaaataaattatttgtaatggattttttatggacattaaaatatattctttattgatattgttccagtgtctgactttcatttataatttcatattaccatttttgctcctatctactactcactttctagctaaagtgtttatacttacagtgatggaaagtttttgacttgggccttccttattcctgcgtattatttaattttacagtgtttggtagaagcaaggtcaaaagtttactgaaaagaaaatgaagcccattaggagactattaggtatatcttaatatttcctttctcagttcctttagatccttcctcattgtattatctgggtcacactggttgagggattctaccttcctaatgtaacgtcagttgtgtttagaactgccttgacatacgtacctgcttgattggcgtcctcttctattagtcaccagagtacagagatactcagttccaatgataaaaatagtatacattccctttagttagaatcttcttagtgcaaataaccttggacctatgggtcctgtccatgataaaaggcagaacatttttcacttttttctttgagtttctcttcctgtgacttccccctccttgttatatgttttacatttgacaaagggggaaagaacactcaagattcctagtcatatgccagataaatatataatagacattattttaaatctatagctgagcttgtgaaaaagtaaggaaaatccttaggggcaaaaaaatgatgagggcattgaaaatcagtgttaagtacataagctaaagttacggctgctctggatgactaagagacttagttttaacaaccacatgggaataagagacttttttactcccttgcagaaagctaagttcctcaaagggtttccacattattgaaaagatgatctagaaaaaacatttgcccc

SEQ ID NO: 127400 - DNA, 1094 bp, Homo sapiens
ggtgtaggacttggctgtaatagaggaactggtgatatgtgtctgattagatttcagaattgttatgggccagtaactgttatgtgtctcctgttccttctccctttttcctcacattttgaatgagagtgtctattgtgcttatcttaagtcagtctcactattgtatgtttgtatgttgggtgtgtgggagcagataatttgtttctttaattcagatcaggaggaactatactgcagtagctgtacctgaggaactgcatctgaggagcctcaaccacatctggacctgatttagatatcgagattctggacatcaagctgatgccataatgaaatgagacttttgaaggtcttagaagagggtgagtgtattttgcatgtgggagggccttgttggggccagagggtggtctgtggtagcttgtatccaaagtggccgccaccaatttcttcccttcttgctattcagtggtggagtctatttcccttgtccccttgaatctgggctggctttagtgacttgcttaaccaatagactgtaactttctgggacttcagaggctaggtcatgaaaagccttgtgtcttctgcctgtgcccgttggaatcctctctcttggactgcttgcacatagaacccggtcaccatgctgtgagaatccccagccagatggagaggacacatgtaggcactggttgatagccccattgagctaccagcaaagagccagtatcaactgtcagccttaggagtgagtgaaggaaccatgttgaataatccagccctagcagacaccatctggagaagagccaaggtttcagacttatggcacatgttaagacatctcagccatcttcatcctttcagggcatcccacctgagtttcccagacatcgtcaatcagagacaagcggtctctgctgtgccctgccagaatttgtggcccacagaatcatgagaataataaaatgattattgtttaacactactaagatttagaatagtttttaaatttagccgtagataactggaacatggccaggcgcagtggctcacacctctaattccagaactttgggaggctgaggcgg

SEQ ID NO: 127401 - DNA, 1182 bp, Homo sapiens
gcctgtaatcccagccactcaggaggctgaggcaggagaatctcatgaacccgggaggcagaggttgcagtgagctgagattgtgccactgcactccagcctgggtgacacagcaagaccttgtctccaaaaaataaaaaaataaaaaaataactggaacattgccaaactgaatagaaaataatccaagtctatgcagtttgtaagaaatacacctaagacataaggaatgagagagactggaaataaagatatggaaaaatctattccaaaagaaagctggcatagcaggttaatagtagccaaaactgatttgaaggcaaaaatcattatttgcgttaaaaattatcagaaaaaaattgtaaaggaagaattaagcaagaagctataattccaaatcagtatgcatcttatagcatggccttaaaatagatagatagaatacaaaatatgtagatagaatataggaagaaaatatatagatacaaatatgaataaatttataaatctataaaatggaaaaatttaacatgtctttttgagtaattgatggtcaaacagacaaaaacaacttgagaagataacagaagatttgaacaaccaaccaacaggcttcattttttggatatgtaccaagccccacgcttaatagatgagaatatacattctttttagggagttttaaaaaaattgaacacacactgaattcataaatcaagtctcaacaaaaccaatgaatggatattatgcaaactattctcgtactcaattcagttaagactgaaattgagcaaaaagataaccaaaataattttatatatttggaaatttaaaagcatacttctaagtaactcatagatcaaagaaaaaataataatggaaattataagtaaagccgaatgataatataaatactgtgtatcagaattatgggttacaactaaagcagcatttagagggaaatttatatcatcacaaagaagatgagggtaagaaaaactaattaagaacattaaaaaagccaaagggaaatttacagccttacatgcttatattagaaaaaaaacagagttcattatttattagtcttagtatttgactgagaagttatttttaaaaagaaatgaataaaaaccaaggaaagtagaagggaagaataaaaaaaaaaaccagaactgaatg

SEQ ID NO: 127402 - DNA, 1020 bp, Homo sapiens
aaatttttttttcaaactagaaaaatgtcttaagaaattgaaaatgaaatcattagtttctagagctttatttttggcaaactagaataatccaagttttattttactaattttatagaattatagccctaggaaggtaagcaaatttctgttttctgctacaatatttttgtaatggtgaaatctagttaaaatattttggagtataaaaaattagaaaacatggtacagaagaggccagtgctgctcaggggttaataaggctgggacagccagctctagctgtaagcatatgtaggttttaatatactaaaggccgtgagctacagcttttgctttctctcccatctatggcctccctcgtgtatttatatatgtagcctccctgatgtgtggatgtatggatgtatttacagctagcatcagctatggttagggctgcattcttttctttctctcccatctgaggcctcctggagtcattcttgcaagagttcacacaagtttgttgaactgaattaaacttcaagtttttgttagaagaattgggcagggatcagagcatagagattcctgatggagaatccatcaggcaaggaaatgaacagctctttgtgtcctgagatgaccagcttctcctacccagaccaggaaggattgttttgccagtcttcccatggtgtcagggaaccaggattgaggagtctaaatttcagttttggcaagttggaaaagaaaaaaaggtacaaaaaaaggaacttaggttgaacttactgccaatctttccccagagggaaatgttcttcctgaccttgtagaatccatgtgattaaagttcttcatgtcctttttagagttctgagcagtaatcctctattttctttctctctctctctttttttttttttttttttttgagatagggtctggctctgtcacccaggttgcagtgcagtggcacgatctcaacctccaccttgctaactgcaaccttcacctcccaggctcaagcaatcctcc

SEQ ID NO: 127403 - DNA, 1076 bp, Homo sapiens
cctgttagtattaggaatttgatgtattaactcatttaattcttagaattctgtgaggtagatggtatatcaatttttctgatacagcaattgaagccagttatcaatttaccataagtcacacaccttaagtggcaagagtgtaatctgaatccatatcggtctctaaatatctctctttctactacaccatgttaatctatatccaccacaacactgtagctgttcatctgaacaggatatcttttattagcaaatattttaataagatggggcaggtattgagattagtagacgtgttaaggagattgcaatatgtgatgtatagaaaaatcctgggactataacttcataaattagaattttagatccactattaacgtgtaccctggataagtcatatgttgcctttgttgtagttttccagtctgtaaaaatgaagatgttaataatatctattctgccttcccagtggggtgtgttgaatgtgtgtttgctggctttgaaaatgataaaactttaccaatgtaaagtattaagtaatgtggttctcaggagttgtgtggcttgatggattggtaccattcttttaaccaagaaacaattagttgatcttggcagtaggccattggaactcaaagaaatagcatctgtcaatcacagtcatttcttggaaggaagaattgaaaaatggcacaggagttattctccttgacctctttctctgaaagggaatttgattaggcaagctggtttcataatagagtagagcttctctcttctctccggggaattgaagctgagcagccaggctggttctgtgaagccagagcaatctggttttaaaggatttaactaaattctctatgattaaggttttctgagggatgtgcattgctgagcagcagctttaaaaatgttacgtatgagtcagtctgtgtccctagactgagaacagagtagtggaactggtttaagttcagggaatagtcttcaacaagttcatagcatcttgaagagaagcctagactctgaaagctgaaaaaataggcagtaggagaccattgtatagactg

SEQ ID NO: 127404 - DNA, 1128 bp, Homo sapiens
catgcagttgatagagagtaaatgcctggtttattaaaatggaaaggttaggatgcttatacctatttttcacataatctggaaggtaaattaagtaaaaatttcaggacattctgatactaggtagtttaaaacaatactcaaatggtttctgaaaatagccttataaaggagaattaaactaaattggctcagttggagtccttacccttgcttggtgagttagagttttcggaagcttaaagtttatattctttttgagatttaatatatgtcaacctttctgaagtgggtagccaacttgtgaagactgtgtgtacacatgcacactgatctattgtagccttggcacattgtgtgactttaagtagggtgattggggatgtgaaaggtaaaaggattgtagagaggtggctgctccaaagaggaggaatttctgaaaacatcactgtttattccaattacaaattttttgtagtgctatgtcccctggttaatgatggtgtcagtggttgcctgtgagtcctttgcactctagtatgctttgctttgaagtaaacttcatcttaggaccgggctgagttgtgcatactgctgaaattaaaggtactgaaaaagcatagggtagacaggccccaagggagaagcgactgttgggagctttggaaaactagcgaacagctccagagcactggtgcttggggagcagaagtgtcacatgttgagataggaaatttagaatgcctttgcttgagacctaattggtctccttcctcctatagactgctagaaatttctacgtagctctggactacgggtcccgaagttggaaccaccattctattcctgtcatttgtagtatggaaaagtaacttttttcttgtttataaaatgagaaaaatttttgagaagaatttttttttaatgagtgaaagtatatggtgtttgatagggtaattgagagctgtaatcaaaatcattacctggctggatgcagtggctcatgcttgtaatcccagcactttgggaggccaaggcatgggaagatcctttgaacctgggagtttgagaccagcctggacaacatagggagagccagtctctaaaaaaaattaaaaattagcccga

SEQ ID NO: 127405 - DNA, 1051 bp, Homo sapiens
gaaagccagtgctattctgggcagctaacaaagaagaattgtgccacggcatagggagttggcaagagcccaccgggagtattacatttagcacagtgtcagcatgatagaaacagaaggtggtgagctctgagagcaactgtagtgctgagggggataaatacatgaatttatgaagatcagttaacaaattcaagcatgcagggttgactgaattccaactacaagatccaggagagacactcccaaatatttgaagggtgttaacattggaagaagagaagaattatttagcctggactacagaactttgtaagaaggtgaaaccaagggcagggcaaatttatacctctctaaaagaaatgccctgatgtagtttttgggtgattcgggtgccttcatccctcaggactttttgtagtatgaagctgtaaggccaaaatgaaggatttgagagttctttctctggagaaatggttgagaaatattttggtcttgtgaataaagagtttttgtcccagagacaggttatgaaggattgatttaatatttattagccatgcacagtatattaagcactgtatacaacacagtacatagttcttgaggttctgaaataaaatgactggccattatatgctttatgcattctcagtgtgtttcagtagtttagaaactttggcaaatttcctaagactttccctttggaatagaatgatggaggaattcggccaaatgtaaatgtaaaacaacaacaacaacaacagatgaaatcctattgaaacgaatgtttcctttcacaagatggcaaaacatatatccttgagtcgggagtttcctcagtgatggggatgaagaagccttgagctgataacacgataacatgtttgttcttcaggatattttaaatgccagatagaggtgctatattgtcttcattgcgggccaggtctctgttatttctcagttcaagataggtcaagggaaaattcgttgattcacttagagacagttctgtttcctgaggcaaaggtacttgaattttcaagtg

SEQ ID NO: 127406 - DNA, 1051 bp, Homo sapiens
agaggttaaataacttgtctaaaatcacatagggagtgggaaagctgggactcacttttatctgcctgacttcaaaattcatacctcaattactatatttaatgattttataaatataaaaatatggcataatacttacataaaaaaagttataagatgatatcattgttttgaagaaggatttattctaaaatgtcagcagtggaaatagttgagtattgggataatggttaatttttgtctcttcttttattattgttttccacagtgaacatgaatgactttcataactacagtttttaagagatactcatttcatagcagaagggtggagtgtattaaaaaaataaatattccttcttcccctctgtttctgggtgtatttctgagatatatttctgagtttgggtgtattcactcctgaagttgcatgtaattgcctcttggcactagtttataaaaactagaaagttgaaacagtgatgttattctgagatctgaagatgtaggcagatgaaatatgtttaaataatgacattttaaccattattcagtttcctagatctgggaccggggccactggtaacaggattcagaagccagaagcacagtaccacacagtgagcaattccccagactcgtctctttgagcttttcactagaaaatccttcttcacctctcctttctcccaattcctttttattaagagtcttttaacctggatgaacataatttgagccgatcataaacaaatagctctcttttttgcctgactttatgcatttctgttgccatgtaaaccaaataaagctagctgtgagcaaaccagctgctgcctgcagcctccttccctagaggaagggaaagggtggtgaaggtaattgggaaggactataagaagggtagaaattgagggaagagagtattctatttacatttctggtcctgattctcactctgtttatttggctatttagaatatgatgactatagttgacttagtcattcttcccagcagctgagagatatgggtgactaataattttttct

SEQ ID NO: 127407 - DNA, 1080 bp, Homo sapiens
agtggctggcagggtggtgatggaggtgggaggcagatgaagatggaatggaggactgagtatgtgtaagtcattgatagcagtaaaagtgactattgtccccaaagctttcttgtcgaatgcctgtgaatttcgagggtgggaataacacactcatggttatcatatgaaacctatttgtggcaagatagtagaaataaaacaaactgtgtaatctgtccacgatcttgagaatttaccaacacttgggaaaaaatagcaagtgcttaaagagaagaatatcagtgtaaaggagcatggactacaagtctgttaagtggtacaggcagtaattacaaccattaaaccactcagaagaatggtttatctccagggttataaaggtaaagctttatgtgggaaccagcatgtactttggcattaagagaagggaaggagaacagaaagtaaatagaaagagtttaataagaaggagacagagcaggcattttaaactgaggaaattatatgcaaaagtacaggggtggagttgggaagggacaccagtgttgaagtattcctgttacttgttggtatcatcattcaccctatcagctggtaggagagcaccagaaacccaagtcttcttagactcctcctccccattaactcaaaggtaatatccagaagaaacaaagaacatttgtggaaggagagtaagagtcatgactcagttttgatcctaagtgaccagaataatagattttaaaaatatatgggtagggaggtagtttgaaggagacaataatgaagagagagaccctttcctttaaaataggaataaagaagcaaaaggtaggtgaatataccaagaacttccaattaaaagatgagggaacttgtagtaatctcccttctgtgtgttagagaatgcggctatgtagctttgtaccttgagggacttaacaagggttaattataatcaactgttgaaacacactgttctaaacgcagtattattcacttgccacctattttgggagttcatgtataagcatataaaattaccattagactgtttcaaagtggtagaccttattt

SEQ ID NO: 127408 - DNA, 1462 bp, Homo sapiens
tcacatgcacctaaccgtgtatttttcctaggagcagtggttcactgttggcaaatttagtgttcatggcaactttatagaatgtaactacctcaaataataagaatcaatgtattttatatatttattttggaggaccttaaagtatctcacagacattagctcattcatcaacacaacttccagaaattagctgctagagaatgagttgttatttggaggataagggaaaattcactctgtaggtctcccttaaggtttgtattctaggacaatttttgcttcttaagtagacagtattttacccttggatgtaaaaagatctgcttgctaattatggttatgtttgattgatttgctttggaactaattggaatattccctatttgacttcaatggggaaaggttaaaaggtaaagaaagcattttggaaagcagtcagaactttttggcagaaaagtaccaggtagagagaaataatcatagtggttattatcacaaatgtaaaaaaggtaaggatataaattgctggatacatatttgaatgtgttatgttgaaaatggctactcacatatatattataggaacttttctctccttcaactcggcattcaaacctttgtctagatcctgctaattcttcctttatatgatttctcaaatttgttccttctttttcattaatatagtgataatctggaaatccagactttaaccattttcaaagttgacctcaaagttgctctcatttctttcagccacattttcccttgaatgtaagagttacacagtaataaaccatcttccttaagcatatttttatcacattctgcagacatattactgccctacttagaaactttcagtggctgctagttgtctatttttaaattactataaaccactgtctcttcatgttcctcaattctcctacagcctttccaccctatcccctgtaattgatgtcatctcataattcattgtgtgtgtaggggaacctctagatgttaattccttcatcttataaccaaatctataaagctgcctgtgtctattccttttttcccttccattacaaaggaaagaagtattagaacataggcatctttgatgaggggcattattttgtctaccacacatttctttttttcttctcaatataagagcaatgtatcctcattccagaaaaattagaaaacagaccagcaatttaggaactgtgtaggccctgttgatctcctaatggaaacagagatccttagttcatgttgattaagaagggagggtctctgatttacttaaggccttgaagatactccaaaagtttgtcaaaagtcacagagaagaaaagtgtcaccttccacataaaatccatggggaaaaggagtactgtaagactcttggcaaggtatttagtttctctaggtcttggcttctttatccttaaaataaggaattgaa

SEQ ID NO: 127409 - DNA, 1031 bp, Homo sapiens
ctgctctatctagttttggacaaaatagcttcctggtgcttagtgttttatatgtattagttatttaatctttataaaaccaatgtgtagaagatactgttatcctgatttacagacaaagaaacaaaggttcaaaaaggttgtgtagcctgaggatacacagctagtaagtgatgaaactggccttcaaacccaagtctattcaactttaaaagcctatagtctttacctgtaatgatgatgcttccatgttgagtccaaaaaatacctgtgaggtatgaattttagattactgaggaactgataagtaagatacctaacatcatttaggttgtgagatagggagaagggctcaacaatgccggtgtctgtgatagcactggcattttgagtttgaaggagtaaaggagatttaaggtccagcaattccagccagtctcatacttgaccacattgagctttgaactcaggtggttaggaactttagcctccataataagctgaaacttaggtgactaaggaatagttattggttttcttgtttttttttttttttttttttttttttatggtctcagagaatctagatggattggaaatagtgttagaactggaaggaaccagttctaaccttccacagttcactcttccttacctccctctcattttatgataaggagattgaagaagggtaattaggtgatttgccaaagtccaataaaacaaagccaggaaaagaagacagggtcacattcttgtattccttgccctgtgccttatctctaggttccagattcatcaccttttgattaaaactgttctgccattatagtaacatcttcactgcctgggggtttttttagctttgagccctgaaaagagtaactttttgtcccttcccctttggccctaagcacatactcactgacttcagatcatccggcaggccatatgccctcatggatgacgatagtatcgagtcaatacttgtgggaatacaactggcacagaggattttgagctgtttttgg

SEQ ID NO: 127410 - DNA, 1046 bp, Homo sapiens
tcttcctaggctccatccgaacctcccatgcaataagactctaacttgagatatgcgagagtttggtgccagacccctggtgtgagcagatggggagcttctgcatagctgtttaaacttgaaagccctaggagctcttgatttcaaggaaacgcctgtttactgatccaaatcaagcaactcttgagaaatgggagtgccttcctgacctcagtctttattgatcttggtatccgcacctccagtgacgtgtcctgaagggtgggagagaattcacaagtgcctcacacacagggaaagaaggaagtccaactattgctgcagaaagtccccactggggaggtgcgggtagagtgtttgggtagcattaaaacagtgagtgccctgtgagaagcacagtgcctgggtgcagcactttgcatcagctctgattttgaaatcagacacagaaggctttgaagccggccagtaaggggttgtcaggcagttgactaatgctcttgatttgaatcggaggctgctgtgaaaagggatgcagcttctgctagccactgtgaacttctgaatctcactagggttgggtctgctttggggcactcagataaccccagtatttccaaaccagctttcccttttgcttcaggacatatcttacccaagcctgcactatggagaagtgggacggtaatgagggcacctcagcttttcacatgcctgagtggatggtgagttcactggtcgttttgtttctccttctgtttcttgataatgagaggcaaccatttctgacgggtgacaaggatcacctctgagaagctcctaccaagatccgtggttggaaaaacagttattactctacgttctgattagttcctaggtactaggtcaccactgtttcttaattatccacgaagctgggaaaggtgtgagagttgcctggccagggcttgttgcctggtcatctctggtgggcaggggctttcctccggctgctggtgtgatgtatgggttgtgtttcctgtgactgttttgcacttctgttttca

SEQ ID NO: 127411 - DNA, 1077 bp, Homo sapiens
ttctttttagtgtttatagaattatggatttgaagaaataactattgataatgagatagaatatatagtaggcctaacaaaggccccctgaggaacttacatttcaactcattgttacaactattttttattgttttgggggaggttattgctgttcttcttaatgtcgtttcagaacattgtgttcaggttttttttttttttttttttgaaatggagtctggctctgttgtccaggctggagtgcagtggcgtgatctcagctcactgcaacctccgcttcctgggttcaagtgattctcctgtctcagcctcccaagtagctgggattacaggtgtgcaccaccataccgggtaatttttgtatttttggtggagatggggtttcaccatgttggccaggctggtcttgaactcctgaccgtaggtgatccacccaactcggcctcccacagtgctgggattacaggtgtgagccaccacgctcagtcttgtgttcaattttaaaacattttgtggaaagaaaacctatccatctacaagcttattccaagtaacatagtgttttagaattaatggaaggatttatgtaatacttctgattgggttgagtttttttgaatttcttgctactcactaataacaagaagagggaaaaagaaatttggttttcttaagggaagggccacgttaaggtatcaaactttggtatttctataaaggaatattacagaagaattctactgaacattagtgtgccaactcagaatcaatcaaagttttataataattcttatttctgtcatagtcctcaccgtcttacaagcttagcacatcccctcaaagttcagtagtggctcctgctgaactttcacccatttaccttctttctagttaatgtgaatgggaagactgccctaaaggagttggtgtgaccactgcataagggatatgatctagggcttcccagcttttagaaaacactctttatttaataaaacacagctctttagtgttgtgtcttggttggtaaaaaataaataaaaaaatttgcagccgggtgcggtggctcacgcc

SEQ ID NO: 127412 - DNA, 1017 bp, Homo sapiens
taatccacgaaactattttataagaagcaaacttctaaaaaactcttcccctaaggaaaaaaacctcataaaaacaaatgaacagaagagacttcttttttaatcagaccgttctcagtgatatatttctgaataagctgtctttgcaatgagttacttggttaaggatgaggaaagaagacagaagtcccttcttcacgattggttctttttgttcccaaactctacaattcttataaagtttgagatattttcagatttttccaaacaacaaaattttgtgtttgtatttgggatgctagcatagctttttacacatttccagagtgttactcatcagtgaagtctgctataacccgacacacaggtccctactgttatttccattaccaaatgaataggttaggcccaagaggaattgcctgacataaaatagtctaataggactaattcagtcagggttctgactgctgcttctcctagcagtaactcacagtatcacagctgctgagaggtaaagcttaatcaggcttgaatcataaaatgtgtatacatgttctgtgagatagattgtggattcttgattcatcatgctgtcttttgattttggaaaataatgaaacaagataacatcccatagtaaagttatattgtacttcatactacttttctacgtagaaactgaacccttttggttatcatctcatttattcgtaagatttttccggtggtagttgggggaaagagagagcatgaggaaagagggaatctgttacagtttacagttggataaattgaaaattggtcacttaaccacttagggttgaagctagatctaggatctcaggactactttagtaggttattggttgttcttgtttatttaaattatgactctgggctttagagtatgctgacaattacaaatattttagaaactctgttcaagtgtgtttgtacatacgtgttgggtttctctaaattttcctaggaacagtccttaatactatctcaact

SEQ ID NO: 127413 - DNA, 1004 bp, Homo sapiens
aatcctatgaagactaaaaagaccccagctaagcatgtgaatagtagtagcagcagctgcctgttaaccacgataaaaagttttaggcctttcacactctagtatatgttgctaaatggattagttatcagagcattttattgtaccaaaggaggatttattcacttctttgggagtctaaaatgcctaacgccagacctactgaggccagcaagaagggagagcacattgaatacttcattgtcaatgtctaattgggtctgcaggcacaattcagcctcatcagagtccgtcttaaaaaagaaagctctgttaggtcagacaaatactttttgtgtggttcttaattactttcccatggattccttgttttctaggtcttatctgttcagtaattgtactaaaacacaaattatatcaaacatttaagcagcacacagagcagagtagttagaatcccaaaaacccatatgttaatgaccacgatcttgcattaggaactttaacctaatgctaccatggtgtaaccttttctttttgcgtattcaaggacctctgcgtgttctgaagataaagttagccctacatttcaagttaaggctatccaggaagaatgtctttggcaatctctttcagcttccctcttctggcatgtgtatagcctgcaggtacttaacagaggtaaaaaaatttatatggtgctaggtggctagagaagcttcagtttgctccatggtttggaattttagaggaagcatttttttttttccgagtgttttttattctgtcattccagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaaggtaaagaaaacaagcaccttttccttcttaacctacctgtgtctttttgtccatattaatccct

SEQ ID NO: 127414 - DNA, 1025 bp, Homo sapiens
aggtgaagtttaaccttttgtttattaggtgttttaaatggattttgttgaaatattctggaattttttatttgtatggacatatgagtacaccctttaccactttagatgagaaaaagaatttcagaggccttctggttgaagtagactttctttttccctttgcgttgccgccattttcccttaagttgattttctgacttgctccagtaccaccgtttgtgatgttctttttagcttgtgttttaattatgaatcgtgagtgtgggtgttcttgtgcacatgaatgcgataagcaggagccaggggtttgtttatgagctgcattcaattatttgttcttctcgttttccccaagtatgaatctattcagtgaaattcctctcgggggtggaaagagggggtgcactttaccagaagctttgagaaatggttttctcagtgactttccttaatatgtgtgctctctcccctcttcaggtggggaaagggtgctgtgctgccctgaaagccatgggctccattgtgtatgtaactgaaattgaccccatctgtgccctgcaagcctggtaagcctctacgctaccatctcacttgcaatctcggagctgtctccaaagaatggcctggttgatgccacactttattttagaggagcccagatcctcagagatgctgccactaactctaagcatctgtcttttaaaaaggtcaaggagctctgcttggagagagcagagactatcagaaaagcgaaaatttagaaatcctgtggagatagtaacagggattctgtcagccagagaacaggtagccccttaccttctccatgtatgatacttgcctttcaaataatgatcagaaaagaaattggcaggcatcagatgccttctgatgtgttacactgaaaatagcccttctgtggtattcctcccaaaaatgtataacctgaatctaattgtgaggaaacattagaccaatcccagttaagggtaaaatctactaactctgagtgaagcatatat

SEQ ID NO: 127415 - DNA, 1044 bp, Homo sapiens
aaatattttaatgtagttggcagatgaaatacatttgggggagtggtactatctaaggtaggagtcatgggagtcatatgtcaatataatcacatatcactgtaagtatttgggtcttactcttatcctgtcttatccttaagaacaggcagtctcactgaagtattttaaggaaaggaagcgacatgatccaaattgcatttaggaaaatcactctgccaaatgatttagaaagatgtaaacctagaggcaatgagattgggccaggggttactatagtaatctaggcaagaagtaataagacctaaacttaagcaaggccagtatgtattagagaagagtagagagatgaaagagacgtttatggaattaaagaaaaagagtcacccagatttggtgacaacttcaattcaggagaggcagcaaggacattcttgtttatatggctcattcagttggatgaacagtgatgctattgatcaagatagaaaatatagaagaagaaatagatgagattatgggtgcagagaaaataataagtttattttcaaacacagtaagtttgagatccttctgggacattgatgaggtgctatccagtggctaatttgatccttggctatgaagcttcagagagatctaagctaaagttacaaatgtaaaaatcagccatctatcagcagtcatttgcagccaaaggaagagtatggttctctatactgaaagaatagagaaaagaataaaggcataaccctgcagagcaccaatatccaaaggttggctgaagttgaggagaggcaattaagagaagtaagaggaaaaccaggagagatgtatcatggagtccaaggggtatagagttttaagaaggcaaataatgtttaatgtagtagaagaaatcaaataatataagagtctaagaagttgggcatggtggtgtatgccaatagtcctggctactcaggaggctgaggcaggaggattgcttgaggccaagagttagaggctgtagtgcactatgattatgcctgtgactagctactg

SEQ ID NO: 127416 - DNA, 1876 bp, Homo sapiens
tgaaaccccatctctactaaaaaatataaaaattagctgggcatgatggcaggtgcctataatcccagctattcgggaggctgaggcaggagaatcgcttgaacccaggaggcagaggttgcagtgagctaagatcatgccattgcactgcagcctgggtgacagagtgagactccatctcaaaaaaaaaaaaaagaatagtgaatggttttcacgttaacacatatatgtctgtcttttttttggagctccttgctgtagtacctttttaaaaaagagttgtataatattccattatatggaactgccctgatttacttaaccattcccttatttatttacatttttcactattacaaataagcctggattgaacattcttgggcacttatatttctgaacttgagcaagtgtttttattggatagagccctaaaaaagtgaaactgattggtcaaagattaggtacatataaaattttgctagctgctgccaaattgtcctccagaaaggttgaaccaatttatgaaacttgacatttcaagaaattgtatgtgtttcccatctacctaataaagaaacggtccacaccattaatatagttctgaatgcactgaaatataattgtatatgtctttcccactagattggtacttccttggggataggaatcatgaatttctaaactttagcatcccattgtttgcttaaataaaccttgaaatacaaaaatgaaaagaaagtactgtctttgtccataagtggctcacagcccagtaaaggaatccacagtcttatctatattcatgctctttactacaatgactagaatatggtatgtaccctgtaaatcattattgtataactaaaagcgtttctttttatttgtctaaaaactatttggcagaacttcttaattttatcaaatgagccaatgggtagttttggaatatgaactcactttctattttaggcattgcctgttggaagaaagaaggtgttgtcttaagtctacaccccgtggctgttatttgattgctgctgttaaaaaaacataaccttttttctcattttctctgaatatacaatatacagaaatggaaggagggtgagccattgggagctttactctaccattaagcatttctttaaaggctacctcacatttgcacttaggtcacaaagcttctgtaactagggtgaaccaccatcattgaaaaggtggaacctgggaccttcggatatgagggcagaaccttgggccccagcatgctatgtttaggacatttggcctcttactaaacccactcagctatgttcctcctttttttctttgtttcttcagcacttatatattcagtttgcactgtattaatttgcacttgtttgcatgttgctttgtaagtattttaagggcatttttttcctctcacatatatattgttttgtgtccctggctaaagtacaagctttttgaaggcagaaaccatgtctttggtttcttttgtatttcccatagcaccttttactgtgagagtgggcacacagtatatgttgtggaatgacatcctgagtgatccctccctggctgggcctcagattaaattccctgaaatggaacagtcctaaccaacacaggacaggtattctccatctggcatgttggttgctcctttcaacctgctatttgaaatggctcccttcaacatctttctgttcccacagtggggcttgctatggctaatgctgtacttgctgtatgtgttccaggcgagtctgcggacaccagaactgacctgggagcgagtgagatctcaagttgaccatgtgatatggcctgatggcaagaggatagtactgctggcagaggtaaggct

SEQ ID NO: 127417 - DNA, 1049 bp, Homo sapiens
ggttatttatttattaaaatcaagaatcctgtgcctgtagtgttggcccagagtgtggttactgccctgagggccatgaaagccacagaggatgggctgaggaaggaaagaaatggggttactgctcccagtgcatcatttgcatcattccccattgactgaatcctcagcagtggccgtttttcctcttgtccaggctcacgagttagtccagggattccatactccctattccctggagttttctggaataaattttcagcacctgcttttctcagcttggcccttccccgggtgaggccgtttggaattaacatggccagtgtttcacacaagattgggttcccaatcttgaccatcactatcactgccttctttatataaaggctaataaggaaggagtgttatttatggctttgccaagctacatcaagaactcagctgtgctgtgcctaccaggggtctcctttcttacccaggactcctttcttctccttgaatatttatgtccattttaacacttcctggttgcaagagggatgtgcctccattatttcctccacagttttggtatttgtcagacatttgttctgctgtctttctaatccagccaacgtctgctcaggaagtggggccagctccactgggacccatagttttacttccttgtcatttgattggatagtttccaaggaagcccctccagattggcactatctcagaaaaggagagcttgttgtgaaacactgcttcctgaaacttcctgctattgcctaaagctacgtctgaaactgagtagggaaaggcatacttttccagggacttagggggataggctttggaaatgggacaggtctttcagactcacagcttgataccctaacaaagcagagtatatttatttgtttcccaggaaggccattgcagtttgactggctgagggatacagagatgaaattgtaaactgtatccagattatcaaagctaatttgactagtttgaacctcgtcagacattcattcctttggccattgccatggatgaaaccg

SEQ ID NO: 127418 - DNA, 1394 bp, Homo sapiens
gaagataatacacaggtgtcttaaatgtactattctgttcttacctgtatataaaaattcataatctaaaatttaaaaataaaaagaccaagactaaagttcagtacctaagagccttgcccacttttctgatttggtttttggtgctttaatcttaaaaatatatatattcacctctccactaatgactgaagaatttaagattcagtgatgggatttgcttctggtcactcctagattctggaacttaagactcaaaagccctgactcccagacaaggtgtttctcaaccattagacagctggctggaacataagtgaatttctcttgctttgtgaattacctgtgacctggttaaatttccaggaagggtctcaggtagggagcagagatttaaaggaaatctgttctatcatctgttgacttctgtatttcagttcttcatcttctgtaagatgagggtacatatacaatgttctggagagagatagagagagtaggaaagggcatttttatttcttttcttctttctttcttttttttttttttaagagacagagtcttattctgttaccccaggctggagtgcagtgacatgatcatagctcactaaagcctcaaactcctaagctcaaacgatcctccacctcagcctcctaagtagctaggactacagtcatgtgccactacacctggctaatgtttaaattttttgtagagatagggtcatgctatgttgcccaggctagactcaaactcctggcctcaagcaattctcctgcctcagcctctcaaagtgctgggattacaatcctataggtctgagccatcacacgtggctggcatttttatttctcataagctttttgcattttgtattgagaggctgctgttagcaaagttagattttcctgggcacagcagccctttgacaaccatagctgttctctagagttttttttgcagcctctgctttgtggctgtgggcaggaatctaaacttctataccctttgaggaaacttagcagggagagaatgaactggttccaaccctgaagaaccatctagcacttacttttcagcccttgccatggtttcctgatccagcacaaggatctttcctctaagtttcaggagttgtgttgccctcctcttctcttagagatgggatagttcctggttgggttgacaaagcaggagttgcagccctgagaaacaggagtgatgagattaagctctctgtgctgcagtcctcctcttggccctcaccaaatgttgaaggctgccttctctgctgcagcagccagctggcaggaagaggacaggtttgatggtttaatctcccagggacacaagtggctatttttaacgttgctctgaaaaggaggaagcta

SEQ ID NO: 127419 - DNA, 2678 bp, Homo sapiens
gagataggaaagcagaggtcatttcaaagagagagagtgaggataccaccgggaaggcagcgccgaaaaaaccagaggggaaccacttgccgatcccccaggcacagtctggaggtcccaattcccgcggtaggggggcgagagatgccactcgtctgatcagcaaccattttgggcccgcttgcgccgcttctccggggcgtccgcgttgtgctcatccagttgcttttgaggttccggccccctccaaacctctgaagcgctccgtgcacgcgacgcggcggcggggtaagctggagccctcgccgcgagccctctccgctgcctgcccgcagcacagccgcgccgacctcctcatcatggcggcggccgggcggggaagccgggccgtgcgtcgcgtgcgtgccctctccctcccctccccctcctcggcggcggcggcggcggcagaagcggcagcgctcgccattgccgctggtggcaggaggctgcgaggagccggcgcggtcgcagtctccacggcgcaggcccacggtagcgcagccgctctgaggtgagtgccctaccgcgcaatctccagctatttcagccccggcgcagccgcaacacgccgcccgcccgccggccggccggcccgccccgcagccggcaccctgccgcccccggctctgggcctgggcccccgccggattcggcccgcctcgggcggggggccccggcccggcccagccaaaccgccaccccgaggatgcgcaggccgcactaggccccaggcgtcctggcgggctcgggagggaggcgctgccctcccgagagccccagggttccggcctcctccgccgcctggggctctcggggccgcggccttctccccgccgtggaacccggggcccggccttcccgcagctcgggagcgggaggcgcgggagagtgcgccgggcccgggagcgggaggtgggcgggctgcgcgggaccggagccgcggctctcggctcgccccctcggcccttcccggctctcgtacgcgggcgggcgggcgggcggcgcggtggggccgggctggggcgcgggagccgctgtctcctgcgggagaggaggctggctctttgggcgacctccgaagcttccctcctgccggggtggcgtgggcttgttacccaggtagactgggggacgctggaatatggcgcgttgcccaccttcttgcaagttaggaggtggccggggcggcagttcgaggaggagggcgcaaagtccttttgtacgcagaaataaggagcgacattgtgttttcttccccagctgagatgtgcccgcggaggggccgcggttcttcctgtgcctggggtggtggtcccctgggtgagggagagggggagtggcacgcccctccgaaggaacagaaccttttgccactggaaagacaggggctctgagatggccgtgtgcatggtattttcccatatccccagaccttttcgggtttgtcattgaatgttgtgcactccatcgtgcaatgatgtctgctgcctctctcacctgttgtgtcgtggctgctggtcccaaagtttctgcagtgtatttggctgtgcccaccagaacttgaagttgtttaaaaatcttaatacttggggggcttccagtgatatctgctccaaccagttggaggagctgttgcctgctctccattcttcttaagcattagattagaatatattaattgcttattttagagctggtgtcaatcgtgctgatttctttatgtggtcagagcaaaattcacatttttttaagtgttcagagactgcgtattgagagacgcataaggagaaaggtagtgtgagtgagcctgtcagcttgggcagtgttgggcagagcttttgtcccgggacatcatctgtgctcacagtgatcctttttcccattccatctcagcctagccttttaaaaaattatttttcctttgggcttgaccagtaagtaattgggaaaggggggtgctggagtcttggagatgctgtttgtgtgtgtgtgtgtgtttgattcattagtatcccgactccctaaaattgtatttgacagttcttgacaggttaccccgtaagacagtgaaaatatgactagttctctccgtgcatctgagtgtaatttccttattttatgagtccgaaagcagacataattatcacatgcaatgtagaatatttattcttaacttggatcctaaattgtgggcagaatttttttgtgtcaaggggtttttttttcttttgataggacttagtggctttcaacagggcccatgaccaaaaaaaacaataatcagattaagaaaactctttacggccgggtgcggtggctcacacctgtaatcccagcactttgggaggccgaggcggggtggatcacctgaggtcaggagttcgagaccagcctggccaacatggtgaaagcccatctctgttaaaaatacaaaaattagctgggcgtggtggcaggcgccagtaatcccagctgctgggaggggcgggggcgggggctgccgaggcaagagaatcgcttgaacctgggaggcagaagttgcagtgagccgagatggagatcgcgccattgcactccagcccgggggacaagagcgagacttcatctaaaaaaacaaaaacaaaaactctacttaa

SEQ ID NO: 127420 - DNA, 1913 bp, Homo sapiens
atgttgcctaagctggccttgaactcctgggctcaaggaatgcacccacctcagcctccccagtagctgagactataggcaagtgccaccgtgctggcagtggcttcataacatgtttcaaggaaatttagctcctgtgttaagagaaggagctatagaagtagaagataatgagggcccttgtccagatatagaaggtttaaaggagaaaggatttcaggtttccttctgaattcctgtgtatgtcgttaggaccccaaattgtaggttttttgttttattaaacgataattatgcacttgtctaattttgttagggaaccgaaggccaacttcccatgatttaaatacctgaatttgcattgcctgcacactgtaggttcaaccaaatctctgggttgtctttagaagcattttatgtaaataatcacgaatgagtgacttgttttaagggaaatttaagctcctgtggtctgggattaaatttttatgccttttcttgtatggaataaggcattcagtaaagttgaagaataataacaatgaacagtaattactgaaattaaaatttttccctgagtatttgaaaaggcatgctgattttttggtttctggaggaactatgaactgtcagtctttagaaacagtctacagtcctacctcaacaggaagttaatgtatacattcagcttctgtcagatgtctttagacaagcctgttgcttcatgctgaagcaggcttattcattcacacagtgccactgtgaaaaattgaagggtgaggggaaactccctgggctgttgaatttcacaaatgtctactttaacctcaagagtttagatgcgccctttctgggccagtaatcatctaggaaatgggatatctgaatttagatgtttgtgtgtgactgtgtgatgcttattaatatgtatatatagagtatttggaaaatcaatcttaaaatgcaaatctttgattttgtaaaaaacatttcaggaaatgttctatactaaaatacattttctttatgttctttcatgttttccttgatagctaaagctagtgttttcagcctgagcttacccaaatataattttccatgaatgcttagtaaaacagcaatgaaaaaggaatccacttgttattttagaaacattttatttagaccaagtccaatgttttttgagtctcaagatacatgttaatttttgtgccttgtgtatcatatttccttccttattaactagagggtggattacccactttcttgggttttcagttagtacttttatccatcagttttctactaaggtaaacagactggaagataaatagtaaaaggaggtgaaacaaatgaatttcaggtgtttccaggagattaaaaccatattgagctattggaaacttttaatcctcaagcaacaacaatgctttgtttgaagttattttagtgcaatatggacaaaacttgggaaaggaatttttgactgctcaagaaaaataagtggattgcttataccttagaatatatatatatacacacacacatatatatattttttattttttcaaaagtgcacttcagaattgggctaatgtattttcagcccaacttaatgcagtgtagttagcaaaacatccaaaaggcttcatcatgttgtggtctttaggcctaaaatgttttaaaatgtgaacatttatgtgataccaagtaaactttctatgacccaaagaagggctagaaataaaactttacagagatgttctagtatattagaaaacaatggctggttatggtggttcatgcctataatcccagcactttgggaggccaaggcaggaagattgcttgaggctaggaattctagaccagcctgggcaatgtagtgacatcctgtctttacagaatattta

SEQ ID NO: 127421 - DNA, 2257 bp, Homo sapiens
gtaggcctaccacatttgtaatctcttgaggcaaatctgtgttgtttctctaagagcagtcacttagaagataatctgacagtaaggaatggtctactgaatcccagatctggtagtctgccttgcccaatcacaacatagtttgtgtaaaactccaactgctactgaaccatcagataatttcttgaggaagccgtttctcttaaggagaagtgtgtgtgtgttggagggagtgttggtggggagaagaggggtaaagagaagatgatactagtaaaataatctagttttgtaggttgggatgatcactggaattttttaggggaaatattctcaaaaaaagttgtaagagctacttttgtatgggttatcagtttggtgatttagactatagtaattgcattgtttaatatgcattgtatttcgattaattcatgcatgctgatttctgtggtaacaaatgtgaaaagtttggctgatggcttaagtggacattttcttaagaactctttaagtggtgcctgttgggataaactatgccaagccattttctgaatcttcatgaagaatgagctttgtatgcatatatattaagacagttttttttaaaaagagcatgtattttactgttggtaattgtaaagtttttgctttttagaactttaagagtccgttttgttgctgctactgaatgctaatgtggttaggctggcagctaaacctacaaagaacaaggggaaatgaggaaatgtcccaatgaaacattgcttaaaactgtttgcgcagtggactagaaatggggagttggggactaggggacctgattcttgttttatgttcaaaggagagtgaagcattctctccattaagaaataacctccttaagtgtattctcactttggagttttgccactcattcattcacctgacgatgattaaagatataccacattctgggcatgtactaggtgctagagtaacaaatcttgggccttgtcgtgtagagcagaaaggtatgggctcaactagctatgttacaacttctagagaaccaaaatagagcaaacaaagagtggtgtgggattataggaggagggagaaattccttctagggagaggagaatgatacacagagaaaagtgaggttagggaagacttttcacataggggaagtttgagtaggacttggaagggggagtagctgcattactgatggagaagaggggctgagaggaagggcatcagtagtctgatttgagaactagcaagtggattttgctcgacttggagaatagtggaaagtgaaactgataaggttgtggccatattgggaagagtttgtaattccatgctcatgagtgtgaactttattctataggcatttagggaccataagaggtttgagtaggacatccactatggtttttaaaaagatgacatgtaaagatttgactagagacttgtgagagtattgaattgtgatgtaaaaggacatcgattctggggataatttttacttcacagttgtcagatttgagtgacaattgagtaaagagttaaagattatagtgtggttattgggtgatgatgatgcctttaagatagggaatgtataggaagaacagaatttgaggaggaaggtaatagagtatgactccagatgtgttaagatatctgggaatcaagaaaggtcaagtaagtacctgggtatttgggctggagctcaaggggacattgggataaattaggggatttgcattcatcagtataatgccatatagaaactgcagaaagccaggcatggtgcctcacacctgtaatcctaacactttaggaggccaaggcagaggatcacttaaggccaggagttcaaaaccagtctgggcaacgttgtgagaccctgtttctacaaaaatttaaaaaatttgtcaggtatagtggtagccacctgtggtctcagctactcgggaggctgaggctggagtatgacttgagcccaggagtttgaggctgtagcaagctatgatagggccactgcactccagcttgggtgtcagtgtaagaccctgtctataaaaaagaaagagaaaatagtacagattgagtatcctttatccaaaatgcttaggaccagaaatgttttggagttttttttgactttgtaatgttggtatgcatataatgagataccctggagatagggcccaagtctaaacttgaaattcatttgtgtttcatatacatcttacaacctgga

SEQ ID NO: 127422 - DNA, 1064 bp, Homo sapiens
catgtctctctgcaatgggagttgcagcttaaatgctttgggagatgacccccaatgacaaggctgcctaaaaatctccatattgtttgggttgtttttttttttttttgcctcttttacattgtcttaaattctgagaattggagatttcatttgagttgacagtgtcttaaaatacaaataacctcttgcagagttttgaggttttatgatattaatatgttaagtatgggggtttttaacctggggttttctggttctggggtttatatattttggctgtgtgaccctgaatcccttaaaattgtttgaaaagttatgtgtgagtgcatgtgtgatttttctggggagagggtccacaacatttatgagatttttcaagggggctgttgacacacagaaaagtcaagggcctttactaaatgttaatgattaaatcaagtgttggttgtgttcgttggctgaaatcagttatctcaacaagtgagacagatcaagggaaagaaatcttgagtaggtgtctcaggtgaagaactttggaaagatacgaggaacttcttagaaatgggagtaggagcaccagaaggaaggtaggaggaatgccaaagcaaagcttaaccgatttcagaattttgtcaagtctctggattgcttggtttttttatactctaggactgacacttagtatatgtttattcatgcactgtagatacagtaggctttatggggtaggggaatcaaatcacttttttttttttttttttgagatagagtctcgctttgtcacccagactggagtgcagtggtatgatcttggctgactgcaacctccgcctcccgggttcaagcgattcttctgcctcagcctcccaagcagctgggattacaggcgcctgccaccatgcccagctaattttttatttttagtagagatgggatttcaccatattggacaggctggtcttgaattcctgaccttgtgatccgcccgccttggcctcccaaagtgctgggattacaggcatgagccaccgcactgggcccaaattactattgttttaaag

SEQ ID NO: 127423 - DNA, 1054 bp, Homo sapiens
ttaatgctaagaaattgctggcattcacatttctaaagtcgtgaataaaattaagaaattcaagcacattatgtgttcactagatcttacttgatttccaaaatatttctttttgaaattttagataattggtaatttttacttccttctgctaatctttgcatctttgaaattagattaggaggcagttttgtcagctaggccctagtttctggggcagtgatatccatacttttgcttgccaccctcaaaataaattaatgccacttgggattaatttgtgatttttctggggagagggtctacaacttttatttattttaccagtagtcttggtaaatacaagaatgatatgaataaatatgttgggtaatcttaaacttgtgttatgtgatttgtaattagcttgtgtttgtggatgatctttacattcagtaaatctccaaagagggcccagatagaatggagtattttgtcttttcctttgggaactttttttggttctttctttcattaaacaattatgaaataaaatttttggtaacagatcttccatgtaaaaatagcccacaaatcaaagaactagccaagatttgctaagtaagaacacatcatggaataccatcatagaactagtctcttaccccaaaactagctgtaggtgctaagtctaaagaagaagtaattctgatatgttaccagaattatgtggtaatgcgactgagtgttaaaattgttgtcttctttaatttttggctctattattttaaaagtttttctccatagaatttttttttttttttttttgagatactatctcgctctgtcgcccgggctggagtgcagtggcatgatcttggctcactgtaacttccgcctctcgggttcaagcgattatcctgcctcagcctcctgagtagctgggattacaggcacccgccaccatgccgggctaatttttgtgtttttagtagagacagggtttcaccatgttggtcaggctggtctagaactcacgaccttgtaatctgcccgcctcggcctcccaaagtgc

SEQ ID NO: 127424 - DNA, 1036 bp, Homo sapiens
aaggcaaatagcatcttatttattatgaaaataattttgacctcattgatgacttgaagaatctcaaggacccccagggtcccatggtttactttgagaactgctgttaagctatttgagggtcgaactaatcatcctaatatcccctttcagttcctggtccagaactttacacagaaaaggtgctcaaaggatatttgtttaatgaatgtggtatgctgacatttaaacaggacaaaacttggtgagtaaaattaatgtaggcagtctcccatccattcaggcagcttttccatagacgtttgtgagaatagagtgaacaaatggaatgtggatgatatacacttggtaaatgcaaatgatgaaataaaagaacaaaatataaggtgatagtacttacagagctaacagtctgagccttgcctgggtcctattaatgagtcttctactttctgtgtctttaaatttgtaatggtctcttagagagagggtcctcaactaggatggatctgatctgaaaagcaaacattcaatttaaatttcaatagttctctgcttgtgcttgatctagtaatgtcttttcaaaagggattatagaaggtgaatgttaaaacaaatcattttgattttccatagtgagttaagaaatacattttgttgttcctcttctgctttctaagtaatatgttgggcttctttcttgttttgtcgttgtgaggcatagtccgaggaaacctttgttttctataaatcctgatattctttggattggaagaggcagtttcctgaataagaaagagtctgactacactgggtaaattgtcagattattttgtcctcacagaagttaaagtgtaaaattgggtgagggcattgctttgaaagagtatttttatttattcttttaaagaaagtagattaataaaaagattgatcagttcaaatacctggaatatttaaaccagttttatgttaacctaaaaaaattattttgtaggcatttcgaagtttgacctcctttttgtcctaaattgat

SEQ ID NO: 127425 - DNA, 1619 bp, Homo sapiens
aggtcaaggctgcagtgagccatgattgcaccactgcactccagcctaggtgattgagtgagaccctgtctcttaaaagacaaaacccaaatttaccgtacccccagtaaaacccaaattttggcttgaagattaattaattaatagcttaattattaagctattaatacataatagcttgcattagcagttaaggagcccaagcaaataatgagtggagactgtgctcgggtacaaagggtgggactctgatggagcagctggaacacttgattgagaagcaggagataggggttcaagttttggatttgccaccaattagagatgtgactttgggtaactcactgggtctttcttggtcacaatttggaaaatgagaacatcaaactagtctccaaagtcttaagcattttaggtttgcctctggttaaaggaatgctctgtggacagttggatttgaccagttatcaaggtaagattatatctttgggaaccaaagtaaacagttccagatttttcagccagtcttcatcagggtgttatttgtacatcctaacaaatcacagagccgtggagaccttatgatgaataaccataagcctcctggctcttcccttttcttgccatcccagtcctactatccagagacagcctttaaaaactttttcactatttctgtttttagcttcacttgtggttacttccataagccttaataatgtgtttagacttctgttccttgatttatcaactttagatgatacctgtgaagtttttgatgtgaaaaatgagaatttaactcacttttttacccctgtcattatttgatatttatattactttgaaagtcatttattaattatctttataattttaaatgataaactttaattttttgatccatcaacttcctgtagggcctcttaacttgccattttggaaaatgggattgtaaatacccccttcacgtccctctttttatattctaccttctgatacctgtactcaacttgcatattgtctaggttataaaaggttaatatttttattctgtcttccattcaccaccaagtattgtgtgctttcctttatatttagattgctgtttttattgcattcgctttctctgcctgctgtgaacatatgcagaatcataagtgtacgattactcaaaatgtttatgtcttttaaaagctaaggaaataatttggtatgtgcttaaagactcagcttattttatttttatttatttatttttttgaaatggaatctcgctttgtcacccaggctggagtgcagtggtgtgatctcggctctctgcaacttccacatcccgggttcaagcgattctactgcctcagcctcccgagtagttgggactacaggtgcgtgccaccacgcccagctaattttttgtatttttagtagagatggagtttcaccatgttagccaggatggtctcgatctcctgaccttgtgatccacccgcctcagcctcccaaagtgctgagattacaggtgtgagccaccgcacccagcctagcttattttattttttgagacagagcctcattctgttgcctaggctggagtgcagtggcacaacctcggctcactg

SEQ ID NO: 127426 - DNA, 1080 bp, Homo sapiens
aagaagcagttttataagcagaaagaccaatttgaatttttgggaaaaaagttatttgactctcactcgtctttgacatacaaagaaaatgttaagtatttcacttatttactaagtgttcttatgttcacaaggccaaatgctagtcactgagctatcttaagtatgtttttattgttatatttgaatgtctttttattattaagggtatctgttgttttgtgatctgaggtataaaattagtacagcgaatttccatcaaaatggtttcacgtaagaacaccactctgtcatttttatgtcacatttgcatggtgcttcccatttcctgtgacttggtgtggcacggtaagtagtgaaattggaattttgtcaaggttcctctgctcttgaataaaatatctcttagtttaaacattgtgttatattacacactgaatcctgttctttttcttttttgtctgacagtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttctcccgaggacacctcttacgatgactcagatatactcaactccacagcagctgatgaggtgacagctcatctggcagctgcaggtagtgttgtttggattagaagctcttctttaatttttttttttttttttttggagacagcgtctcactctgttgctcaggctggggtgcagcagcacaatcatgattcactgcagccttgatcttccgggttcaagtgattctcccatctcagcctctggagtagctgggactgctgatgtgtaccaccacatctggctaatttttgtatattttgtagagacagaaatgtcactgtgttacccaggttggcctcaaagtcctgggctcaagcgatccttctgcctcggcctcctaaattattggcattacgggtgtgagttactatgcctggcctttatcacaacttttttaagccttgcagttataacttgagcctg

SEQ ID NO: 127427 - DNA, 1038 bp, Homo sapiens
cccagacctaatgagacttattcactatcacaagaacagcaccggaaagacctgcccgcatgattcagttacctcccactaggttcctcccacaacatgtgggagttatgagagtacaattcaagatgagatttgggtggggacacagccaaaccatatcagctgtgtttaaggtgccttttttatgttctcttttctttgttttttctttatttattaaggtgcttctaaatctgttcattgacttattaattttggtaattgttaatagtttaaccaaaactactaaccaagtgttttttttcctccagttttagaatttctagtgtgtgtgtgtgtgtgtgtgtgtgtgtgtgtgtgtgtgtttcctccgagatttgcactgaacggtttccaatagtggaaaaaaatttcttttaaacaaataattttataatttacctggtaattctctctcaagtttctgttacatgttgttaatgtcatttcttgttcacgttggctcttttcttggtgtactattatatttcaatgaatactggatgctgtgtttggaaaattatttctagaaataatttggggtctagtataatgttatcttcctctagagaggatttttgtttgcttctgcgagatgcccgagggcactagcaatcctggatcatcttaatccaatttaaggtttatttatttatttatttatttattttagtatttattgatcattcttgggtgtttctcagagagggggatgtggcagggtcataggataatagtggagagaaggtcagcagataaacacgagaacaaaggtctctggttttcctaggcagaggtccctgcggccttcggccctgtttgtgtccctgggtacttgagattagggagtggtgatgactcttaacgagcatgctgtcttcaagcatctgtttaacaaagcacatcttgcaccgcccttaatccatttaaccctgagtggacacagcacatgtttcagagagcatggggttgggggtaagttaaagattaacagcatcc

SEQ ID NO: 127428 - DNA, 1094 bp, Homo sapiens
aacggcctcatgtatttgagtctaatccatctatccggaagaggcaacaaacacgtttgcttcggtgagggctcccttatccatattgttactattcctcaaatacttcctgtggatgacagacttagaacatatgtgattaggtttgtcaaggatgcttggttcgattccttgatgacagatgtagacttaaaagtattcttacaaaattaaatgcatgaaaacaaagaaatacgatttaacagatacgtaatatcacattaattcattcagaaaagttgtatgcctgctatgtgcaagccattgttgtagacattgggcatggaagagtgaacaaaacaaattgccttaaagagcttgtatcctgctagagggggaaagaaaaaaacaatatgcaatatgtcagctgatgataagtgcaatgggaaaaaaatacagtggagtaaggaaaatagaaaagtcaggaggtagggggatatagtcagttttctctattacggggatggtctgggaaatcctttttgttaaggcagcctttgaacagagacttgaaggtgctgaaagagcacacatgttgatgctggggggaagaacatctcaggcagggtgagtatcaagagcaaaggccccgaggtgtgaatgtggtagttgtgtttgaggaacagccagggagatatgagaggatgttcagagcagtagagaagagccacgccaggagatcttttttttttttttttttttgatagatgtggtcttgctatgttgtccaggctggtctgggactcctggcctcaagcgatcctcgtgcctcagcccccaaaatgctgggattacaggtgtgggtcacttcacccagcctaggagatcttatagtccaatatcaggggcttgactcttactctgagtgagatgagatgtcattgtaggcttttgaccagagcagtagtatcatctgacttatatttttaaagaatcactcaggctactgtgttgagaatagactgtggggatacaagaatggaatcagggagaccaattaggtggtgattatagtaatctaggccagaaatgatagtgtcttaaaaccaacatgg

SEQ ID NO: 127429 - DNA, 1058 bp, Homo sapiens
tgattgcatgatggactttatcttattcaaagtctagctcaaatatcacctctgagacaagcctttcttgattatcccacctaaatgaagctttcttctccctaccaagccactaatacatcctctgtgttcttgtctgtataacacttgttactacctggaattgtctcatttattaacttgtatacttatttgtggtctccccagctagaatttcaggaatttagtttctgtcctttacttctgttcagtatagctgctcagcttctgaaataacatgttatctaaataatagtatctgttcagtaaatgacttcagagttagagcaaaaatgagttaagcgcagtggtggggaacaggatcgcaagtcccctgggcagttgtttactcagtgtggacgctgacgctgctgctcaggggtggcacttttattttttattccatctgaaccagcaacttggtctgaagtaatactatattttataaatataaacctaaatagtgatcttttgattgttggattcatagccctttctgtggacactggaaggatctctaaatagtggttcagaaaggaaagcatatctaaaccaagcttgtccaacccacgtcccgcaagacgcatgtgacccagaatggctttgaatgtggcccaacacaaattcgtaaactttcttaaaacattatgagattttttggcgttttttttttcttcagctcattggctgttattaatgttagtgtattttatgtgtggcccaagataattcttcctctaatgtggcctagggaagccaaaagattggacaccccgatctaaacttttctttactgtctttttacagtttctattattctgtttctagaggcattctgactggttcaagtaaagaaaacataaagtgaattatttttatctagttgatgtgaagaatctactctgtctcagatgtaaagtacatctactgcctaagcctttggtttctaatactgtgttaggtaaactcctctcctgtgatgggtattttttgttctttgtcacatttggtgtgttagg

SEQ ID NO: 127430 - DNA, 1092 bp, Homo sapiens
acaaccaaattagccgggcttagtggtacatgcctgtaatcccagctactcaggaggctgaggcaggagaatcgcttgaacccaggaggcggaggttgcagtgagccgagatcatgccatcgcactccagcctggggcaacaagagcgaaactccgtctcaaagaaaataaaaataaataaataaagtgcaaagtttgataatgtttctgctttgttttacgcaaagattactttatgttaacatgaagatgtcaacaactctctttttccccccttattttcctcttaaatagatactgtgtgttggaaggcacattactaagttctttacaggggcatctcatttaatccacctttctgtgtgtgtgtatgtgtgttgtaaaaaattcttattttatagtcaaggaagcagagctcagatatagcttatagccataaagaacaagtacattttactggacattaattctagatttcagaacatgtgggtaatttatggcttccttgaagtgataaaattctagaactatcaaattggactgtaatagagatagacttgggttaaccagacaactctattaatcatcttatctgcacttaatggtatagagataacttgatattgatgaccctaacttagaaatctatataggatcctaagatacattctgaatcatctaaagagagtaaattatattcaatattgttctaatattatgtgttgcactattttgtatctttataaatgagaaggttagcatgatttattggaaagaatactaactcagagtgagaagatctattctctagtctcaattctactacatataaccatggttctcactttcatcttctgatgaaatatatgccctcctaccttaaggagttagaggaagaaaaataaaatttggtgtaggaaaatgttttgaaaactaaagcatcacaccaaggtattattactaattattaatgttaattatatgtattgcctatattcatttttgaataacctgaacataccatctctcagccatgctttattagagaaagttcatgaaccaagaattttaatttttctcaacaattaagtg

SEQ ID NO: 127431 - DNA, 1026 bp, Homo sapiens
ggccaaggcgggcagatcacgaggtcaggagtttgagaccagcctgaccaacatagtgaaaccccgtctccactaaaaaaaaaaaaaaatttagccgggcatggtggcaggtgtctgtaatcccagctactcgggaggctggggcaggagaatcgcttgaacctaggaggtggaggttgcagtgagctgagatggcaccattgcactccagcctgagagacagtgtgagactccatctcaaaaaaaaaaaagtcctagaaataattatgatggttatacaacattgtgaacatatttagtgccactaaatggtacatgttaaaatgataatgttatgttatgtgtattttgccattattttacaaaatttttttgaaaagggctggataaaaagtattttagtttggtggttctcaaaattggctgcatagtagagtcacctagggaacttaaaatcctagtgccccggccacactccagaccaattaagtcatagtcttcagggatggatctaggcatctgcaatgtttaaactctccaagtgattccagcatgcaggcaactttgagaaccactatgatggatcacaattccaaactgcttctccatactgtagtgtcagaatttactggcaaagcaggctcttcttactgtctgaaattatcaaaaaatgtttacatatatgatgtctttccatgtttagtaggcataatgaaattaagagaatatatatgggccagatgtggtggcccatgcctgtaatcccagcactttgggaggtcgaggtaggcggatggtttgaggccaggagttttgagacaacctgggcaacacagcaagacctcatctctactaaaaatttaaaaattagccaggcatggtggtgcatccatagtcccacctactcaggaggctgaggtggtaggatcacttgagcccaggagttcaaggctgcagtgagccatgatcatgccactgtacttcagcctgagcaaaagagcgagaccctgtctcaaaaaagaaagg

SEQ ID NO: 127432 - DNA, 1939 bp, Homo sapiens
actccagcctgggtgatgagtgaggctgtctcaaaaaaaaaaaagaaaaagaaaaaaaaaagagagaaaacttggtaataaaatgtggaagaggatgaatgggtattgtctggtactcttagtgacagtgggattggcaaagtctttctggaggacaatttggcagtgtgttaaaatgttaaatccatataccctttaatcagcaattccacttttctgaatttctgctaaactgatttcataaactgtaagcaatctaaatgtttatcagtaggggaatggctaaataaaatggaaattctataccatggatactaggcaactgtttttaaaaattagattattctagttgcactaccatgagaagatctctatgacaaaatgttgagtggaaaaaacaagttataaaatagtgtacaatatggtaccatttgtgtttttctttaatcacataaaactgcctttctagcatgtatttatgtaaatgtatagaatttggcctagaaggaaggctgttcatcaagcccatgcctctggataggagactggattgagggaggatacatggcaaagaggactttgactttatctatattatttacatttttgtacagaagagtacaacaagcataaggtaacagaaactaaccaaactgtctccttcaaagagaaggtaggactttaagagcattttgattaaaaagagagagaaagtttgataggttgggggtgccgagatacagaagcagaagtcttgccttgagagaggagtctaaatgagtgtctccattgactggccttcaaattcactaattctgaagttacgttgatcttttctccaaacttgctcttgtggtttctatgggaatgtgtttttagggaaaatgagattaagagaagccagtgttttgcttggcactactagggagtggtgtttctgataataaccaccatagtcatctctctgaacagagatcagtactacaaataattcccaatatagggcaaatgaatcactttgctttagctctttaatgccctttaaatatccattcaaataaaattgggtctgtcagcctggacggtaataattttaagttaaagtaatgttgccacagtctgaaaaatctccatttttccttccctgctacattcctgttttctgtaggctatacaaacataacctttcaacatggtttgctttcaactgccttctctttaaatttattatgtattctctgacctcttcagtagaggtggagttggcagatatgttggtctgaaagaccttttcttggtaattgagcctaaatggacatcaggagcctcaaaatccctagactcagataaatgcagagcaaagatagagggaacaagaggagagggtatttggaggatgtgtaaggataatgcattgttggatagcaaagaactaactgaatttacaaaggaaatttctagcatagcaagaatttttttttaattggataagacgttttagagttttagagaaccttttattttaaacctatctgtggtttccacataatctttacttttcactgacacaggcatgaatttgatatccttatctttgctgattgtcccgggaagtggtagtattttctattctttgctgatttggtgtggctgtactgaccaagctagagtaccttaggcccacctagagccctaaatcagaatgagagtccaggaaagcttgttccagctcaattaaaggacggtctgagaggttaggctttagctttgctgatcctgttgattgtctccctgtgtattaaagacaaaccttccttaacaagcacttcaagaagctctggtttccagaactctccaggaccagtaattaattcaactggtaatgagagcacagttccgaattctggaaaggaatcatttgactcttcctgtactggac

SEQ ID NO: 127433 - DNA, 1112 bp, Homo sapiens
aagtaatgaccgcatgagccagctgatgggtttttaaatggatacgtttctatcagcctgctgcttgatgccagagccaaatatatatggagtgtattatatcatatcctgtaggcaggagactgttggggcattgggggacttagagaggtgaagtggcaggcttggcacaggaattaacagcatggctaccgtcaaccagaactttattaggtcaacattactgattgggttcatggttccctattatgtaacaatttgtatcatcttctcgtaaaataatatctaatatttattataagaatgataagaatacctgatatttatagaaatctttaatattaaagtgttgctgtactcattctctcattaatacttaattattctcatttctgttttttcttgttttactttgtaactacaaatccacacccccgagtctgattcattgctaaaagtggcctctttttggttttcagctgcaggggcagtatgggtgcatccttagttgcaggatgctacttatatctggagtgctatagaccaccaggttaaaaggaagacagtaggtctgggaaggaggaatagatcataaattgataaactgcttttcttgccagaaatcattatcagcgattaagaatattcacaaagtagaccctcccccaacacacacagagtgtggttactatgccaggaaataagaatggcagttgtctttgtggtttaaaacctgtttggtctggatttgatttgtaaaataaatctgaatgaagtccataatgcatttaaattcacacatgctttactatgtctatatgtcagactcatggacagtggcctagcttactggaaaatttctagaagagttttagggttattttccctttttattaagttaaaggcctgtttgttttcctatattttataatcagccaccttattgaattctcattattgtttgtagtagtttttcatttgatctctttggaattctctagatataaggtgacttcatctataaataataatgattttatcagctcgcctcttatttctctcttatctaattgcatggattcctacttccagaacagtgttgaaaacacccc

SEQ ID NO: 127434 - DNA, 1013 bp, Homo sapiens
actagaacaagatgacactccttaaagtctgaaagaggtggaaaagacaacgaggggtacagttaggagatgtgttagtttttggcttagacaaagttatcaaccatatgtctctactgaatgtttcttggtactatttaaagaaagtaacttcgtttccttctgtataaaataatttgtttttgacacataatatttataacattaatggagttgcgtttccttttttttttttttttttcctgagacggaatctcactctgtggcccaggctggagtgtagtggcacgatctcagctcactgcaacctccgcctcccaggttcaagcgattcttctgcctcagcctcccgagtagcaccaggcacgcaccaccatgcccagctaatttttgtattttcagtagaaacggggttttaccatgttggccaggatggtctcgatctcttgacctcatgatccgcctgccttggcctcccaaagtgctaggatgatatatagtatatataattctgttagaagagaaagccaaagtgcaaaaacattagagacgtgaattttaaactgaaccatcaatatatgtaacagttttgaattgcataactcattttaggtgcatttttatgaatgtcagtttaccttaaatatgggcaggctgaataacaaataggaaaatatcaatagtatttttccatccatcccttcagtaaacactttttgagccctgtgccaggcactgtagagactatagataaaagataataaagactcccctttcccttaaggagcacataggtaggcggtagagaaaagcaaagaacaattgcagtgagataagggtctactggcagcaagcccagggtgctgtggaacagcagaggagaggctctcatctggacttcaggggagtggaattgtctcaggaaacacttcccagaggtgtagcccctgagcttagactagagtgggaactagccaaacaaaggagagggatgggagttctatcctgtcaaa

SEQ ID NO: 127435 - DNA, 1081 bp, Homo sapiens
caagataaataagttttggattattggggaaaataatgaacttttttcttcaggtatgttaggaagggtgctgccaaatgggatgctccaagaggtggtttctgaaactcgattgtattattccctgcctggttctttctactggttgttgacaggaaagatcagcttcatatcattctccctcttcttcattcctgatgcaattttatttttaatgggctcagggatttaaattaatggtcaagagtgtgagccttgacgccagactacttgggtttgaagcccagctctgtcacttacaagctgtttggcatcgagcagttgatttgaactctcagtagccaggctctcctattctgtaaaatgggagtgataacagtacattcttctaggagtgttatgagaactgaattactccatgtgaaatccttaggtcagtgtcttgtatacagtaagggctgaactcttgcggcatgccagctctactgggtaaggctgtaaatagagaatagagtgctctagcatatactctgccctcaaagaaatcatactcttattgcggagactgatttaagtaaaacacttagcaaacagtattacttagagtgtaactcactattgaattgtatggtaaagactgtgaacgttgtagaaattcagaggagggtgatcacctcccctaaatataaaatcagtgaaagtttagattgattatgatagatactagagagctgtgatggatttgtatacagttcactgtatgaggctgtatagtatggtggctgagagcagggttccaacgtcacatagattcaggtttgaatcctggctccaccatttgatcctgagaaacataacctctgagccttgttttccccattgttataatgaggataagactcatcacacagaatcatgtatatgagataatatagataaaattctcatcgcggtgtccaacctatagttagcatttcaagaattatagttattatcatttaagttgtattttaagagttgtctattctgaattgattatagtgagaggagattagaagatcagttaggaagaggcactcca

SEQ ID NO: 127436 - DNA, 1097 bp, Homo sapiens
taaggtcttggaaactgaagtagtaagaatggaggtaaagtgattcttttttttttatttgaaacggattttcactcttgttgcctaggctgaagtacaatggcatgttctcggctcaccacaacctccgcctgccgggttcaagtgattctcctgcctcagcctcccaagtagccaggattacaggcatgctccaccacacacggctaagtttgtatttttagtacagacagggtttctccatgttggtcaggctggtctcaaactcctaacctcaggtgatccacccgcctcagcctcccaaagtgctgggattacaggcgtaagccaccacgcccagcctaagtgatttcattttaaaagaagtatggccagagattggtggttgattaggaataggaaactgaaacacacacacacacacacacacacacacacacacacacacacacacaacacatcttctcagagttacctagttagtccctagtgatcagaacatttttttcagcccattgagccatgttgctcttgttgctcttcatttctttttttcccccactcacgtatatactcatcatgttgcttttcagtaacatgaaagtcttacttggttccttacacttggctcaattctacccctctctttgagagaaacacccagataaacttcctgaaaggcatggccaagtgagaccctccgtccctttagtccagtaacaccccccattctccgcccgactgtagcttggggtctaacaggccctcattaaagaccagcaaaacttgatttcattgagacttgcagccaacaccttggatattccagtgaagtgtgtgtgtcctgggaactctgtacatagtggaaaatatgaggcacatttgggctctctttgttataaggaccagggcttgtttctaaaggcaagcgggtaatggtatcccctgagggcttgttaacaaacttagatgcagctgaggtggctcagtgtttactccaaaggaaggagaatgtgttcactgtggcatagaggaggaataaagagatgttgaaatctctttgcaatcaggtagttcgatgccccaatgagtgttag

SEQ ID NO: 127437 - DNA, 1068 bp, Homo sapiens
ctcaaggaattttagaatttgtctttttttttgttgtgaagattttgcttttaaaagtcatattttgaaagaaaaatttgctcttagtcttttttttttttttttattgagacagagtcttgctctgtcacccaggctggagtgcagtggcgcgatctcggctcactgcaagctccgcctcctgggttcacaccattctcctgcctcggtctcccaagtagctgggactacaggcgcccaccaccacgcccagctaattttttatatttttagtagagagggggtttcactgtgttagccaggatggtctcgatctcctgacctcgtgatccacccgcctcagcctcccaaagtgctgggattacaggcatgagccaccaggcctggctgctcttagtctttaagatgaaatattattgacttaaaattagacatattattaaaataaaatggggcttttatatacggagtgatatttgtccaataaaatgggatggaaaacttagatcagaaatcttctctggaagagaagtcagggatggtacaactgcttttctttcctacaggtaaagattagacgcttacagataaaaggttgatggaaacctcttatttatagctttggttttgaaatgacttttgtctaaaaattgtgaagtggtctagctcagggcctttttaatccctattcacctttttaagtgaacataatctttttctaggctgggcgtggtggctcacgcctgtaatcccagcactttgggaagccgaggtgggtgaatcacctgtggtcaggagtttgagaccagcctcaacatggagaaaccccgtctctactaaaaatacaaaagtagccgggcgtggtggtgcatgcctgtaatcccagctagtcgggaggctgaggcaggagaattgcttgaacctgggaggcggaggttgcagtgagccgagatcacaccagtgcactccagcctgggccacaagagcgaaactccgtctcagaaaaaaaaaaaaaaaatctttctagcagtttagtttggtcgtttcccataaagttgagtgtaaaag

SEQ ID NO: 127438 - DNA, 1642 bp, Homo sapiens
atagaatcaagaaaaatgggtatttatgcacatagtaaaagcatatagcaaggaaaagaaagaaaaatgggacacactgctaaaatagtacttgctataaacaaatggttaatgtcttcctattctacagagcatttgtgctatgtagggaggtttattattttgttgtaattatagaggcaaactgtatttatacagtttggacttgcagtgataattttaaactttaagtctttgttttagccctgcctggatatacagtgagtcaaagggaagagctggacttttcaggatattaatcagccattactctgtatttgaaaagcataactataaatcaaattaatatttagtgttaattgaagagtgagtccaggttgctgctgactcctcatattatcattcatccttggctataaaaggacagtctcagatggtctgccttatgttactgtgaggagaaaagagaaaaggaaaaccttgtgattgacaaccaaaatggcttttgcattgtgaatatggatcagagctttcactatggcttgcaagcactcagctgatattgataaggaagaaactgataatgagtgccttctgtcctcaaacactcaattaccgaggttctgagaaactctcaccattagctttatagctatgtaagacttgagatttctctagccattaatattatttcaaaattactcttggctttatctattagcactgttatcacatatttgctggtaggatcacaaccatggagtcagtagaaagacccaaggaaggcattgaaaggatggtttgtcttggctgcagtgctgttcctctattcatcatcctctctcctgttcctgtgcccgcagcgaagctgccgcccatgctgtcgccaccctggctgaggccaccttacaaggtgggggacagatcgtcttgtctggggaaaccgcagcagccgtcggagcacttactggagtccaagatgctaatggtaagagagcataaatattttattaaatttcttccctgtttccacttaaaccttcctgacatgactggcaacaaagccttcagaaagagtttgagcttcgatttttttttcttcattggtagacatttcatgcctaggaatattctgggagcctgtgattcctttcactagtaggaaacatgggggttcctgaaggaaaatactgtgataatggctacctaattgaattgttacttaaaaagtgattatcgtcttgtgacaagacttgctgagaagcaccttaaaattcactgtgagccacattttgtcttttactgtctcatcggatagggtagatcaatgtcctttactgtagcagagactctctcatgggcaggaccatcatggaaagttctgactacatcaagaaaggcgccaatgtctcacctgtgcttggggtcaggcagcaggctgtgatgccggtgcctctctggttggtactgtggttctgcttcctgttatatgtagcctcacgaaggacctttggatttagccaattacatgcccctaccctgagcttcttccccagctctttgacttcctggacattggtgaatatcctgaataagcaaaagggataaaattcatagaaatatggtggcaaaaatatacaac

SEQ ID NO: 127439 - DNA, 1513 bp, Homo sapiens
aaatcgcttgaacccgagaggcagaggttgcagtgacctgagattgcgccactgcactccaacctgggtgacagaatgagactccgtctcaaaaaaaaaaaaaaaaaaaaaaaaaaccaatcctggaatgaggatagataaataacatactttcatcatgtaggcagaaggttccttaatggcattagtggcagaaagaaaagtacctggcactttgtttatggtaggtgcctaagaaccgaatgctctgttagttggaaaagtctttgaagaaagacatagtgctgtgtcctcctttggaataggaggaaacaaagtacctctgtcccgccagagaagaataacataggaaatgcaaagagccatcgtggcttctgagaatcattttccaaagatgccaaacaaattcaattctaaaactatagcctactttttctgtagggaaagaggcttttgtgcttatctaaatctagacagagttgatctcaaccagaatgctgtaggacaaaggacatcttatagccacacatgttcaggatgaaatggaccatggttggaattaaggagaacctctctctctagctagactcctacttctatttttttacctttttctattcctcatcagagtcctaaggcaccctgagcaaagggtaggatatctggcttatgtggcattcatgtgaagtgtgattgctcttattcactatggaactgctaaaaataacttcccatgtgggttcagtaggaaactttattatccattctaatcgacttgacctgtctgggagagaacagactgctttataattctggctcctccccagcatcaccttttcagatggatgaatttataataagtccaaggaccctctggctctcggccaagtagaaccgttcagccatacaataaagttgaaccacacccgctactattgattactggaagctgcctcttttcagtagcattgggttgtgtgaatcatttggtgtgatttcatgttgttggctacatttgtgatctgggaaaattctggttcgcatcctaaaagccagtatttcccccaaagcaggccatcctcagtctgtgactgccagtacttgctgaactcaggccttgagagttggaagttatctctttctgaatgcagcatttctgtatcaaatcagacccttgagttgtgccgtatcccagcagttttaggcaaaggccaatcatttcatctgcccttgggaatccaaagaatgaatctcatatgggatatgatccaagtaactttgataatcctcttatcttctaacatttttgcccacagtgctatagtatttactttgggattggaaccagatttttccctcttaatcagcaattttgatatctggctagacttttagaggttctctttttcatcattctttcggattctgtcctgttgccagagtttgttgcttctttttgtttttgtttttgttttttgagacagagtcttgctctgtcacccaggctggagtg

SEQ ID NO: 127440 - DNA, 1030 bp, Homo sapiens
ggctatatcaataacactgtggtctcctggcaagttgtaccctctctgtacaggggaggacaacacaaatacttcatgagctttgtcttccagtgaccttctcagctcataaacagcatggctttgcttttaaaaaaaaaaaaaaaatctacccatgtgactgcagtaatccgcagccagtaaacagcagggtgggagggttgcgaggagaactgatctatttttatgcactgcagagtccaagcaggaaaacctgagaccggagacagtggtgacatcaagactcacttcctagtgagtttattcatgactcaggccatgtgcatatttccacttggattcctcacaagtgcaagtttctcttctaggctacaggtatctgcagccaggtgctgtaatggatttatagtagcccgccaaaagatcaaatatctgaagcctgacgggtcacaaagctgacaggagccatgactattgcatgaattccagatttcacagtgaaacagagctgctgctgaaaaatgggagcacagagctgttcactggggctcttgattctagacactcaaagaggggtacagttctctgccccatgtgtgtttctcacccaaccttttcatggtgttgaggaggggaagggacagctcagtggtgattcttcacttctcaaacgtgtcctcctcctctgtcttcataatgacctcctgaagtccaaagtgccttccaaaatagctcttggaaagaggtggcagtttcctgactccccaatctcccccatcctgggagatgtgttgatggcactaatttgcggggtagcagagactatagtcctactctctttactggctggggcattggaggcatgcagtaactgttgactaccactgctacaactgctgttatgattattaccattataatgattaatcactcacaccgaatgggaagggaagtaaccttcagaggttcactcttagtacttctggcacatatgcttagggccagggccagtgagtcttcattcgcagag

SEQ ID NO: 127441 - DNA, 1025 bp, Homo sapiens
ctctagtcgacatgtcagggccccaaaggaatcaagtccctttggcataccttcatgtcctcttttttttgtttttctgtacttcaatagatgcaaattcatttactctttggtctgcctgtgttgggtattctcagcttggggaaactcaatgagccagcacaccatcctatgaacagaacaccaatctgagccagggacattccgagcagacaactcaggtcagggcttccggacagattcccaaggtccctgccatctggcagatggacaccactgactgtggtctcctctccatccacggtgtcctcaaggccaagttacatgcttctttgtctcattctccttccctttaggtccgcagatctttcggagtctttgtatgtaaaggcagattttggtcttagattattccagctccttataaaccaagactgaatcttgtgcctgtcattgtgagcgctattctgtaaagggatttttttttctggcataccaaatccagagccataattggacaagtttaattggagtcatttctattcaatacatggatggcaaagtgggttttaattgagcatgtaaaaagggcattaatcactgttcacacaggaatcacaatattagaacaggaaaaattcttataaagtttttcaggttcttgggtaaaggggactttcctctttttatttatgcttccattaggattttgaaggaatgccagtgcactgttattaactctaatagcttgtccctcgcagccaggatggtttggggccctctggctctcaggttacctgtgtaaatacagggattcacttgccagcacccagctctgacatttgcttaataaagagcaaatgtgcagaacccaacagcagcagcagcctggcagaagcagtaatctgaacaggataaacatgcttcctctttgtgcgatgctctttctccatccttctgccaagagcaggatatcaaatgaaggggaggttgtggttggagtcagtgaagtgaatgtctaagtg

SEQ ID NO: 127442 - DNA, 1011 bp, Homo sapiens
ggacagcactcaaacagaacgtgcccatcatcacaggaagctccagtggaccacactgtttgaggttggtctgaacctcttgaaatgcctcggctgcttaaggaagcctgggagtttctattgcaggcttgttggaaggaaaaaatgaaatttgcctcaatgtttctggaacaactccttccagccatgttacctagactgtgttctttttcacctttttgtatttttttctccaaggatttcatgtcctttgcctactcctaccccttgtttaaaaaaaaaaaaaaacctgaattataacaatgaaaaggaaatttaattttaggaatgtccactttcagctgaccttctccttggccttctcctaattaaactttcacagccctgctgttggaccagacagtccttttctcattaaatggagcaccttagtaaaacaagagggcatgtgaacactcgggccaagagtgtgtaaacaagttgtgcattgtgtggacaatgctgctgggtgtggaacgctgggctgccaacactttccattttcagcaactcttgggaccaaggacagggcctttaatcttgcttcttccatttgtctgtgtctagtagctactacacagttgctttgactcctggagaaagcccacgtaaaataacaatactacttcaaatttagacagtgtctttttttctcaagaacttaaatcatgtaagcatgatgttatttatcctcatagtggtcctaagatacagaagtggcctgttggttttacaaatgtgaatatagtcaactcttacttgttacctacagattatctgtcacgcagattactcgtgacacattttaaatccttgggcaatttctctgagcgagccagtgtaagcctggaccatctcctctgccccccgacccagctgctgggtacttagggaatacaaattagttttcatattagcttaaagaagacataattaggaaggtaagtctgctacaagaaaatcacatcacaa

SEQ ID NO: 127443 - DNA, 1081 bp, Homo sapiens
agggtgatgacatcacatcatactgccctgattgtatttttcacattcttaatattgaggagtggttctgcctggttgcttattgaccagtgcactcgattagcaaccacttcatctacgtcatgtgcagtgccagttctgaccatcactgtgtttcagaagggaagctgcctgccagtccatctgccctgatttcatggctgttatctttaatctttacatctttgaaggcctttggtgaatgatgtgcttcctggcaggagaaaatcactgctgaaaggagatctgtgttgtctctgcttttctttctgtttcccgagagctttagtctaacatctgtgaccccagccagactccatcaaacttcatactcaaagtcatctttgaaaagcagtggcatttattatatacctactatgtgccaagcactgtaatagattttaatgtgtcatcccatctatctagtttagcagccctgtgagatgagtgatcaccattttacatatgaggaaacaggctcacaagccattaaacagcagaaccaagattcacatgtaggtctttctgactgggaagcctttaatggaaataaacagcctactttttctcacataaaatgcacctgatctgcagcaccatgagaatggttgtggagaaaattcgacttcattctgaatcagagtaaaaggtgttaaggctgtttggtctgtggagggcaagactaaagggactaccatcaagtttctgaaattcatgaagagtatgatcaatgatacattttcatatcatattcaattattgagcacctactgtgttcaagttgctcaacattaaaagacagtcctcggccgggcgcggtggctcatgcctataatcccagcactttgggaggccgaggcaggtgaatcacgaggtcaggagttcaagaccagcctgactaacatggtgaaacccccacctctactaaaaatacaaaaattagccgggcgtggtggtgcgcgcctgtaatcccagctactcaggaggctgaggcaggagaatcacttgaacctgggaggcagaggctgcagtgagccgagat

SEQ ID NO: 127444 - DNA, 1267 bp, Homo sapiens
gaaatggctgcttgagcaaggaatggcgtgtgactttttccatttcctgggatggatgatcagagccacaactgtggacacagagttctccccatattggaaccccacattctcaagagaaccgccaaccacgggagcacaaggatacaacgggctcagctgcccctggccaccaccccagtggtcccgccatgggccatctaagatctgcaaagatgggtggagctattagagtcgcaggtctgggggaaagtgcttaaggatttctgccttccctttcccatcctccctccttgcccacccctctatcccccacccaaacccccaccccctgcttctggaggatctggaccatgagcagagaagggaagtgtctaccaggaagaccacgttcccaacaccgaggtcctgcctcccctcaggaaaagggcagcacatgtacttgaactcaagtttgagactgaagcttgaaagtgataggttgaatgatggtacatgcttacacagatacagaattcacccaaaatgtcattaaggagctagaatgggccgggcacagtggctcacgcctgtaatcccagcactttgggaggccaaggcaggtggatcactactcaggaggctgaggcaggagaatcatttgaacctgggaggcagaggttgcagtgagctgagatcccgccactgcactccagcctgagtgacagagcgagactccatctcaaaaaaaaaaaaaggagctagaagggaaagtcaacagaacaaggtcaaacaaggtcaaggcagtgaccatagaaaataaaaccatgttgtgtccagatccaccaaatcaagaagcctgatgcctttggttccatgaacagaagacacctcagacttgtgggttagtcagtggcaaggaaaggttccatttccacccaaccctaagagacacaaatccgttttcataaaagtgtgagccccaccctgccccaaggatatgggggatgggcacctctgcctgtggctcacctcccctgacaagctccagtgggtgctgtgcttcctcttcactgggaggcttgttcaggaaatccagttcactccattattgaaaacaactccatctccaggaaaagttgaaactggcagttttagcatctgatgatggagccttctctgccacttcaaggcctgctgcctccttttccagccggcctctcaccccaggaaacaccagcgaagccagtgcaaggagaggcctcaatccctggaagattgaggtcat

SEQ ID NO: 127445 - DNA, 1172 bp, Homo sapiens
gctccaggctgtggccctggagtctgaatcgaggagtgagggaactgggggatgtttggtttcagggctttggcctggctcctctgggtggtgaaccttctcaccctctcccctgaaaggccctgttcagggtgggctctagggccccgagggagggtctcctaaccttccacaggtcactaagagtggttccttcctgggctgctggctgggaggatgagggcagggagggcacgccgtgcatcacggacatccagtgatcctgctgaggccatggagggccagatgggataagcctccagagatgtgcaggaggagagtgtacaagtcacttgtgtaaatgcgggactggccccctggggtgcaggtggcccatgggctggacctctatgcctccagcattccacttcatggatttgttcctcctgacgcctcagaacctgagacaaagcctccactcaccttcccagagcttgtgtttgcagtgggagctcccctgagccggagccgggccacagggtcagagtgagtggcacttcccagagagttgggcttggtgggcagacctgctggggaagcccggccctggagtctcctggcctgcagatggctcaggagccagagtgggagctgcgcgtgtggttgagagggtgtgggtgcaggtgtaagtgtgtgtgtgagtgtggcctagcccgcagtgaacggtgcaaatgcaaatgtgaaggcctatcccctgctccccagccctcggcctgccagccttccttctctggtgctccccatcccccaaaccccttctatcagcccccatcagccctcctttctcctcacctgccctcggagggtcatgtgtggttccatgacccaccaacccctgtggctgggcagggcggggcagacatctatctggtggctccaggctcaaccggctccgtgcagctcactgcgctcttttggggagacacaggccgagtagggaaggtctgagccggcagctcttgagacagaaagagaagggaactgttctcccgcaggctgcactatgcatgttacatgccgtgagcacaagcagacgctgcgtaaacaggctggctctgcagggcatgaagaaggctgctctgagctagggccacacggcacctgctgggacacagggaggggtggggagtcct

SEQ ID NO: 127446 - DNA, 1336 bp, Homo sapiens
cagaggccaaaccttccccaccaagcctctcctttcgggcagaggtgtcctccccagcgcccaagcccaggctgccggtccggtctgggtgccaccgaggtcctggacttggccctggggatggcctggatctgtttgcatcttaagccatcatcccatctcactccaccctaaagggcaggcaggatgggaggggtggtggcggtggcggcggcagcggtgtcattttgggggccctgccaagtcagctgctcccccagccggggcatgttcggaaaatgagcctgctcatggtgggcccatactgcccaggaggcttgagggcaaagagtcccttccaggctgcaggggaggcatggggatgcagggttgggggcaggcagcctgcacccttgctaaaggcttgagatgccttcaggacacttcaacaccccttgggaaaggacctggcctcatcaggggaagtgggaacacggaagtgtgctgcccttgggtaagtgactggcggtctggggaaatgccactccgagaatcagatcgcagccagccctcaaagggtctgggtgtgtgcagggctgctgggtgtgtgcagtgggttctgtggtcaggagagtgccgtctggatgggagatatttggttggttttagcttggcccattcctgccactgactgatggccccagaggctgcctgttcccgttcctgggtagaaggtcccagcgccattgtttgtccactgcttttagggaagaggccttggcaagtggaatgctcttcctcccttggacttgatagggaggaggaatgttttgtgtagcaacttccctctctccctttggggtgggcagcctgtgagctttaggctctagggaatggcttgggagcatctctctggattaaatggagcagtgacgtgggcttagtaaatagcaaaacccagcccacattagccatctcttccccagcgcccaggggcagggctctctggcctggcttgtgctggttcccagagtccctgctgtcaggtgctgggagtggaggtgccctcgggttcccttgggagtggtgaccacagctcagggcctgggttggatcctggtggctgccctagggatggtgtctgctccatgcctgcccacaggaactgcaggttacagatatgaggggaagggaggagaggagggggctgaggagggaccgggaccagcaggaagggggactgtggggttgggcctccacaccagggcgaccctgcaggaaggaccttgtcgcagttgcggggatgggcgcctctgtcctggccctgcctggaccatcctaactgtctctgtctctt

SEQ ID NO: 127447 - DNA, 1087 bp, Homo sapiens
cagcactggtcaccatgttcctgctgtgcagtcaactggacccgtcatcctccagctgccagcttcaaccacacacatcccccacccgggcactccctggctcagacacctaaaatgactcccactgatctgggctaagtccaccaacccttgcctgaggctccctggggagaagcagccccatcaggggctggcccagtgacctggggcatgatagctcccagctggtcccaagtcggccactggtctcctgcttgattgctgaccaccagatttcacatgggtccagcctggctggccaggctctccccagctttgacagactaggtccaggcctcccagcctcagtctctgccatctggggcatccttgggagcccaggcctgtagattcagagctgagacacctccaggccctgggtgcctccatggaaggtgtggctggtggcggaagagccacagtgacccagctctaccactcaccaacctcttcagccaagcctttcctctcaaagcctcaggttccccatctatgagataactattttaaaaaattacaagccccacagggctgaggtgggaactgttgggattatatatgtaatgtcacctgacacccagatggagagcataggccagttagtcatagcccagatccagggacccaggaagctacattaccagtgtgtggtgtgtgaaggggaacattggcctctgctccagaaccttctaggggcaggcctgaaaatgccctccaactccgagccccactaagtatcctcctcttggagctgttcggagatgacccactccacagcaggctacagctccagagacggtagcccccctggaaacacccaggctgacctcaagggcagcccacctgcctggagctgcccccttcacaacctgcagcagaaaagaccaggccctgtgctgccagccaaggtctcaccccaagcgtgtgctgggagcctggctgggcctttccaacccacggcaccattcaggatggccctacagatggtttcagactcccccacctctgccctgggcggccccatctgctggcccagctcagattgctg

SEQ ID NO: 127448 - DNA, 1896 bp, Homo sapiens
aggagtgacttcctgagatcaccacctcatcaagctggattgtcctctggggagatagaccagctagaagggcagagccctgtagtgggggtgtgtgggagcaggacaaagagtcctcgggagcaggaagggtggagcattaagcagtgtctaggggagagcggatggctttggccaaggtacccagatggagctctgaggtccacgggaggtagttcctgggggtaacatcgccaagaggtctgcatagtttctgggccagggcacctgctctgacccttccaggatattttctagccaccctgccttctgggccaccgctgacctggagtaggctgagactctagtggccactctgcggaggccccagcttgcctgccctgggtgccagctccccagagaccctccctcccaccctctcccttcttcccgtccttccccagggcctgtgacaccagaggcagggcctccacagcaacttctctctaggcagctgctctggcaaccactgatgcaaccttcccagcccctccctcgctcctgagcctccgctttcctccgcagtcactccagagccagccaggagccactcccttgctagagtgcatccgtgcctccggctccctccaagccacctgggtggctgcaggacttctcttctgccctcctttcctggccttttcctgccttgatcctaggccggcagcagagatgcccagcctgggcggttcacagtctggcccaatctggtctggtttgggatgggagtgggggtgagcagcagattcggtttgttcctggggctctgtttctgccacagggcaggctggggggtggaggataatggagaccaaagtgcctaggagcctgggctgctggtgtctgggctcagaggctacgagaggcatcttggatgtcccactggtcactgcccctgtggcaggttgggtagagaggaggctctggccagctgcttgcctctccgagccagagttactctggcaaggagatggatggtcctgacccactccctccccagcctggaggcgcagtctgggtgatgtggagggatgtgggccttcaggtggagataggagacaccttggtgtggtcttctcctctgcaaggccagaaggtcagctcctctcccgcactgtccctgtctccttgaaggtcatcttgggctgatggggcatgtggatcttgtgaagaggtgggatggggtggggggtagagaccgtagcagccgctgctgagggcctgctggggggcccccaagggagtgggcaggctaggagcagggaacgggcatcgtgggccgctggtctctccgcagggtcggcaggccgcagagtgtgactcctgttctgtgtatggcactggtagaattcactgtgaacagtctcagtcagtgaattaccgaagggccataaacagagcagagacagatccacgagggcctccggagcaccttacccacttctgccttgagtgctcctagacgtcggaaacaggctgcttccaagggtgcagggatgcaaggcccctcgtccagtgtgtccccagagagcccgcaccagtgccatctgcttggccgattttggcactagcacatttttgcttgtgtctctccgctctgagcaatcatgtgcagtgccaatatgggaaaagcaggacccgcagctgcgtccgcctcccctgcatccttgtgtcagggccccagcctgctcctcctcaaggcctcctcaccgcctccccagcccatctggctcagctgctgtgtgagggcccagcgctggtgggcagccagatcgccttacactgcctggggccacggtagagctgggagcccagcaatctgagctgggccagcagatggggccgcccagggcagag

SEQ ID NO: 127449 - DNA, 1117 bp, Homo sapiens
tgtccccattccagccctgcgcccctgggtccgggtgcgccccctgagacaggtcagccttgagcacctttctgcggggagactgcagagatcgtccagtggccctacggtgcgccccagctcccaacgcacttcccctcccccctcccagggtcggatttccaagcacgccacgccacacacacctcggctagctccgggctcagagggcgctggggtggcagggcgtccgggcgcacctcggctagcggcaccctagcccgagggcaggaggcggggatagaaggcgggcgacgggaccccttggggccagacccggccgggttgggcaagcaggcggggctcccggcgtctccgcagtcccggacgggcgtgccctgcgccgcgcaccaaccggagccacattcaaggtgaatcatccccggcccgccccctgcccctccccgcctcgcggcacctgagccaatggcgctgcgcgaggggcgggcggggcccggggcggggggcggtaaaaccctcctggagtcattctctgtgcactccgtcgagcccccgcgcagccgtgccggagccgcagggcctccgtccagccgcgcggtccgggcagcccgcgccccctgttcttccggtcctcgggcccaggtacccctctggacctcccccgcctgcagcgcggaggcggctcctcttcaggtggccgggccggggccttccccggcagacctgtcacccgacacccaggaagcgcgcggccgggtcccggctcccctttgttcccccgctgggctcggcgctccggcgccgccccctctcgcggggcagcggaggtttgggcccgggccgggcgcgcttcaagctccgtccatgcggctctttccaaaccggggccgtttttgcctggcttctctggtgtggactccgcgcggagctgagaggcggctgtgcgcccagcctggagccggcgcaggtgagtgtctggggccgggagcgggggggcgggccgggcggagccagagcggggctcagtagaggaggcggaggcgggcgcccgggaccggccgcactagaacccgggtgcagggcagaagtcccggcgcagctggctttcggggatgac

SEQ ID NO: 127450 - DNA, 1052 bp, Homo sapiens
aaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtataatgaaaactgtaaacttttttaaataaacgtgtatataccttggcaaatggctggaccttgatcaataagataatagccctcatgattactctcagctggttttctaaaataccctctctgttctggctcctttgagcagcagacgctggcttcttttggctgagcagctcttagaatgcagatgactaaattagtttgggaagggagtggcacccttaggcagtaataaccaagaggctctgcccagaggcctgtccttgaacctggaactcagatgcacaactgctggctatgaacggggctgtgaggctcctccactagagccgtggaaagcccgaaggtccctatctacccccatgcctaaaccttctaagccctgtcaactcacgctgagtgaggatactccgtggcctggagttcaaggacagtgcagcttcctgctgggactgatctgcctaaacaggtggtcctctgccaagtgctaagcctcctgggagatgaggaacggtgg

SEQ ID NO: 127451 - DNA, 1051 bp, Homo sapiens
cctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctggagcagcggtgtttcaccaccaaatgcctttccaggctgcccttccaacactcaggagagcatccagatccctgggcagaggctctacattcttggctttagaggtggtggcagcggcagcaggtcagagccacttctggcggtttccctcccctttttagtgcccatagtttttggatcctcccttgagttttaccagcacaagccattctttgcccctgttcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgt

SEQ ID NO: 127452 - DNA, 1059 bp, Homo sapiens
aatacattaaagagggctgatagtatcaaattctagtgtcaaaaaaaggtcaatatttatcttctacaaaggaagacgcaaaatagtcaacccattagaggttaaaaataaaattgttaaagtttgaataaatatttctcaattaaggtaaattcctacctaatcatgggctactttaatctcatcaaaatcattagcataaaattttgttataatgaatttgaagggctctaagtctcaagtctgcaaaccttttctgtaaaggaccacattggccagatgtggcctttatcacacattctgtttattattttttaagacagtttttaaaatataaaaacattcttagctaggccctgtgctagttattcaaatctggtaggcccatttggccattcagcttatcttcctattgcagtgagtccccgcaactctataggaggaaaaacaaagccacaagggtgtgtttttgtgtggcttgcattttgaataggtttctgtcatgtcttttcctattgtgtggaggctgttcacttgaaaacagtatgcacttagagtttttaggaacaagtttgtttattcagcagttcttaaaagccgtttcagcagtcttattcagcctagggttccaccaaggctgtagcagcggaaatctaccttcaggtaaattatacatggaaaaaccactcagagccgagtggtgtctccgtatagcagcttagtcctgagcagattgagcgatggtttttgccagctgcttcaaaaacctgacaggcaggatctgtttagactaaaatcgattcctaaaataatagacctggactgaccgtaattatgtaactgcagatctaaaaatgatgaaggatttccttataaattactatggaatcatgactggtcctatactatctgggagatgaaagtaaaaagaaagcgtggggctcccatttccctggtccctgaagagttcttggggtgctgcagcacacacattcccctgcaagctgagcctgctgtgttgctcttcccaatacccctttcctcagggggcaaaatgca

SEQ ID NO: 127453 - DNA, 1063 bp, Homo sapiens
attaaaattaaaatgtttaaattggtattgaaatgaatgtgtaatacaagtcacatgtaatagagcacactcgtatggagaatcatccccgtgtgaatatctaagaaggtaagcagcttgactactgaatgcaagtgaattttaggtgaacttgcatttcccatgtgtgacatgtttgtttggtttttcagatcttaccaatatatttgagtccttcctgcctcagttattggcctatcctaaccccatagatcctctcaatggtgacgctgcagccatgtacctccaccgaccagaagaatacaagcagaaaattaaaggtaagaggatgggtagtttaacctggagacaaaagaacttaaatctgttgggcttcagtcattaaaagtccttcttaaattacttagttcctaatactttttcttaggcctaaaaagagacagctgtgggctgaagtagtgctcaccaacctcgggtggcagtagcaccagtttgctcatcctttgcgatttagaatcctattttcccatccttaaaacagtttacgtgctgatgggatatgagtttcatttaaatgaagataagtttgcgactggccgtggtggctcacgcctgtaatcccagcactttggtagcccgaggcaggcggatcacaaggtcaggagatcgagaccagcctggccaacatggtgaaaccccatctctactaaaaatacaaaaattagcctggtgtggtggcacgcgcctgtagtcccagctactcgggaggctgaggcaagagaatcgcctgaaccaggaagcagaggttgcagtgagcctagactgtgccattgtactccagcctgggtgacagagcaagattctgtctttaaaaaagaaaaaaaatctaaagctccacctgggttcattggattttccattttacctctgtgtatgtttcagaactttcatagtgaaaagtctagatacatgaagctccaccaagaagcaaaggaattcaaagtttgtgaaatatacctgctgcttttaaccaatggcaggcattagtatctagccagttttt

SEQ ID NO: 127454 - DNA, 1045 bp, Homo sapiens
ttgttgtaaggcagagctgctctgtgtcaatacctggtgtgtgagaacaggacgtggtagctgtcatgggaccctctagcccatcattctctagacctgcactgtccaatacaggatctactagccatgtgtggttatttaaatttaattagaattaaataaactgaaaattaatttccttattcacactggccatattttgagtgctcagtagccacttatggctagtggctattggtttaggtgagcacatataaaacatttttatcactgcagaaagttcggttgagtaacacagctctagattagtctctaactgctcagcttcttaaccttacagtgataagagccacctcttataggtaagattttctagagcaaagttgggcagaccttgggtacttgtttttgtatatgtagttttataggaatacagccacatcgatttgttgacctatactttggctgcttttgtgttacagtggcagagctgagttttgagtagttatgacagagaccatatgtggcctgcaaagcctaaaagtatttgaccctttacaaaaaggtttgcctaccgcttttatctagatcagggtttcttaacctcagcactgctgacattttggtctagataatcctttgttgtggggctgtcctgtgcattgtggtgtttagcagcttccctggccttcacccaccggatgccagtagcaccgcttagatatgacaaccaaaaatgtctctagacattgccaaattccatggggagcaaaatcacccttggctgagaaccacaaatctcaagcaatgtggcttggcaaagcattcatctgtaatactgcaaaggagcgcccattgttaaaagcaaaattggttgaaagagctgactaaattaatgagtagttttttatgctacttagtatacttcagcattgtctccagaaacaggaatgttttatataaaacatgacaaagcagctggagtggggcagagacatggaagcattctcatgtccttccatttctcaggggtgctgcagttcac

SEQ ID NO: 127455 - DNA, 1140 bp, Homo sapiens
ggttctaattgagtctaaggcaaaagtaagagctgtttgctcatcataaaccatatactcaggaatcttgggacttcctttaaaagttaagacaggcggaaatggggtcggctgactgtactctacaggtttaggtcaactgtatctggctctcttcctttaaaaaaattgaaggttaatgtttttagataaagatctttgaactgacacatttttatcgttattattatcgacacatttttatcgttttatcattaacaaaaatctagggaaaaagtgttctttatttttctacagatgagtatctttattttattcttgatttatagttttagtcttctctgccagtgtatttatcttgaaagaagactttctgcacatctgcacatttgagagatgctcctttcagaagcacccttaggagtaatcactgtgttagccacttgcaggaaggccttattgctttaagatggcagagccatcacatcctggcctcccgaagttgtcatcttcacccaaaactgggcctcatgtgtttccttttctgctcttctgttttacaggtgtgactcagcacttctgtaaaatggatcaaaaatgtgttaatgcaggaagacggtagatacaggaaggaagaaccaataattaagggttcttttatttgtttggaacaaattcataggcaaagccttttattggtagcttgaggaaacttaaaagtagtaggaaagggtataaaatctctttctgggacacgctaaactcctagttttataacacgttgtctgtgatatttctctagccctgaagcacttctgaacattacttcagaacataaaacctatgctttgtttttaaaggttttcgttgttatgtaatagcatccagctgctaatccttttgagcagcacctgtaataataatatggcaggaggagccttccgttcgctgtgtgcaggtgtctgcgggttacctcctgcggtggagctgcatgaaaacaagcacaccgtctctgtgaatagccacagaaacatctgaacgtcctttgcttagcatgcttctttgcacttgtgagggattctttggggaggagggtgatcatctctgatccatggatttagcttccctgccagcgatggt

SEQ ID NO: 127456 - DNA, 2093 bp, Homo sapiens
ttctgcctgcctatccgattggttttactgaagttttccttgaggggctgtctgtcatcttttagggccctctgtttgcaagtttttttcaaaaataacaactgcttagttgtgtgcagtgtaggactctttataggtttttgactactcttcttttcttgtagaatttcactgtcttttaatgtttacagactgcaagcaggataaaattaaaaattcaaccattattaatattgctgctttgtaggagctggtaaaggagtagaaggtaaagatctattaattatagtgtctaatacacccttgaggaaaatctgttaactccaaattattaagtacctaaagaaatctggagatcttaatttatttgccctatttcaggccttaccaaaaaaaaaaaaaaaagctacctggtttttgtgcatatagtagatacccaccaccaccaccaaaaataattgtggaatgaatgagatttcatggttggctttattttgggcacatattgtaaaattcatgacttgcgtggcagttcatgacgaattcaatacagttcctaaagtcaaccaatggaattttgaaaggtcaacagctgcttttctctagtagtcaaggatgtgaataacttgggtgaaattcccaggagtttcaactataatgaccaaaagttcaggggaaagagatctatgtaagtcacagagggaatcatcagttctagacaacaattgacttgtgatttttgtccatgttttcctctaggtgtgaacaggatttttctttcctttcctgtcagccctgttccttattgaattacagaacagataaataccttagacagtagtgactatccctgtgattttcggcttggaaagccaggagtcctcctccagagggagagggatgatgaaagaagtttggatagcatgcttctggaggatgcagaattttgattggcaaataatcattgtacatattcatggggtacatagtgatgtgttttttgttttttgtttttgtttgagacagagtcttgctctgtcgtccaggctggagtgcagcagcgtgatcttggcttaccgcagcctccacctcccgagttcaagcagttctccaggttgcagaattttgattgagggcaagaggaacttattgtttgtgggaaatgacctaagtgattgttttaaggaaactttctctgattacaaaggcgagagtatagagcctttaaggccatttagtagatggctgccctgatccagggctggaatgatatattggttttgacatagttacatgccaggggaaataaaagaaaaactagagacatttctgggaaactgagtgagtacatggaagaaaggaagaacacctagccagattccttccagaggcttggagcctgagagccagggcgttagagtcaacctactcccttcattaggtgaagggaatgggttttcaggaaaataatcttagacatgtaaagtttgataagactacaagactagacatatgaaggaccagttatatggatttggtagttaccaacatagacttcttatttttctttctttcttttttatttaaagagactgggcctcagctgggcatggtagctcacgcctgtaatcccagcactgggaggccaaggcgaagaggatcacttgagccttggagtttgggactagcttgggcaacatagaacttgtctctggaaaaaaaaaaagagagactgggtctcactgtgtcatccaggctggagtgtagtagttgtgatcatagctcactgtaacttcaaactcctgggctctagtgatcctccctccttagcctcctgagtaactgggattacaggtacaagccaccacacccagtagacttattcctttaaaattgtaggatggccaggcgcggtggctcatgcctgtaatcccagcactttgggagtctgaggtggatggatcaccctgagatcaggagttcgagaccagcctggccaacatggcaaaacgctgtctctactaaaaatacaaaaaattagctgggcgtgcacctgtaatccagctactctagagcttgaagcaggagaattg

SEQ ID NO: 127457 - DNA, 1770 bp, Homo sapiens
agagaaaaatcaacatttgggaaaagtcttcccctagagttatctggggagttagtaacaggcaaataaaattgactacaacagaaggaatacttcaaggactttgagattaggcaagagatacaaatttttttttttttttgagacggagtctcgctctgtcgcccaggctggagtgcagtggcacgatctcagttcactgcgagctccgcctcccgggttcacgccattctcctgcctcagcctcccgagtagctgggactacaggcacctaaaatttattttaccaggcatttagaaatttaaaatacaaatttaacacttatcccatccccttttcagttagatagtctgtgaatcttcccaaataattcagattttggcagaaggtatatcttaaaataatgctttatgctggattagtgcatgctgtttcctaaacattttagtgtaactacacagataagaaatacatgtatgtgtcttcatggatgattaattggccaactactatttgaacagcttgagaacttcagtattgatctgtccatgttgaatcacaaacgtcatcctgcctttggaacagctggatgtcattatttgtagatagaggccaagtagagcaattctgtccagtactattgggataatgtcacctgttgtacataataaagaaatgtgctcagttgtggatttgcgcttcaacagtgcttagctagctccgtaaccaaccttctttatctgtctgcttggaaatcttcagatgaggtgtatgtggctcaggagtctaactagttatatacataaaaatggagtcttgctggctttgaacaacttagtggacattcattaaaaataccacactcactggtggtcagctttaaaaccatggggtggtccaggctttttggatcgtgggacatgagccagccagggtatggctctgaaagacagccacagctatgctctactttcgtaggggctctgattttagggcttgtttcattcttgattatatgtaaatgtaaccttgatttgttttatcttcattcacttacgattactgagttataaagtcttcccagcgtatggacacttggcttgtaattgcaggaagttacctcttgttattcttttctgatattaacaactaaattattgtctagtaattacaagcttgaatagcgagttttagtatgacagcaagactatccagctagctaattacacattaactgccctcatttctggaaggttaataacaaatcctattaccatgttttagcttacaagctcttaaggtaagcagggttataaggtttgaacgaggatgaattacctctaaaaaacacccaaatagacgagaattgttttgagattgacaatgcaacaagagcagtgtttttgatgaacaagagcttgttttcttcattgtgatctatgcagtagcacttattttcttctgcaactctctgaagtttaaatatgttggggggaaaggggctacaattaggcaatgaatgggaaattaccttttaagcgggtttggaatgctttaaaaacagtctatgtcctgtaactacacacctcagtttggtggcctggtagcctggccctgagcagaatgtggctggttttcccagtttcagcaccctgcatccatctgtccatctatcttttctcttctcttttctcttctttctttctttctctctctctcctttctctctctctgtccctccccccatcccccttccctctctctctctt

SEQ ID NO: 127458 - DNA, 1029 bp, Homo sapiens
acaaaacttctgggagagtgaagtttcttaacttttatcatgacactggctatgaaccatttagtagtataatttatctttgagcagtaccttcatagctcagaaaacagttgctttaatgattgttttgtataagaagctgcatttctcccagtttgctcatttgttaatagaatgctgatgtattccaaataattggagctatcaggagaatataatgtttatcagtaatgaaagatctaaggttgaaagtagtgatttataagtattatcaccttttcccaatactgaaattgtttccagtactgaaatacttttattgttctctggatactttttgctgctaattaacatctctttttacaggattcatgaataaaattttccatcccaacattgatgaagcgtaagtaactattttaaaatgtttcaattttagcagcaactgctcatgattagtgtttctctgtgttataaaaagcctcggttatctttttggaccttatcaggaggtaggactgtatgaatggtcatgtaaatgatagaatccaaaggatatgaggttctcaatcacttagttcacattctgctgttgtaccacttatttttttccattgtcgtgactgggtccttcatttttcttgttacccagcaaacagtagtaatattccacatctcacttctctttttgtagacacagttcagagatctgttttcagcctacagatagactattttcagatcttataatattttctcaattcttgatagatagtaaggcaaaatgactatagtttcatttcagttaatgaatcttatttatccccttctttccttctaatattttattaatgatactttaaaatattccagcatatcctgttttatacttctagtgctgtttagaatatattattgtttgggatgcaattttaatttgtcatggcactaagttttactgtctctcacaaacatacctaacaggtttttctgcactctgtgtgagtaggttgtatatatacatacatc

SEQ ID NO: 127459 - DNA, 1451 bp, Homo sapiens
tcactgcaagctccgcctcctgggttcaagtgattctctacctcggtctcccgagtagctgggactacaggcacacgccaccacactcagctaattttttatttctttttactagagacagggtttcaccatgttggccaggctggtcttgaactcctgacctcaggtgatccacccaccttggcctcccaaagtgctgggattacatgcatgagccaccgtgcctggccagataaagtcatttttaaccactgtttcctcttctgttcccttttcctatcatgaccctggccctgtgccctaactgaaacaattacttttgcaaatttggtatatgttggttcagtacagttttcctatacttgttaccatggagaattggtagttgtttgttttagtttatttaaataacctcagcctgtaaatataacatcctgcaacttaaaaaaaaaaaacaaaactcagctttagatgtatacaagttgatacacatggatctacttcattacccttggctgtataggactcaggtagatggatgtactcccctttatccaaccctatcccattgacagggttgaatttggctgttggcttttataaataatattgcaacaaatactctcatggggcatctgggacatgtgtattagtatttttctaaagttaatgtagaatgttttttaccctaatttttctcctcttaataccaagacatgaacatttcccattattaaaatgtcttcataaaccacatgcttcttaaatctagactttgaaacatctttaatttccttaatgaaaaattaatattggacacaaagattttttttcatcagagtaacttaaacatcacataggccctcttgattgtagtagatagaacattatgctgtttcaacacagagcatttaaaaacaaaagttaaaagtgtgagtgactagagtggtctaagactggactacttggacttggtattcttatcccctgttttctacttcaggggaagtttctcaggtttttggagacaatctctgtagcgcctcacttgaggctcctcctccagtgccatttctctgcatctttcctgactcttcccattttactccgcctactgtatcaatactttattcagattgcaggtatttattggtgtctcttgtcccactgccacagtgacctcctcaagaatagtgaactgtcttatttttataccctatccaagcacaatgcctgcggtgtaggtgctgaccaaatatgttctgaatgaatatgagagagagagactgtggggatgggggtgatggaggatgggggtcggagatagtggtggtgatactcaccttaataaggaacttcagatattgaaagtgtggaacagaatgagtcctaaaaggaaatgaagtgataaggatgacaaaatgacacctttgacaatggatctctgcttt

SEQ ID NO: 127460 - DNA, 3879 bp, Homo sapiens
ggtttcaccatgttggccaggctggtcttaaatgcctgacctcaggtgatccacccaccttggcctcccacagtgctgagattacaggcgtgagccaccgcgcccagccaatatatatatatatttttttactcatgcaagtgataaagggaactgcattaatctttttcattgtcagaataatagactgttcaggcattatacattttttatttcactctggccagaaatgacctcacactatttttggagtggaggtttataatatggcatgactaaactacctatagaacttagaatacttaccattttatcttatgtcttcctagatggaatcattctagagttactccctcaagaactagcatgagtaacttcattgagcagtatttaagcagggatgggccagtatttgcagtagagaggagtttgtcattcacaagaggtttcaggttagtcatttaacaaaggcctacttgtaccactgtattttcacaaataaaatgaattctgtgactgggcacgatgactcatgcccgtaataccagcacgttgggaggccgaggcaggaggttcacttgaggccaggagttcgagaccagcctcaccaatatggtgaaaccccgtgtctactaaaaatatatatatataaaaagtagccgggcatggtggcgcgtgcctgtaatcccagctactcgagagacggaggaaggagaattacttgaacccaggaggcagaggttgcagtgagctgagatggcgctgctacactccagcctgggcgacaagagtgagactccgtctcaaataaaatgaattttggggctggggaggcaaaattccattcagatcacctgtgtacttctctaataaccgtggttatgactttagtcctgtcccaaacagttacataatggctactctgtagtgatctatatcttttttttttttttttgatacagagtcttgttctgttgtgcaggctggagtgcaatggcacaatctcagcttactgcaacctctgccccccgggttcaagtgattctcctgcctcagtctcccgaatagctgggattacaggcatgtgccaacacgccaagctaatttttgtattgtaggagagatggggtttcaccatgttgcccaggctggtgtcgaactcctgacctcaggtgatctgcctgccttggcctcccaaagtgctgggattacaggcgtgagccaacgtgcctggccaatgataagtatcttttgaattccagtagagagaaacaaggttctagtaagtaaggaaggttttgtaaaaaaataaatagagataatgctatgagaatataagccattgttaaaagctcttttactggtgttctgaaaataacatttttcaaaaattatgtctggcagctgaggctttggctgtggcatacatcatccttccaatcagtttcacaaagttattggatacctactgcgagctgggcgttattctgggtgctgtagatacagaagtgaacaaattgctctcttaatactttatgttcttttggagtgcgaagataaagcaaaatttaaaacttctgatagctttatgcagagaattaatggatagaataggtaccttggatcagatattcaggaagggtctgacaaagtaaatttaagctgagacttaaaaagattaaaaacaaaacaaaacaaaaaccagccctgatcctccaaaatcaggggtaagagctttccaggcagaagaaattttgagtacaaaggccccagcctggaaaactgggtaaaatgtgaggtgtgtgacacacgggccaagtggcaggcagggttgagttcacagaccgctttgtaggccaggttaaaggctcgactttcattttaaatgtaatagaaagattacatagttttcagcaggggagtgaaaggtctgattttgtttttttaatgatcattctactgctgtggggcaagacacagtgacgggatagaagcacagttataaaagcttttgtagccggagatgctggtggcttggacaaggctgccaaggtcaagaaactttgttctagacatacaccgctgtgaagacatgtggctccattaaggaaatcatccaagctggactgcagtggcataatcgtggctcactgcagcttggacctcctggactccaggcatgggccaccacgcttggctaatttttttgcattttttgtagccatgggtttcaccatgttgctctggctggtcttgaactcctatactcaagcgatctgcccacattggcctcccaatgtgctgggacagcaggtgtgagccaccatgcctggcctgtttttaatttttaaatggaagattctgaaggattttaaagtgcttattgtagagagatgtttagaaaagggagagcttggtgatgctggagttgggaagagaattgcaggagcaccaccatcgagaaggaaggagggagcaggatcagaacccagaggcctggtgtttgagaagaggggaacatgtgtgcaagctgttgaggcagggagaaagagtatgtgtgcagggaggagtttagaaatttttatggaaaatgaagaatcctgccaattggctttcatcttctcaaagaaaagggacaaggctatttagtgaaagaactagaggagagagttaggggaacaaagggagagaaagaaagtagatttgcaggattgtggtaaaatgtaacagtcatgggagactgggggagcgacccactagagaaaggggaagggaagattgtaggtgatgctgagtccaagaaaggctgttgagcatgtttagataaactggtatatatttgtttacttatgtctctcctccctgccagctcagtagatgtgaactccatgaaggcagcccctgggtctgttttgctaccaccacccctgtcctcccaaatactcactactcagggcctgatacagtgccctttctgcagaagaatattcgtgtgagtgaatgaatgcctacctactggtaccctcaagtccaagttgagcaaatgtgaatgatgcttcctgtggtagctttgctagatgggcattttggaggggagaggacaggggatttgcagaggattgcttgagagtgaggatggtgatggctcttaaatcttaagctgagtaagaagccagtgaagataagagggctggtagttgggaagaaaatgggagaatctgtggattacagttaacaggtgaaagaattaatgattcctggggtgggaagcttttggcaaggacaggggattggtaggataggagatgtctaaatttgtgattgtggaggtaaatatgtaattgtggagggaatgacaaaggtcagggtatgtcctggggagcatgaagtggaatggaatagaaggtcactgaggagaagcttaagaaacaagccgggcacggtggctcacgtctgtaatcccagcactttgggaggccgaggcaggcggatcacctgaggttaggagttcaagaccagcctgaccaacatagagaaaccccgtctctatactaaaaatacaaaattagctgggcatggtggcacatgcctgtaatcccagctactcaggagactgaggcaggagaatcacttgaaccccggaggcagaagttgcagtgagccgagatcgcgccattgcactccagcctgggcaacaagaatgaaactctgtctccaaaaaaaaaaaaaaaaagagagagagagagacccgggtgtcaggagtatggtctatattgtcaccaaaaatgacaggagttggggcagagagcaacttgggggccaagccaggtgctgaagttctcagtgagagaagccagtggtcaaatgggcccttttaat

SEQ ID NO: 127461 - DNA, 2580 bp, Homo sapiens
ttttgagactgagtctcaccctatcacccaggctggagtgcagtgatgtgatctcggctcactgcaacctccacctcccaacttcaagcaattcttttgcctcggcctcctgagtagctgggactacaggcatgcatcaccatgcctgggtaatttttgtattttttagtagagatggggtttcaccatataggccacgctggtctcgaactcctgacctcaggtgatccacccgcctaggcctctcaaactgttgggattacaggcgtgagccgctgcgtctggccagttttttatgtatataggcaaaatgcagtcttacacattttacatgtttaacctgtctaatcctcacagaaatcctatgaaatgctgttttcccaatttgcaaagagaaaacaaagactcagggagtaaactgacattattttggctaggctcaaaaactcagtaaatggcattcctgggatttgaacggccgtctctgaatccaaagctcatgcatatcttcttacaagagtatatattgcctcctcctaaactaccagaattattatgtatattttatcaatgtcatgccaaattttggtaacactttaagtggcatatgcctggggtgttattggtaattctgccagatactgtaaagcctgtgtaatttcctttaccgtccaccttagcatcgagagtaaacatgaggttacgatcctgggaggacttaatgaatttgtagtgaagttttatggaccacaaggaagtaagtacatgtgttggtatgtgttcttctattacagtcttttactctgtttcttaatagaatatcaaagacagatggtagcatgcgtagtttctgaaaagcaagtttagttggactgcagaaccagtgaggaaatctttctcttatcacaatcactttatatacagtcatcccttgatatctgtaggggattggttccaggaccacctcataccaaaatccacagatgctcaagtccctttataagatgacatagaatttgcatgtaacctacacacatcctcccatgtcctttaaatcacatctagattacttgtaatagctaacacaacgcaaatgttatgtaaatagttgttatactgtattttatttatttatttatttattaagtgatggagtctcactctgtcacccaggctggagtgcagtggcacgattgtggcttaccgtaacctccacttcctgggttcaagcaattcttctgcctcagccttcgaagtagctgggactataggtgcctgccaccacgcccagctcatttctgtattttagtagagacagggtttcaccatgttggccaggctggtctcgcactcctgacctcaggtgatccacccgcctcagcctcccaaagtgctgggattacaggcatgagccccaccgcacttgtcctttttggtattttttttgtgttatttttaattgtattgttatttattattgtttggatttttttctctaatatttttgatctgtggttggttgaatccaggggtgtggaacctgcagatatagagggctgactgtagttttctctttatctctatgtgacagtactagacatgaattgtaaattctgggttttgttatggatggccacgtgaatggtttccaggaaatgttttttgttgttttctttttggccttggaggggggatgaatatggggtttattgagataggagggaaagtaacatggctattacttaccaaataattgaatagtgtttagtacttttgaagaatcaagtaaattgcagaatgaatctgcttattttttaactctggatctttccaagaaaagtatcttaatctgaacgtggtacacctattgattgtagtaggtccctgactcttgaaggaattaatttggaaggttttcagaagattaggggataatgtttaatttacactcagatttattttctaatttggagatgtagttctgatgaacatttttacttttatttcagcaccatatgaaggcggagtatggaaagttagagtggacctacctgataaataccctttcaaatctccatctataggtatgttactacttggtttttctccttagagagttttgaaatctaagggggaaaaatcttacatttcaggggaggtaattaatgccagaaatggctgtctaattgaatttttccttttttggctttggttaattaatcagtgacttttggggggaacttctatagtgtgttagaagacgtttaaatatactctttgcataattataatgaccattactttagatttttgtcttttggtgtcagattaaaccagctttaaggccccactgttctttaagctgttagcaggaaaataataaacatatcttaagtctaattttgaatgccagattgcaagaatgaatgttacatagtatgtgttttaatcctatcattttcagaaattctccctagatcctactttgcttttttgttcactccaactctgggtaccttacaattaaatgaccctttgcagtcttcccacctccagtctctttagccccctaaacagcag

SEQ ID NO: 127462 - DNA, 1039 bp, Homo sapiens
ctaatgtttaaaaattttgtttttgtggagactgggttttgttatgttgcccaggctggtctcggactcctggcctcaagcaatctttctgcccttgcttcccaaagtgttgggattaaataggtatgaaccactacacccggcctcatgttcatttgtagtctactgtttgctgggtactcttctgtgaacaaaataaacaattcctgctcttacggagcttgcactgcagtaggagataaaagtaaaatacatagtatattgcatggtgggaatgttaggagtaagtggttgtaaataggatatcccagaaggcctcactgagagggagacattggagcacatatactttgtttacacttagaaatttagagcttgaattagaaattagaagattgatttggagatctgcttttttgttttgtcatgaaaattagacattgtagcaacgttggagctttctactggctctgccaggtctgttcagctgtgaaggcctgtgagggctctgtttaatgtcccatgattcatgtggctgttatcttagttgaggtcttgaatatttctttcctactcttttgctttaactctgcttattcccaccttcagccagtcctacacaccacagttgggttatctttgtaaagcacaggtagatgcactgtgcatggaatactgtttccctgtttgccagataaaatccacacttcggagccctccgtaatctggtcttggcctactttctagtattccctagggtccactcatcaaaataaaaatgtattgttctcagtttcctgaatcagttctatactaaatctttgcattaaattccttctcccacctcgacatgtccaaatcacactctgtttaggacattttgtaagtccttaccttccatagcagaccatccctatccctccctccgggctggaagaaatctctcctactctaagctatagtattactttatgcaaactctttctgtacttcttaatgaacagatctcgtgttcccttgctagacttcaaacttctgg

SEQ ID NO: 127463 - DNA, 1764 bp, Homo sapiens
acagtttgtacctacatgtctttgtgtatgtgatgacgtggatgtgtgtgtatataaacatctctatggaaagtgcataagcaatggtagtatctaggcagtgggactagaagttgcggggtggaaaggctattttaagccccagtcatgtttttaaaagacaagaaaaaaaaaaaaaggcctgcaactcaacacttgatctgatgaggttatttggttgtattgagggtgctcttgtgtctttcaggagggattctcctctgcactgtgccctctgattgcaccagcacatctcacatggtggcacctgagcctatcagttctacttgtctccgtggtgcaaacacgagagaaggaaactcaatagttttttcaccttttcaatgtcaagttttcttactatatatacatccactgttgtgtctaggtttgttttctgttgttttgctaaatagcttgatttttttcatattattcagttcttcaggaagtactactccttgtgagaaacttgatttttaatttccttctcatacttcataacaatacagccttcattcttattgttgatgcatatttaaatctaaacttctacttaagtgattaggttggtttcttttatactgtttatcacttcatatgtcctaattgtacctgacagatcatttcttaactgtatgttaatcatttctgttggtcttgagctagcagttttgctaatatggcagggtggctttttctctgagatctatcacctgttagtagtatgatgctgaaaatagctctaccactcttgttgtatcacattgcacacctagatacagtctactttcacctcccttgactttccagggttttcttgcttatttactcatattggtgtgattttcttatggtagggtgtttctttaacagcaatttttttccataaaataattcatttcttttgcttattttcactatgggtttttttaaaaagcagcattccagtttttgttgaaagttttttatcccacttctttcatcctaaatgttgataaagataataaatacaggcagcttataatagctatttgaacgtattatcaaataaggtattttcctgttaactacacttctgtatagtttttaagcagaatttcaatcaagaagacactatttttctatatctctttagattactttttgatttttttaaacactgtttatacaagtttttatcaaacttccaacagataatgggtactgcctctcataaatcttccaaagggacaatggaaactgggcccagttgaataaagccatattcatttgttttggaacgcagagttctctgcatgtagattgcatttagcattctgtctagtgtatccatctgtagttttgcttttttcagaataaaaccttgacagtaattttgaacctgttactttatttctttttgcatgtattgctttaaaaaggccgaagtctagtattctcttcccctttttaagttttatgaaatcaaggttaaattgatattagtgccacttaatatttgacacctgctatgcctaatgaacttgaagtagtaaagggagcagcaggggtcagccattcatattatgcaagataactggagaacgagcagactatgattagagctttagactagtgggttctaacctctttataagagcaaattcattatttatatgtgcatatgtgttaccttttcctttttcctctggatttataggtatttgagtttcaagaattttc

SEQ ID NO: 127464 - DNA, 1609 bp, Homo sapiens
ttcattcttcttctgagcttgcaggggtgacccttttatgagataccttaatcctttgcatgtctgaatacattgattctggctgtacttgaatcttgctatgtggaaaaccagattttctctttcaaatggcttgtactcccctcagtcattgtgtgttgatctcgagttgaactctgaggggccatcttacttcatgtccttggaaaaaacttcactgtagctgccatataagagcaaaatgctaatctcccattgcatttagccagcatcaccacctcttgaaaacacctttggcttccccacctcctggattaggacaggagcaccttcagtgtgcctcttcagcactgctgagtaaccctcatatcactcttaactgcctctttggtagtttattgattgttcatttccccactaaacttggagctttcagagggcagatgctctcttatttccagatcctactgtctagcgtagtgcctggcacctactcacactattcatttaaccagtttctgttgagcatccactgacacgtagccgaggctagtcactcagctacatgtcaggaataaaggcaaataaggttcttgccctcttggaagtcgaatttcgttcgaggtgagggaggatataaaaagacaaaatagtactcatgataaaacctacaaggaaatagacaatagaatgaggtagagaataattgggatggtctgttgggcatgtacttcaggtgatcggaaaggtctctaaggaagtgccatttagacacaccataaaggcctggtgcagtggctcacactgttaatcccagcactttggaaggccaaggcaagaggatcgcttaaggccaggagtttgagaccagcctcgccaacacagcgagatccccatctctatttaaaaaaaaaaaagacacaccttaaaggataagaatcagcaagctatctgtcaaaacagggaaatcagggctgggcagaagaaatagccattgcaaaggccctggggaggaagagagcttattgtgtttgaggaaatgaaagaagaccagtgtatctagaaaggtaagagaggaagaatgtggcagactgagaccgtgtcaggcatattgtgggcttggatgagtgaaattagacagctgtcgatacagtgagtgattcacatactttagatttgtttggaactagcactgttataaattgggattctaaatgttaattttgcacattcttttctggaatgttaatactcaaaaaataacgattgaaagataacctagaacttattattttttaagagacagggtgtcactctattgccgaggctggagtacagatgccagcatagctacctgtagccttgaactcctgggctcaagggatcctcccatttcagccttctcagtagcttggataacaggtgtgtaacactgtgctcagctagttttgttttgttttttaaataatagagatggcgtcttgctttgttgcgtaggctagtctcaaactcctgggctcaagcagtcctcctgccttggcttcccaaagtgctgggattacagacgtgagccaccacatgcagccatagttttaaaatttttgtagat

SEQ ID NO: 127465 - DNA, 1021 bp, Homo sapiens
attttttaatacagacagggtctcattatgttgtctaggcaggtcttgaactcctagggtcaagtgatcctcccacctcagcctcccaaagtgctaagattacaggcgtgagccaccactcccggcccatttttctctttttgaagggttcttatttctactcttccagggcaattagaagcaaaaggaaaagacccttggactggagtctggtagaaagaatgctcagtgagcaaacctggggctctgaaccgtccccttgtatgtttttcatggccttgcagctcactccttggagctgtggttctttgaggtgtaggtcagaaattcacggggtgcttcatcaaagtgtgcatgtctgatgaatacctaccccctgcctgcccctctctaggtatcagtggggcggggaatgtcactctcctggtgattcttgtacatgtttcttcttcccatttccggccatttttcccacctgacattttctccctgctccttatattacatagttctttatgatctttctcctgtgttttgtattccttctctgagagagaggggctccagttgcaatgaggttcaaatgatggttttagtgtctcaattaaaactctgaatgcacttactttttttagtaaaagcattggtatagatgatggctaatattccagagttaaatagtgtacttcagataaaagtgagttaaattggcttttgtgtgtaggaagttacattctgagttctacgcaatggacttaagaacttttgaaacaaaacttaaggctgttagttaaggactcatggagtcagatctgcagtagagaacatcattctatacctcctgccttattcccctcttgtgaccccccatttcttccctttactggtaagaaacccaggagcaggcagtctttgttggggataatcatagattggcccttggaaagtggattggaaaatttgaaggtggtgctcatttgtgtttaaacaattatttgctatcatatttagcagtatgctt

SEQ ID NO: 127466 - DNA, 1049 bp, Homo sapiens
agcctcccaagtagctgggactacaggtgcccgccaccacacccggctaattttttgtatttttagtggacggggttccactgtgttagccaggatggtctcgatctcctgacctcgtgatctgcccgtctcaacctctcaaagtgctgggattacaggtgtgagacaccgcgcccggctgtatttagtatttaaataaagtgtgaagaagcaggtgaagaaaccttcctaccatttaacaagagggagccaagcccgtggtttttgttgcaggaaatgtgcttctgccactcctttaaagctgtgaaagttaatttcacagcctcggggaaagacattgtttcccctaaagatcaggtcttgaagttggaagttgtcatttggtctataacttacactaatgaaaagcctcttagagtgcttactgtgtgccagacacattaatcatagtagtaacagctgacatttgagcgcatcctgggccggacattgtgttttttagcactttaaatatcttcctcagtcctcagaataactcaagaggtaggtactgttttctttttttctgttttaaagatgaaaccttaggcccctatctcatgccaagtaagttgcagagctgagagataagctcagtctgtataactcgggagctttgactctgaacaactaaattctctattatggtactgataattccctggactgtctggcagagagtgtggttctttatttcatcaagggagtgggctcagagaagataagtaatttactgtcataagccttgtgttgaaaccagaactcaaacctgggtcggtttgaagtgaaagcttatgttcttgccactgagtgtatcatatgacctcttagagtacattactgtaatatctgatttacaaaggtctttttatttcttgtgtcggcttccctctgtttctggaggggagttgtttaaaaggttgatttttggtcgggcatggtggctcacgcctgtaatcccagcacttcgggaggccaaggtgtgtgggtcacttgaggtcaggagtttg

SEQ ID NO: 127467 - DNA, 1790 bp, Homo sapiens
atgttggtatgttcattgagatgcaggggcaacactgagcattgtgtagatcctatttttaatttaggagaatcctatgcaggtaggttaacttttttaaaccttacagttcaaagttgttgtttttttacccctccttttcacctcccagttcaaagttttaattgtgtttcctagctccttgatatttaacaattacatacttccctgctctctctaaaataaaggctttttattagttcaggatttagtccagggagaccttttactgcgtgaaccatgcttgagatgaaaagaactagacagaagcatgtattgcccagtgtccctgcctgtgccctttcttctcagaaaaccctggctagttgattgtctcagcctcatggtcttttgttaccaccaacctccctgcaccccagactccagcaggcacacacacatctgcacacacacagtttagctgatggagaaggagtagggatgtgagggtgtgtcctcagggtaggggctgggactatttcattttctttctgtcttcagcaaatgtaatgcatgttaacaccttggcagtaaaagtgggctggatcagttggatacaaggtgactgttctaaaataaaatgaaaaacagcataatctcgaatttgtaggcaacatgtgagacccagcaaatggaactttttgtttgtttgtttgagacggagtctcgctttgttgccaggccggagtgcagtggcacgatctcggctcactgcaacttccacctcccaggttcaagcaattctcctgccagtagctgggactacaggcacctgccaccatgcccagctgtgtttttttttttttttttggagacggaatcttgctgtgtcgcccaggctgaagtgcagtggtgtgatctcggctcactgcaagctccgcctcccaggttcacgccattctcctgcctcagcctccagagtagctgggactacaggcgcccgccaccactcctggctaattttttgtatttttggtagagatggggtttcaccgtgttagccaggatggtcttgatctcttaacctcttgatcccccttcttggcctcccaaagtgctggaattacaggtgtgagccaccgctcccagccgcaaatggaacttttgcaggtggtttggccattagccgtgtacatgcttagagtgtgtttaggctagtggacaggatgttctctgtgtgtactgtgtaaccttgaggctttgcgtctatttctatttccctagaaatgaaatctaaaacaggctgctttccttccccctagctttccaaacaaaagtaaggcttgtagatgtgaactagactgttgcaaagttctggagaggatggctgtggtttgggatttgatttttggtaggcttttttttttttttttaattgttagaacttgagtgtgataaatggcttctttttttttttttaagtgggaagaaaatacaagatcattaaccacttgtgcatattctatttcaaatggcttagaaatttaaagcaaacttgttaaagtttgtagaagctgagttgttgatttctgtggtggataaaagccagtgctgtatctggaaactgttttcctgtttttcttagataccccttgaatcggatctgtttaatggaagaggatttttctgttaagctggttataatgccggttaaactttgtgtttaggatgttaaagtcctggaatgaatataattacctgcctatataaaaaaagctgaagtcatttgacgaaaagttaacaagtgcagg

SEQ ID NO: 127468 - DNA, 1059 bp, Homo sapiens
tacttgagatatgaataaatatcccttcatttaaaaataagctgatcaggacaatatttgacaaataatagtctaatgtatgtaacctgaagcagaattgctgctttgacagtgctcattttcagcttggcgagagatgaaaaatatcactcttcaaagtaattttaccaaactcacattcccatcagcaacatatgagagttcctgtttattcatatccacaccatcatttatccagctttctaacattttgcctatctgatggatgtgaaatggtatcccagtgttttctcagtttattttctagtcaaatatttttggtgccttctttctgtcagaccctgtgcaaagcagtaaagatggtaacaagagaggtgagacatggctttcctattctagggagcttgcattctaggagagagatgaactttgtctcccagtgagtggcaaagggacacacaacggggtgcaatgtgcagcctgcctagggaaatggggctgttccaagagatgaagtttgaccttggtcttgaaagatgagtgggcattttcagagagctgtggagttgaggggcattccgggtggaggggaggcaaaggcatagagctgtaaaaccacattattcaagaaacttaatgagtgttcatgactgtagagtcccaggattggtgaggccaaggaataagcagaggagagcctgcagatatggaggcaggtggagttgtatgctgccggcaccagactcattgaaggttttaagtagggtgttaacaggagttttattttgtttttacaagtctaggaatggattctggtattaaacgtgatggtcaatcaagtttttgtcttaatttcagtttcaaacgcattagcttagctgtttactatagtctttttgaaacaggtagataatagaaattattatatttcctttgaactagagttggtcattttctattctttcctagcatatgacacatttcctttcatccatgtgccttgttttttggtgctttttttttttttttttttttactttgtttttgtttttgagacaa

SEQ ID NO: 127469 - DNA, 1028 bp, Homo sapiens
cccacatttttaaatttctaataggtttcttaaaaaagttactgaattctattattaacattttagtgtctctgttttattctgtataaaaataataggaccattacatggagttatgaagatagtgtatgaataaaaagcctaggcatccttagaagtacgttttaaaaaggagaatagggccttggaaaagcacagagttgagtctatcagagaaggcttcctggtggaagcagaatgtcatagagacaggagatagatgagcaagagggcactcatgaggtatgaggcggttggtaggttatcttgattaaagaatcaggttgtaaataagttactgttaagtacatatgtactagtatgtactagagcgtggcgtttgtgaccaagattatgtgggctgctgtatggagaaggggctgagctttttatgatctgacactctgcaaccagtagggccatacctgatacttttctggaggtgtgatcacttatcagtcagccagaggaggactcttggtaaagaatttactcacaggttgaaatccaatcatggttggcagggttttaatgaattagaagacagtgaatggatttgtggcacattatatgagaatgattgagataattttttgaaatgcctctgctttttcaggtggctcatgactgtaatttcagcgactcaggaggctgaggtgggagaatcactcgaggccaggagtttcttttttctttttttttttttgagacggagtttagctcttgttgcccaggcggagtgcaatggtgtgatctcagctcactgcagcctctgcctcctgggttcaagcgattctcctgcctcagcctcctgagtagctgggattacaggcatgtgccaccacactgggctaattttgtatttttagtagagaaggggtttctccatgttggtcaggctggtctcgaactcctgacctcaggtgatccacccacctcagcctcccaaagtgctgggattacaggcatgagccactgtgccgggccga

SEQ ID NO: 127470 - DNA, 1065 bp, Homo sapiens
tttttcctagtagagacggggtttcaccatgttggccaggctctaggctggtctcgaactcctgacctcaggtgatccacctgccttggcctcccaaagtgctaggattacaggcacaagccactgcacgtggcctgaactggattatcttaatggacatatgtatctttttatttgcttaatgagaattagaaattctattttttttttttttttgagatggagtctggctgtgtcacccaggctggagtgcagtggcgcaatctcagctcactgcaagctccgcctcctgggttcatgccattctcctgcctcagcctcccgagtagctgggactacaggcgcccgccactacgcccggctaattttttgtatttttagtagagacggagtttcaccatgttagccaggatggtctcgatctcctgacctcgtgatctgcccgcctcggcctcccaaagtactgggattacaggcgtgagccaccgtgcccggcttagaaattctattttttgtagaatcagaaatcagtttgtgacttgtgtgcttttaaattgggcatattactcacttgaatgaattggataaaacatgatggttttagtctgccagttctggcagttttatttcttaaatgtcattcttaaagtgttttgtcagttctgatgaagttctgatggcatcttattatttaaagttaaattttaataggtattagagtcatagattttagcatgtttttatacttcgagaaaacctggactgcaaatactagtattacaaagcaatggtggctttccgaatataagggctcttagtgtggaaattaataatcatattctctctaggcaataatagcatttgttgccttaaatagtagcttaagaagtaataatgcttgactgtacacttcattaatgcttgactgtaccgcttcagattaggagagtaaactctggtaactttgttattattgatagaaaaaaacagatgaaagttgagaggatactacttttcaactgtgattaacatcagttttactagtagtcatgtttgttgtgtgaa

SEQ ID NO: 127471 - DNA, 1040 bp, Homo sapiens
ctttgtaggtatctaggacgttatgtaggcagtgtgaatagttgctgctgatcttctgacctgtccctgcagagaagtcagagagaggagtaggtagcccttgtgaagggagaggcttggctggactttgccattctctggaagactttgccattctctagaagataggcatggttggcgggtctgtcagtggactcaaaaaaggcacctgttctgtagcacttggaggatccatatttaggatatcaattaattgagaatgtaatctttgtctttggttcaatctcctggtttctaacttttaaaccatttttagggaagcattatatgtgaaggtaggagatactccctacatacaaaatcatgttattaatgttgtgaattatgcatttcctttttagtattaggcaactttttttcatatatcaagttatcatgtacacttttcaaggttttttggattataaaatcttagttgaggtaatataaatagaaaactagatacagagtgcgtgtctggtttgtgttacctcagaagcaattgggctgtcacttagcctagcaaaaagtaaatttagttgttttgtccaaagggtgccagtataactttggtaatctggattttgcttttctttctttctttctttctttttttttttgagatggagtctcatgttgtcgcccagtctggagtgcagtggctccatctcggctcactgcaatctccgcctctcaggttcaagcgattctcctgcctcaggctcccgagtagctgggattacaggcacgcgccaccatgcccggctaattttttgtatctttagtagagatggggtttcaccatgttggccaggctggtctcaaactcctgacctcgtgatccacctgctttggcctcccaaagtgctgggattacaggcatgagccaccgtgcccagcctggattttgcttttcaatttgatgactatgttgcatagacagttgctgataagttgattaatttaaaaattcagaatttggttggacatttccattgtag

SEQ ID NO: 127472 - DNA, 1001 bp, Homo sapiens
gcctggaattttttgaagcttttttttttttttttttttttttgagaccgagtctcacactgtcacctaggctggagtgcagtggtgtgatcacagctcactgcagcctcgaacttccggattctgaactcaatcctcctgcttcagcctcccgagtagctgggactacaggcgtgtgccaccacacctggcttacttttgtatttttcgtagaaacagggttgcgccatgttggccaaactggtctccaactcctgggctcaagcggtctggctgccttggcctcccaaagtgttgggattacaggggtagccactgtgcctggccttaagttaatttttagtgaaatggtgcttaaaatttttttttggcatcttaagagttatttgataggttattggacactgccataataaaattagacattgatttgtaatagttgttgttacattctttctgataaattataaacaatttatcttatggacatttacatgtgtgttgctaaaaaaaaattaaagctggattcagtggctcatgcttgtaatctcaccactttgggaggagtgcttgagctcaggagattgagggtgcagcaagccatcattatgccactgcactccagcctggacaacagagtgagaccctgtctcaaaaaaaattaatattactgacagctggaacttttagtttggctaacaaaaaggtgacctggcttgtacctgttttagtttggagcaatgatagtatgtttggtgagtagactgttttggtattcagacacaggaatggtgccctgagcatataaattccagtgtcttggccagacgcagtggctcatgcctgtaatcctagcactttgggaggctgaggtgggcagattgcttgaactcgggagttcgagaccaaccagcctgggcaacatagtgaaaccctgtctctactaaaatacaaaaaattagccgggcattgcttgaactcaggagttcgagaccaaccag

SEQ ID NO: 127473 - DNA, 1031 bp, Homo sapiens
ttggtattttgctgttaatcagtagttactctatccctaagttagtagtctttgttactctttaatttgtgttcaaagggtagacagttccctaaatcttttaactagttctagtgtcaattgggaacctgtggtttgcctctttatttccagtggactctgttttagtgagatgatgagatgaaagttggcacagctttatggtcttcaagctaaaagttaaagatttggcaactctcagtgttctgaatttgtcttccctgcctagattttggtgacaaatataacatactggtacttattttggttaggcaggaacctacatgagtaagcattcacagcttcagaacatctgattcctgcagtgcagttctagtaaattacacgcaagcctaaaaattcagctttttgggaaaaaatgtttcgcagatgtgacccataaacgtccctcctgtatttgtgtatgtatgttagaacaacctaagtttgttggttttctagtgttgcaattttcttagccccttgacctgcattttatagatatatttaaacattggtattcttttcagtcttaacagatttgatggttccaagaatcattggatttttaggcatgtaatccagaccttacattacgttataatgtttgcaacgtaatagctttttacctgtagacctacagagtgtacctgttagtaaaatacttaaaagaacttagttggatttcaaaagtaaaaagataattgagaaaaacataggttacaagaaggaaaaccagtcacctgtaatcctagttctttaaacagtagttctcaaactttagtttgagattgcaccactgcactccagcccgggggacagagcaagattccatctcaaaaaacaaaaaacaaataatcacctggagagtttgttaaaacaggttactgcataccactcctggagttttctaattcattgggtctagggtggggtctaagaagttcgcagatgatgcttctggtccaggaccactgtttaagaactgttgg

SEQ ID NO: 127474 - DNA, 4002 bp, Homo sapiens
cagtcagtccctcctgttaagctttctggtccccgggagaaccctactgttttcctttccactgacaaagcctgtcccacccatagttgtatgtgatgaagacccccgggccctccagcaagccaccctccatattgtgggtatgacagctggggaaagaggagctcctggacaaaataaatagtccctggactggccacttgggcaaaacttcctctgtgagggtcaggttcttgggggaatacttgccctgatgtcgccaagtgacaccctttattttctgccccctccccccaactttatgcactctggaggttgcagtgggaaagctataactgataagagcccttcaggcagtggttttggttggagtccagactgattatttcaggaccagctagagaaattcgcgaaggttcctgtgacaaatcgagaattttttttttttgaagggtagtttagagggtagggggagcccagagttctgaacagctagtccttggggaggggggcaagtgggggcttagagggtggtagtgtggaacacagtttaaaagtcctgtctcctgtttctctccctcctccccatccccccaccgtttccccctgttgcagggttttgtttatataactcaagttgtttggctaaattcttcaggtgaataccttttttcttccttttatttgttgctgtttttgattgagtgttttacctctttgtagagatcagtggttattgtcaaaaaattcagttagggaatttgctgaagttttaaaaaagtagtttttgcatatggtttggcagtgggggatgggagggaagttgtctgggcaagagatttttaaaaaataatcttttcagaaataaggtgtttttctccttgctcagggaaaacttggttagaaattaggagcagtagatagacttctaagtttgtggtttggagtttagaatttttgggggagtgggagattagagcggagcaactaataaagtatagtgtacccaatatatgttcaggcgcaagtgaaatcaactctttatgagctgtttgtggctgtgattgttttgtaaatgtgtgaatgataccagtaatgttggcttttcataaggctgcaggaaaacttgtaactatgactgtgtgtacattttacacaaagcagtttcgggttttatttttgtttagaaactaggaaatgacatagtggcagcatctgagttatttttatcttgaattgagagttactgtcacacctaatgcgaatttctacctaatgtttaattgggatggagtggggagacaattccagctgtttgtgatcgttgtcagagtctcaaattatgtacatagacatatttttaaaagattgaggataaagaggggggcctaacttgacctgatgccttttccatacagtgccttttgttcatttagtagttgtggcatctagaatgattaccgcatttaggagtcggggtgtggggggtggagagggagaggaaaacagacaaagaacagcagggtgtcttttttttctccccctaagtggcttatttcatagcttatttttagtagaagatgaagaaaggcaaagatgcattggccttctgttctttccccaccttccttcctttctgacaaaagaaagcagaggcgctttaaaattgtagatctgagataggaggataacagtttcgagatttaaaagccagaggttatctttgtttcgtgtttattttctggtataatggagtttggaagttaaaatgtttcggatttccttttgtgtgtgttgtgtaggtgagagattttgtgtcctcctttctctgttgaattcacagatcagtaggcccaaatggagccaacaatttttgagtaaggtatatttagcagaaaatttaaggaaaaattccccagccctctactaaaatgagtacaattgtgtgaaaaggctgggggttgagaaagatggtggagaggaagtaggaagaaaaggtctgaaggaatgcacttcttgccccccatgccccttgatgatttctttggtgtggggggcgatagctggtttccttgcagtctcctgtttcagcccatttttggatgtctcctgagcgtaattataccaccacgatttacagcctggcagggaacctatatagtaggaaagtagcagtgtgggggtagggagagaagaggatgtgtaactaattggccgctgccttccaccacctcgctcggttcttttggagacaccgtctctggttgttgtttggagtcagtgatatttcttttgtgacgggttggtaggagagctgactcccaagttatgcagggagtgagtgttttgcaccaatgcacttaataatctgctgggtgattatgttctgaaactctgactcattcattgtttctcttctgatcctttgctaagggttgtgcaaacctccccaggagcctagaaactgatttacatgacttttggatcctttaggaatgtgtcccagtaaaaaaaccttgcagttagcccagatcctatggaatagtctcgaatagtgcggccatttgtttgcaaagtcaggtagattggtgatctgtgctgcccagagcctggcaacctttgaggtttccacctccaaccagctgattatttagattgtctgagagctggggctctggtgaccttaaagcgtgatttgccctaaaggaatatcggtttaagttctccctggtggaggaacaaacagctcagattacacgggtttccttgttggtgggggttactcgtctcaccctgttgcacagccctggtgatcctttcatctgtgaaccagtggcccctgctgaaggctagagctgcttgttttggaaaagcgtatgcaggcaaaaggccgcaggcaccgctcctcagcgctcattggccgccctgttactacccggaaaaggaggaggggaggagctaccaaacagctgatggagtatgtgacaagagagtgtgtttatatacaaaagaggtgggggctggggaggccctctgagtggtgttacaggaacaagtgtgttttcgaggggtaaaaagagaagaggaaaacctgacctgttagagtacaagaaatgtttagaaaaattaaggttaaatcagaaaagtagatcggataataatggggaccggcatacaccatatgtacaattttgtaacttacaataccaagagttttcaatgattcttcttttcagagggagttcagtaataggatcccccccttatttatttttacattttttgtagagaccgaggtctgactaggttaccaggctggcctcccaactcctggcctcaaatcttcctcctgccttggcctcccagagtgctggaattacaggtgtgagcccagtgcacctggcccagggcatgccactttaaatgcacttaactgactcatttgcagggattccaaagtatggcagaaatgtcagcttcccttaagaaagcgtcaagtgtgatagaaagggacggtgtcttacattaaaacggcctgagttaattttacagaatcgttggtgtctgctttagggtttcagaagctttctctaacaaattcaaaacctcagatgtggccaagtgtggtggctcacacctgtaatcccagcattttgggaggctgaggcgggaggatcacctaagtgtaggagtttgagggtccagtgagctaagatcatgccactgcactcatgcctgggcaacagagcaagactctcttaattaaaaaaaaaaaaaagctggcacagtggcttatgcctgtaatcccagcactttgggaggccaaggcgggcagatcacctgaggtcaggagttcgggacaagcctggccaacatggcaaaaccccgtatgtacttgtactaaaaatataaaaaattagccaggcgtgatggtgcgggcttgtagtcccagctacttgggaggctgagtcacgagaatagcttgaacccatgaggcggagg

SEQ ID NO: 127475 - DNA, 1040 bp, Homo sapiens
gcctggcctctttaatgtttaagtaaatttagtgtcaggctaagacataagcagtaatttgtcttcactatttgggtttgaagtttgcaggtttcagggaaaatctgcagctggtaaattgaacaatttagtactaacaagagttttggcagttccagggagactccatctttctcagtcagcagattcagggcaattcagaaagcttctgtgtgatactatagccctgtccctggaagtattttgttctctgtgaagagaagtatcttcatgtttgtaatttccttcctgattttcggcttgtaccatctaggtatgttataatgtgtaatttttctttttatggtggttgaaacgaagttttttacttggctcccttgtagtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtaggtgagtcagcagattttgcctggagacatgaaccatgacaacagcattacacccatatatatcagtcactaatcgtatttagaaatcacatggtgtttcccgtgagaaaaagagacaaagaaaaactgggtgggggatggtgcgaggagaatggataataagaattagtaacaaaaccagaattggaattcaggaattcttggtgttcacaactgaactttgtttcttgtactgttgcttcttaactgggaatttgtgttctcttttttttttttttttttttttttgagacggagtctcattctgttgcccaggctggagggtagtggcgtgcgcgatctcagctcactgcaagctccgcctcccgggttcacgccattctcctgtctcagcctcccgagtagctgggactataggtgcctgccacacgcccagctaattttttgtatttttggtagagacggggtttcaccgtgttagtcaggatggtcttgatctcctg

SEQ ID NO: 127476 - DNA, 1156 bp, Homo sapiens
tctaattggttcttttttttttggaaggagtgggtatgaaaggtccctccaggtagaaatatcaaaattgttttttctgctgttaagagtcgaatttctgccaggcgctgtggctcacgcctgtaatcccagcactttgggaggctgaggtgggccaatcacaaagtcaggagttacagaccagcctgaccaacatggtgaaaccccgtctgtcctaaagatacaaaaaattagccgggcccacgcctggtggtacgcgcctgtaatcccagctactggggaggccgaggcaggagaattgcttgaacctgggaggtggaggttgcagtgagccgagatcgcaccgttgcactccagcctgggcaacagagcgagactccatctcaaaaaaaaaaaaagtcgaatttctgaagagattcaaattgtataatgcatacttgaagtcttgagtcttattttctgtctactaaagttatgccaaatacttgtggagaacagtgagtgagtgaggagaatagtttgctaggattagtggagccctgtagaggtagaaattgaagtttagatatgggtaaactgtaaagagttttgaatgccagactgaaaaatttggattttatttagtaagtattataaaaccattgaaaataataagctgaggaatgacatgagtaaaatgatttttaggaagcttaaaatccagcgttggtgtgatttatgatacgatgtgtagagaagctagataacatttaagcagagggtactgtgaaaggtttaccaacagttttgccactttatattaggaaggacacgtctgccacatcccagtcagttaatggatcaccccaagcggaacaaccttcattggaatctacaagcaaagaagccttctttagcagagtggaaacattttctatatccttttttagttcatgtgaattgcactttctgcctgcttctagaattcctccaaggtattacaccacttactgtgatgctttaaacttaagaataaaaccttggtaagaaattatataggaaagtcagcatcctaatatgttatcactcagagggacagttgaggttatctaaccttttctttttacagaagaaaaaactaagagcctgagaaaagaagaaataataactaatactt

SEQ ID NO: 127477 - DNA, 1022 bp, Homo sapiens
ctggggagtgtatgggaaagagaacctagaggattagggaaaactagttggattattaatattttggaatgttcagagacaggataatggtgtctaggttttaaggggagaaagtgaagatcaaaaatatacttagtgacacaattatgctgtgtttacaatataaaaacaactgagaattggaaaaatgtacccaatacaattatttgacattttggtctacagtgccctagccttgagttcagatgcttttgaaaacaaaataaaatcaagtggatatgtatgtgtagacaattttaaagaggtatgtttgtaattgaatattcaatctagtagaaggaaggtagggaattaaataatgcagagaacgtcaaatatcccactgggcaagcttatttttactatgaaaagaactatcaggaatgatgtgttaattattcatcgtgttttttgtgaataatattgattatattagtgatatatttgtttagctgatgagttttgagaacatgatgaattggtttttatgaattgtgcttaagactgtaccttatacttctagtcaaaaattattatttgattaaattgaagatgacaaagggaatttagcacatttaatgagacaattgcttatgttcgtgatgaggttgttgatgtgtgctagaaatgtacattaccccatttatatgcattaaatcgaggcatttgtaagtagtcatataatataccagaagttgggtttgagacgttaatatcagactgggcatcctagaattgctaaatatacgatctttaacatgaaaaagaaaaaaggagcaatcttttttcttactcccaattaataataaaaacttagatttttgtgtattggcagcttagaagatgaatctcttagcaaacactgtcaccagtttgccctctactaccgcaatctttaggtctttgatcacggattaattataccatgggcttcaagtaggcattcctaggttcctagaacctgcttggtgcacttcctcact

SEQ ID NO: 127478 - DNA, 1046 bp, Homo sapiens
tgggattacaggcgtgagccaccgtgcctggccaaaatcaggttctttaatgtaaagtagtggattagactctgcatccattgcgacagcacaaacaatagtttgtgaaacctttttttaagcacttgcctttctcctgttttctgaagttcactagtgattatgtgtttgcctcataggccaagaaattaatagctttttactcctggatttttactaactcataatttctatacacccagtaacgaacagggaattgtgctttttgtagaataagtatgcagagagctcaggagcgcggggttcatggggcaatggaattcaggtagctgttgtgatttaactgtgtgagtttgattaaataccatgattagctgggaaaacagttaaacattgttgctaacatgggaactggaaaactgacaaagaaaaagaaggaaaaatgtaacagttggtaaagctgggtaaaaataatactgtagtcttaacttaaaaattttaagtaagtaatgtgtataaaatccaaatgatacaaaaaagtatatggtaaaaggcaagtttttcttcttcctttgaccccagctaattgactgccttccctagaagcaaccaatgatacatttcctgtatattttttccaggttcaggggggacgggagggactttgtggagatggtagcattcctttgtttggatgggtatttaagatgtttacaatcttgctaatacaaatagtgatacaatgaatagccctatacatatataacttttgcacatgagagagtctttctttaggataaatttgtagaagtacagtttctgggtcaaaggatttatgtttactgcttaaattttgatagattctgtcaaatttcaagtttatgtttccctgttgttgttcgagtgctgtcttccttgttcttttggtaacggagtgggttatcaaacgttatttaaattgtcagtttaataggaatagttttcttaagtgtctttccaataggtagataaaagagccatttatttgtttcctttatctatagatc

SEQ ID NO: 127479 - DNA, 1051 bp, Homo sapiens
acccctcgttttgcagtctgtctccctagcagtgccatctccctagagtttctggtctgtctttccagaaatagaatttgcatatatgtgcatataggtgtatgttatctttatattaaaacagagtgcaacaacaaagtattctttctgcatctgtcttttttttaacttaaaaatatattttggggattgttctgtgttagcacatttagacttatctcatgcttcttcatggctgaaagtattgtgttgtgtgaatgtgctgtaatttaccagccacccaattgatggatatttagcttgtttctggtttctgttatttaagaacaatcactgcaatgtataatgataaatattgctaatttgccttttaatatctgtgtttttaaagttttcctcaagttgtagaacttaaaaactcacacttatccccttattttactctgctttcccattcagctagtcttttacatccttatgttttatccctataataatattagccagggatttatataaacatttacttataacccagtaagggaacagatactattgctgtccccttttttatagttaaggaagctggggtacccaggacaaaaccttgtccaaggacatacagctagcaagggacagagctaggatttagacccaggcaatgtggttctaaagtccctgcaccatgctgcactcccctctgcttcctgtccttcccagttctttttgttactagtactgtaattgaggtcctcactggtgtaaactggactacactaaaaatgttttttttgctattcctagtcttactttcctgacccattctctatatttaaacaagattaattttcctaatgcacagctatggttatgttgcttgtcagatcagaatccttcagtagcttcctgctgcatttagaatccagcccaatctcatgctcttcccttttatatttgctatattccatgaatttgttccaagctttatctaggatgtgagcattaaagcgtcataaggcataataagactagatagtgaagtgaaattaga

SEQ ID NO: 127480 - DNA, 2633 bp, Homo sapiens
tattcttaaatcttttacacaatacctcaatttatattttttcatcaatatctatattagtcattttctatatccttcatctgaataagacagatactttaatgttcttctggttttccttctctcagcctcccttcctacccttataaatattcctgttgatagcatctgagattatagttctgaatgttagtaatgtttttttccccagtcagtgcatatttagacttaaaggttttactggtttctctgcttacccttttcttgggccttgtttgttattcttgcattaattttttaaaaaaacaatccaattatatatctttgagtaattatttcattagaagtctgaaggaagcaaactttttgggcccttgcatataaaaaaatttctttatttcactctccttcttaagcaagagttggagtaggtatagaattctaaatgtaaaactatatccaagtgtcccaggacaatttgttgaaaagactatttattccccactgaatagtcttgtcacccttgtcaaaaaaatcagttgacactgtggatgttagggtttacttttggactctcaatttcattaatttaatctgtatgtccatccatatgccagtaccacactttttgaatactgtatctttccagaaagttttgaaatgaggaagtatgagtcttctttcacttctttttcaagattgttttgatattctgggtttcttgcttttttccatctgaagtataggattagcttgttcattttggcaaaacaaacaaaaagctagttgaaattttaatattgttcgattctcttttgtgtcttaactttttaatatacttttctataatacttcttcatgcttgggccttagttttatgctcaatcatctttatcgtgagtcctagttagccttgctgtgagtgttaaatctgtttattgcagcaggtctccacagattgtggatagggatggagtaagcaatgagatgaagtgtactacttgccaggctccttcagtgtgactgtcccctcttctgcctgggtgttagtatccccacggggttctaccttctccctctgatcccagtgttcacactgattgttctagctggagagtgacacctttgttgtttttgccactgttcccatctgggagcaaatacctctattctataatgcttgactcaaagaggtagatggctgggaggggttaacctgctatgtaacttctgtgctacactccaatcacttaggctgtaaatgtttaaaatggtttcacttcttcctgctgtcttttaccttggggcttagttgaccccgagagttggtccctccacttgccctggtcctctgctcttggtgtgtaggactgtggtgtcttctttagtccgattctatctgcttttcatcttccagtgattcctcatagtattagtccactaagggcatttcttgttttcttttaattatgtctttttttttttaatgacttttttttgttatttgggagattttaggggaaggtgagcttgctcacactgtgctcagcctaccatcttaattcagccaatgactatgttatatttatagtgaagtaaacatagtaagaaagagaaaaaactaaaaactagcaaaaaataaaatattgatgaagttattgaagaaattattattattattatttttgtggagacagagtcttactctgtcgcccaggctggagtgcagtggcgtgatcttggcttactgcaacctctgcctcctgggctcaagcagttctcctgccctcaagcagttctcctgcctcagcctcccgagtagccaggactacaggtgcatgacaccatgcccagctaattttttttgtattttagtagagatggggtttcaccatgttggccaggctggtctcaaactcctggcctcaggtgatctgcccatctcagcctcccaaagtgctgggagtacaggcatgagccaccacacccggcctatatttttgttttgaagagtcgaagctatcacgtaggaaggttggcactttgaatatataaaaattaaaactcaatgaataaaagttcagaccagtaatatatttatatgaaactggagaggcatacatttatttaaaaatttaagaagtacatttgtgttggcgtcacactgttatgttgctggtttctcttttttctgctctttgggtgaaagaataaaatgggttttgaagtcagtgcctgccttgattgaataacctccgcagagtcaacaggagtctgtgcatacagacttatgctggttgctgagagagagacatgccaaagatgtttgatagaagccctgagaagacataaaaagggttttttattacagttttggtgtgttaattatttttgtttgtttttgtttttgagacagagtctcactctgtcgcccagagtggaattcagtggcacgatctcggctcactgcaacctccgcctcttgggttccagcaattctcctgtctcagcctcctgagtagctgggtttacaggcacctgccaccacgcctgactaatttttatatatttttagtagagatggggttttggcatgttggccaggctggtctcaaactcctggcctcaagtga

SEQ ID NO: 127481 - DNA, 1120 bp, Homo sapiens
caatggttctctaagattgttgaatgtcataaacctgtacattaaaaatatatatatacttatatttatccatatatgtatatttatagtagatatgggcttgcaaattttcagtttttccacgaaaaaatattaaaaagaaaaccaactaccattttcttatcagcatcatttcataaagtaaagaatatttaacaacaaaaaggttctaatctctgaaaaaggagcaggcctttaaatggaacattttagctttttgaaaaacttattgccttgtccatatttttctcattttatgttggactggtgaatcttcaccttagcctagcagtggtctgtagaccagcatttgagaatcattgatttaaaagacttagactattaaaagataaatcattttgcaaaataaataattctccttttccatgagtctgtattctctacaaaattaagtgcaaatgtgcaggtgatgccatttcattatacagaatctgtatatctctatgtacaagttctgtagtaagcaaactagaccctgctaatggacatctgaatatatatttccagttgccaaaaataaaaactgttctttttctagggaatttaagacaggataaaatatggtgtagtgggaagaggcaagtttttagagtcagaaggcctcacttgaatcctggctctggcattaagtcatttaattttcctttagcttccttgcttgaaaaattatgatgatactatcttcttcaaagtattttgttagctcctgttacagcaattccttcacagtaacgtaattatttgtttacacatctgccttccttatgagaccatgggctctgaagagcaggaatcatgtccttgttttgcaatctcaggtcctagcatagggctccaggcatagcagatgcttaataaaatgattgttgaatcaatacaggattgttgtgagaattatatgaggtaatatatgtgaaagctctttgtaaaccctaaacattatgcaagtgttaattgtttttattgtcaataagagctatatttgggagcgatcaaaactttgggaaaagagataattaccccataatagttccattaatttaattaggtttttattcta

SEQ ID NO: 127482 - DNA, 1048 bp, Homo sapiens
aggtaatttgcttcctgggaaggcagatgagccccttccctcccttcccccatggaagtgccaagatattaaatgtttgtttaatttggttgctgttttaaaatttaattatagtagagtcagcttatttcgtatttaaagaatggtgcccattgctttatcttcttaaccatataattaatataaccttgaagagaacaggagcctctgttatgtccaattagtttcagagctccattttgaaattaactgacttaaaaatgtcatcgtttctaatctgttcataaagctcctggtgaatttttgccacaagatggcattggtgattattgagtgcacatgctattgaaccagaattcccaaaaacggtgcacaaaattgtattcttttgggggtaagagttgaaaaccttcatcactgcttatatgttaatttaattttgacttccaaaacagggttaaatgctactttacgtcactttctttctgtattcaagtattgttttgtttcctgtttttctgtctttataactacagtaactatgtattatttgcaatgtgttgtatgtgtctgacttattgctgataattgtggtaacaggtaagaagaaaatacgatgggacccagttaggaggcgcttcattcagtcctgtcccatcataaggatccctaacaggtttttgagaggtgggtgataattagcaagagatctgtgcttcgtatgggttaaagggaactttgaatgaattttctaagctcaaaactctggtttttaaaaatcatctaaacagctaatgaaacagttggaataagaaaaatctagaacttaattttaaacctgtttcttgttggccactattgggattgtaattgtaagtttcagggagtcagaatcacttagtgtattattagatggtagagataaatcatctcactgatataaatggtattccacagtagccatattagaaagaattttgagtgaataatctataaaatatggatgtgggaaagaattttctaaatatgattctaaggaagaaataaa

SEQ ID NO: 127483 - DNA, 1087 bp, Homo sapiens
gggccgggcatggtggcctacacctgcaatccagcagagtgaaaccctgtctgtctacatacacacacatgcacgcatgtacaattagccgggtgtggtgggggcatgcctgtagtcccagctacttgggaggctgaggcaggaggattgcttgcaactaagagttcgaggctacagtgagctataatcatgccactgcattccagcctgggtgaaagagcgaggccctgtctcattaaaaaaaaaaaaagtagagaattgatttgacatataaggaagtggaagtgaaattagatgtagattttaggcaaaggataataaattcagtttagtctctccagaacaaccaataatagcattaatagcatatcctttaacactcagtccaagagtatttccagggaaacttccttggcaggcctctcccctctttgttctgatggcaccctccgtgtacctacctatatcatagcacttattgcactgaattgtagttgtttacttgtctgtgcctcccattagactgtaagctctgtaagggcagggacaataggacagtgcctttcatatctttactccagtttgtagcatagtgcatgtagcaggtatatcatatgtatttgaccttgaattaaagtattgtaaaggccactgtcagaaaataggatgggagtaacattttattatgttctcaacttctctctggtattggtgacagtgaactaatgaattgttgagaacatgaaaatgctattgtttaatgcttcaataggttgtgtggttttgcttgtttgtttgtttttaacttatctatacttttgaaatagccactttgaagcctgatattttggaattctttatatcacctctcttggttcagattgtagacagtttcatagggcccattttctgtcactagattcctcttcactaggtcctacatcttctctaaaacatatttctaccaattaaaattgtggtgtagtgaaaacagtaatggcgtaatgaaaacaatggtttttattataaaatggcagacttaacatacccatttacttttccctacttctcagatgtcattggaaat

SEQ ID NO: 127484 - DNA, 1147 bp, Homo sapiens
gatattaagtgtttacctgtgaatacaggttctgttttaattttttgcttttacatttcccactgggagttcctgaatcaggtaaacgaattctatggtagattttattagcagcaagtaatttttaggaaaatgggatttgcagatggagaagttgggggaggatttagagagctactttagaccctgaaacacaatttcagttttgtcaaggttgaggaccctatgctatatttcacctaataaaaattaatgcttagtctccgtggcattaatccagacagacaattcccatggtttatccaaaatggaatggctttttaatatgttagtcactcttgggttataaatatgagaaagaaatctgtagttactggcgagagagaaagaggagttgcatttttactctcagctatgagattccttgacaggatgtttaatatttatcaaatattgattagatgctctttacccaaaagtgtgatttgcagagatcgtgaaattattaacagaaaccaacagttgggctggatcagcactgtgtcagaaataggtaaaccacaaaattaaaatttttccagtacccacatttaaaaaagtaaaacagacaggtaacattaattttatttaatatttttatttaacccagtatattaaaaatatcatttcaacatacaatcaatatgaaaactaataatttcacattcatttttgggtactaagtctttgaaatccagtgagtattttacatgtaaagcacagttcagtttggaccacccacatttcaagtgctcaggagccatatgttatggctcatggctactgacttgggctgtgcaggctggactgtaagctcccaaggacagaggtagtcattgccttatcactgtatccccagcacctagcacagtacatggtacttagtacatagccagcatccaatagtaactttttttttttttttgagacggagttttgctcttgtcacccaggctggagtgcagtggcacgatcttgactcactgcaacctccacctcccaggttcaagcaattctcctgcctcagccttccgagtagctgggattacacctgcctgccaccacacctggctagttttcgtatttttagtagagacggggtttcacc

SEQ ID NO: 127485 - DNA, 1060 bp, Homo sapiens
aggtgtaagggaggaactctgggatttccaagcagagagaagtatgagaaactgacagtaggacaaggttagtaggagaaaagctctaacatgttgggcaggggacttgatacttgagtggtgaggaaccatcaaagactttcaaacacgactaacaggttggacgtgagtgactcagtgattcactgttttttgttgctctcaatctgtgcacaatttcagctctggtttaaaaatataaccttagaaagtgggattttgattttaaaaagtaaatatagaaggcctgtattaggttggtaataaatgtataacatgtttattaggtgtctagcgttgtcctaaatattaactttatactagtatctattaccaacataaaaaactacgttcatctttagggtcacaactatagtagcttcttattccatccaatatgtatttaagcatctttggttctgaagttgggcaagggtttgtatagattggtataaacattttaaggataacagaaactacaataaagttttttgttttttgtttttttttactctaaaataaccttgaagtaatttttagtaaactagttgagaccgggtgcagtagctcgtacctgtaatcccaggatgttgggaggccaaggcaggctgatcacctgaggtcaggagttcaagaccagcctgaccaacatggagaaaccctgtctctactaaaaacacaaaattagccaggcatggtggcgggcacctataatcccagctacttgggaggctgaggcaggacaattgcttgaacctgggaggcagaggttgcagtgagctgagatcgcgccactgcactccagcctgggtgacagagtgagacttggtctcaaaaaaaaaaaaaaaaaaaaagttgatataatttagacttcaggacactttcaaatttaaactgtaggaatagcttttcttagtaaagctcttaataggatgaaagatgctctctgagataaatataaggagattctttgttaacctccataatatccgggatgttatttaaagtcaaaattttactg

SEQ ID NO: 127486 - DNA, 2219 bp, Homo sapiens
atgtattgaatacgtcatatatgcctagcaatgaactatgtgatagagcccatatagtggaattagatctttttctgcagaactttgtagtataggctatgtatcccttatctgaaatgcttgggaccagaagtgtttcacatttcaaaatttttttttgaatatttgcattgtacttagcataccaaatccaaaactttgaaatccaacatgttccagtgagcatttcctttaagcatcattgttggtgcgcaaaaagtctaattcggattttgaattagacttcagattttcagatttggcacgctcagctactagttagatgtcagtggtttgagctatcttatgagatcattaaagcagatatgtgtagcttctcagatattctgggtttatgtgggaacaaattgcaggtagccatttgtgaacagaacttgtgcttctccttcctcagttgtgctgcatggaaacaacctgttagtatttggaggtacgggcatcccatttggagagagcaacggcaatgacgtccatgtgtgtaatgtgaagtataagagatgggctttgctcagctgtcgggggaagaaacccagtcgtatatatggacaggtaccaatctgtggccagtcatggtgtatttgttcatatttttctagtctggggatggtgttagaatatttgtaattgttaccattttattttaatggagaagagttctttgtggttagtacttgattttttagttctgatatgaaattataatttgcaaatctggttacttgctgtgttcttttcttttctcttcctttcttttctttttttttcactttctgtttctaattcaatttaggtcaggatgtagacctgtatggaagttcctttaaatgttagaaccccacctccacctctaccctcaccccccgtgagagattgggcttcactatggtctgggtcctggtcatttttagagtgattcttgagtagatgagaaagcacttggtgaagaaacttttacatggatctgagctaaaacatacattatgtagagattagtttaggttccagcgcttcaaaccttaggtctgaaaagttatatccagaaagatagggagcaacccaccatacatcagagactctttgagagtttaagcttaaaacaaccaagctttgacttctttcttgactcgctggcattagtactgataaacagcttctgagcttaacttcaaaggagcacatactggataactttgttgcttccacaggaggcatttaaacttaagaagtggccataacaatagctgaaactttcattgaaaagggtccagtggaaaacatcaggttccttgaactgctaactagggtttctacttagcagattgtggtggcttattttcatatctgctgcttcttgagagcatttttcttcagactgcttataaagagaagcagctttcaatggaaatgcttatgcccatgggctagaaattatttgatcagccaggacccttaagaatcatcttgggaggtaggacttcctttccagttgagtaaagcttcacctttctaaaggtgttttccaggttcttaaaataatctctgggttctctaaaatctttattcttttaagagtctgatacattaaaagattaaaatacaagagaatttcataaaacctgatttggaggtatctggtaagtttacattctttaatcaagtgttaacaagtcggtcttattcacctttccttgttatccaggctatggccatcatcaatggctccctttatgtctttggaggtacaaccggctatatttacagcacagacctgcacaagttagatctcaataccagagagtggacacaactgaaaccaaacaacctatcctgtgatctaccagaagagaggtgaggttctaggattcaagcatatttattctttcgtgctaacatttgacctctttcagagtgttggcaatatgaagaaaaccctttggccccagttagaataactaactggctgttggatgttagatctcaggtaaatagtaaagaaaggtctatagtaaaaaaagttcttctggtgaggaaataatatttccttctaaactacagaatttttttccatgtcatttcctcttatactttagtctctctgcattaggaagatagtaacactttgaagaagaaaccagtggtaacaactataaccaaatttc

SEQ ID NO: 127487 - DNA, 1066 bp, Homo sapiens
gtagtcccagttactgaggaggctgaagtgggaggatcatttgagcccaggaggcggaggctgcagtgagccaagattgcactgctgcattccagcctgggcaacacagtgagaccctgtctctaaattaaataaataataaagatctacctatctccttgtgggtaaaagggcttgggaaagccactagcaactcctgtcctttccctctttgtttccggcaccttagcattgtactgttatgatgagactcctgatggcttttgaaataaggagggagtggaaggactagtcaatgtttgcttaacatgtaacaaagggattgttttgagttacacgtagtgtgtctttcactgtgttatatcagtgtggttcccagtctttctgtaagtaatggaacttctgtgtttgtgtgtttggcaggctttcctgcagcccgaaggtgtcacagttgtgttcaaataaaaaatggtaaggattctaaataacattttgcttccatttctgtaattgtatcttctgaaaatgtcttatttcctaagatagccccctcaaaagaggctcataactttgagaaaagtctatttcttgtaaacttaaagggaaattcatagttatgcctctgtcagctgttttcataatgtaaactagtatggtgtttgggttccttcagttattagagaactcaaaaaatggtgataaataagcttttattgtagcacttgatctttcagcatcccacacctcaacagatgtctgtggttatggtggctaatactaataatcttgactgtttatactgtagagacctcagcgaacattgtattaaaattgtaataactccttcagagtgttatttcataaagttgattctgttctctctctgatgccaaatggaactcttcactcattctttggccatattacaacaaaggcattgtatggcttcagaaagcagctgcagctactttaactaaatgtgataagtgactcctctctggataaccttcctgtcttttaatttacaacttatttcatcgtctgatatagctcttaaattttttct

SEQ ID NO: 127488 - DNA, 1106 bp, Homo sapiens
tgccttgaaaaaaatggacgatctggcaattgccagccttaagtctgttataggaccgaacagctggggctgcatagctgtcgcctcttttagagcatgagcatttctgtctgttttcctgagacttctgtttgtttatcttccctagacccccttgctcatttactttctgtgcctggaatctgtaggtatgtgtttgaatttggtaactttgacatgaaggctccttagaggcttgcattcttagtcccagggaagaccctgacatagcatctcagttctgttgagggacaagacaacagcatgagaggctgcacagcagaagtcgtctgtgtcatggggcaatccacttcactggccgcatgtcagctggctgtgtgacctactctaaaacactccatagctttggctcttttcctttgtgtgatcttggctttctcttttcttcatagatgtatttatttgtgggggctataatggagaggtgatcctgggagatatctggaagttgaatctgcagactttccaatgggtgaagctcccagctaccatgccagagccagtttattttcactgtgcagctgttacaccagtaagtttttattttcatatcttccttatgtagttacagatgataaggaaatctttttagagatattagcaagaaaaaaagccagatataggcaaaccttagatgattaataacatatttttaaaacttccttccaaagctaggccctcctctaagaaaagaggagaaaaatcatcacacccaaatttgagagaataacataaatgtaagagaaatgctacctgtggcattccggccctgaccgtgatgtcaaaggtgtttcctgggagggcggaatagttttacccccttgataccatattattgaagatcctgctcatttcttgaaggcaaaggcctttattttcatctttgtattcccagtatttggcatcttggatacttaatataggtttagtttaatgttagttaatagtgaaattgtttgttgttgaagtaaaaaaaaattcatatatataggccgggcgcggtggctcaggcctgtaatcccagcactttgggaggccaaggtggg

SEQ ID NO: 127489 - DNA, 1115 bp, Homo sapiens
gaaattaaaacatcatcaacataaagaaaaatgaaattaaaaaatttttacatctagcaacagcaacaaccacaaatttaggggaagctgagaaggctaaccttgggaatcttgcaggttatacttaaacctagatgtttaacttagtgttttcaagatgtgtctaactgagtagtagctgggtctgatggcagcagtgcttgccatcttgttgcacagataactcaaacctaccctttggctttgaaggaaggttaagcagcccagcaactcttggttagtgatttctttctcatcctcatggtgccagcagtggttagagttggtttgtcaaaagacttacgtgtgtgtcgtggtcgtgctctttgttgttgctcttagaaattatggcaccaagaatgtttcaaacggaaaaacttgtggtggccaaagttcttcattctggcagttttgaaactctcttatgcttattaatggttttaaatatctctttgacttcttcatggggaattgtagaccctaagtatgtggtgtaaatgccatgtaacatgaacacaagctcccgagggaggccagagaagagccaggcagagaaaacctgcatcctctgggcttgttaacttggcttccactcgggctgtggtctttggctatcatcttggccatttccttttgagaacttgtttcttttctaatctctgggccaggtacctgccattttctcaggcagttggtccttgatttttcccttagcttgttgccttcttttccgtctgctttaatgtgcatggtgctgtgaataattgtctagtaattggatacaaggtcttgggggtaaagccacaggtcatccttcctgaagaaccaagtatcatttaaaaactagcatgaggaaggaatgaaactgagtagcattcattttgtgtgtgtgaaattttagttctggtttgtttgatttgttttttttttaattctaaaaagaatgacataaattttcactcgctttgccatctggctgctaggggagctgagcaagaggctcaccatgcgcatgtgtaagccgcaggtgtactcaaggtgctgaaggcgtgcaaggggcagcgctggtcctcccg

SEQ ID NO: 127490 - DNA, 1872 bp, Homo sapiens
cagcctctgtgcttagactttcatggtccttaggatagaagtgagtctctagccctgctacaccagagagctgaagagagatgtggtctggttccatccatacttgctggcatcctttgttaagccttctgagggcagtcttctttgaggtagaccttggaggcctgacatcgaagacctgtgtgttttattttcataaaagtatatatccttggtctaaagtgtcttcttttaatataacactagtaaaaatgacatggtatgaccagcactgagtgctatagaaccacacatgtgtacatgttctggatgccaaatgagactgtgtgtaaatgactaagtgtagataactagaaattagataggggtcatcaggcgtttcggtatacctataaccagcactcggaattcctgacactgtttacttgatttaggaaagtttatgcctgctgcttctctgcctctttgaggtactcccagccgtcttactacagtcctgtaaatttaagtgcaatatatagaaacatatggatatatacagattatatatagggtgtaactataaagcaggtagactacttttttgcatcttggggaagtgagctcattactttaggttcaaattatgccaagaattttagatgtgatcagctggcttaagccaactcatgtcatgataaagctggattttcaagtccatgttttcttactccaactcttagagactcattgttccttaggtttgttagagttgagattttttttctccctgtcatctttgtactctctcatgtttgcatgtcttacattttgttgccggagaacaaggaagtccatctgtaaggagtttcctaaacggagaattaaaacctagtatttaacactaaccattctcctatgtatatactaatttatctgggaatgtaatactttattaaatgaagaaaatgatgctttcttcatttaatattttccacatcctggaaaaactataaactgacacagaataggttgaaatcttaactggggctaaacaaaaccctttccattggcagaatctccttttttcagggccataatgacatgatgtaaaaatttgctttaaaccattcatgcccttaaatagctagattttaaagcataataagcatattaacatttttaagcaaaagatacgttaacagtgacctttggttatccacagtagcaagagtaaagcacagatcattgaaatccatagataatcagtgaatcaactttcctaccaaacaatagattcatttacatttctttttcctccctatcctttcctgtaagcacctgtttttccatggaatggggttaatgagtaggtagaaaaggaaaaggaataatcagtaggagctgacaaccagtgaccatataagcagctgattgcctgtaattagtcaggctgaacaattagagttgaatgctgaaattaggaaccacaggtggtaatcctgagtagatgtagctcttcagcgtcatctcctgccctgagctccaggccatctctctaaccaccaaagaactcttagtacctacgggaaggaaaagctgtgtgcgacacagaggaaactccattatttgaacacatttctttggctcttgacaaatacttgcttttcctctaatcttgcaagagctatggctcttctattttccaatcacacagcttggcatgtaggaaaggttgaatgatcctctaagactgtgttggtcttcgtattctgtaaaacccattttttttttgtggtcttacagatgtttagaaagtggcacaggttactgaattgtctacctgccagcattctgatatagcacaaaaagctattttcctttattttttgt

SEQ ID NO: 127491 - DNA, 1056 bp, Homo sapiens
gataagcagcacacggctgggctctctggcaggaaggcttcagggaaggacccatgtgaggctttgtctgcccagttagaatgagagggctttgtacaatcagcacgtatgcctcttggaccccagtgacactgccatatctcactgggtatgccagtagctttctgctgggtgtgcaggattgttaggcgttagctctgagccacattataatttgatccctggatgttcatcaataataacgtttccacactgaactgcattgacctgggatgggacaggttatggattctacagaggcggcacctcagtgggagttaggaaggagagtctaacagcaggatgggtgtggagaacagcaccacagccctgccaccccgcaggggacagcagcgaccctgaggatatttcttagcaaacttgcatgcagacagtcccaggcactactgtggatgagatttgtatgtaagtccttttctgccccaaaccaaaatgagtatttcaaaatcagtctggctagaagagccactggcctcaatgcactgagcattcagtgggaggactaagctctgtcattaattggggcaggacaactagtctctcacactgattttttttcttcttcttcttttgagacggagtctcgctctgtcacccaggctggagcgcagtggtgtgatctcatctcactgcaacctctgcctcccaggttcaagcaattctcatgcctcagcctcccaagtagctgggattacagatgcctgccaccacacccagctaattttgtattttttaatagagatggggtttcaccatgttggccaggctggtctcgaactcctaacctcaagcgatccacgtgctgcgattataagcatgggccaccgcacccagccctacactgatttctgataaaataaaatgggctggatgtggtggttcacgcctgtaatcccagcactttgggaggctgaggcaggaggatcacttgagctcaggtgttggagaccagcctgggcaacatagtgagaccctgtctctaaaaaaaataataag

SEQ ID NO: 127492 - DNA, 1066 bp, Homo sapiens
aactaaaatatacttgacactgatattttatattttaacagtaaagacacgcagcatgtggggtggcactttttttttttttttttttttttttttttttttgagatggagtttcactgttattgcccaggctggagtgcagtggcatgatctcagctcactacactcagctcactgcaacctctgccttccggtttcaagcgattctcctgcttcagcctcccgagtagctgggattcaggcacccgccaccacgcccggcaaatttttgtatttttagtagagatggggtttcaccacgttggccaggctggtcttgaactcctgacctcatgatccgcccatctcggcctcccaaagtgctgggattacaggcatgagccaccacacccagccctttctagacagctttgtaatagaaatgcgcacattgaaatgcacacattcctcaaaggtcagtctttggtcctctgattcactgtatatgcttttccttagagatctcattcattccacttcatttatcacctctctgcctttgactcccgaattcatcttcaagcataatgtttctcctgagctgtagtgttgatttccatctacctgtcagacatttccgcttggatattctgtgaactccgtgtctggaactgcgttcacatctgctcaaatcagctccctctacttacatccctttttctgttcattgtactaccagttaccgatgctcaaaattctggtgtcatcttttgattcctggagctccctgggtccccaatccaatcaggcaacaaacctcatccattctttcttaacaatgtctcttgcagctgcacttcttccatttctgccaccactatgctcatttacacccttatcaacccacacaggactactgcaacagcctaattaatctcacagccttcgaattgttgccatgcttccatattttccaattcatcctgcacattctcttcaaattcatcttcctagaacacctgtttgatcatttcatccccctgataaattccttagcctgacatttaaagctccacacaatctggcc

SEQ ID NO: 127493 - DNA, 1774 bp, Homo sapiens
tatgtattttgttgttgttgttatatgtagtaggatttaatgtattactaatacacatatgaaaactcactaaagtatccccagtagttagtaaattcctaattcaaatcaagtaatacagttctctgagaggctagcatctccatatcttccatcttttaaatacaattgatacttttactttaatcttgcttgttaaaattattctgttagctattacctggtgtaatagttcttgtttactgaaaaactgtcaacactccataaatctatttattctaaatttgggttttaggcatagttaagaaagtaattactgttactggaattcacctgataaaccatgtataacataattcattgcagaatcacattaaatatcagttaaacatgtattattcataaagttttttgttattagaaaaagaccttaaatgcttggcaaccaattctaataaaaattttttttctctttataggagagttaatcttggtctatctggtgtgaatatattgtggatctttggcgagtagcaagtcatatatttaattctgacatttagactatttcactgaaccagaagtcgaaactaaacatctctgagccactgactcttctgaaataaaatacacatgggtgtatgttacagactctttagatttaacagaaaatgtagctgttatgaaatgtaattgtaaaaatatgtcccgtatcttctatatcgagacattgcctttaattttatatcgcttttcagaaatttcagttgactacaaaactgcaacccttcggatttttattgactcaaaatagtgccattccccttaatgaaatagattttgagtctttttttcattgtaacccccaaatgagaatcatctacctgattcttgtaccaaaaaaaaatttttttcagtcttttttttttttagagagggtctctgtcaacgcagactggagtgcagtggcacgatcttagctcactacaacttctgcctcccaggctcaagcaattctcctgcctcagcctcctgagtagctgggattacaggcatgcaccaccacgcccagctaatttttgtatttttagtagagacagggtttcaccatgttggccaggctggtcccgaactcctgacctcaggtgatccacccacctcggcctcccaaagtgctgggattataggtgcgagccactgcgcccagcctcagttattttatttaacagtgtaagtacttagaaagtaagaaaattgctgatttagtttttttttttttttttttaatgtttccccagcattctgcaagttaggccaaagcccacattcaaagaaatgagattaactcttaagtaatgtattaagtttatgtatattttaaaatattattaaaggaggtttgaaagtattgacatttaaaaagtcaacacttagattaaatttagctggtagttttaatttgggttttagttaagagtgtgaggacatcaggaaaactgtttactactttggttttagcagctcagttttactattccataatgtgttatttttaaagttctctttttaagatcacagtgatatcctatcttcaaattttttaaatatgttcaaaatatctggagggtgagaagttaccaagtttgtatgttttgtttgactcaccatctttattttctgtatatgtagtagctggcaattgcatatattttcttgattaacatattagagactgcttccatcatcttatgtaaacctggaaacagctgaaact

SEQ ID NO: 127494 - DNA, 3054 bp, Homo sapiens
ccccccagtatgttacctttctgctcatctttcaggttgcagcttaaaatacaaaaaaaaaattagccgggcatggcggtgggcgcctgtggtcccagctacttgggaggctgaggcaggagaatgacgtgaacccaggagatggaggttgcggtgagctgagatcacaccactgcactccagcctggacgacacagcgagactccatctcaaaaaaaaaaaaaaaatctttccctcagggaggcattctgtcgctaaccagtctaaatcagacactgcatcttcatatgttcctatggcacctcctctcatagcattcctcacactttgttgtgattcttagtttactgtctgcctttcctactggcccttatgtccttgacatgtatcctttctgtcttactcactgcagtattcccacttcctagcacaaagcgtaggtactttgtttaataaataaatgaaagtctgaattatatggaattctgagttagtaggatatgaattgataagatatgtatttacctaccagattgaatctttttcatttggtttaaatcttgtcttttttgtctttgttccagggcagaaataatatgtttcatacattgttgatgtttctctacatcataaagaccaaagagtcaggaatgcttgggtaggtacttatgctttaaaaacgtaagtagttatttactgattttcttcctatgttaagattctgcagaaggcagcagcatgtaactgaaggtttatggattgaacaatagataatggcttcagccctgtcacagactacctctgctattttgggcaatccattagctaactcctcggaacccattggtaaaaggcaagtggactacatcgttagcattatagttgtgttccctggaggaataattcagagatagataaaaattagactcttgccgtttaaaaacattttttttttaaaatctggagactgtttttttccaagccatttcatttcagacacaaagcattctgcgaagtgtttacacttccagagagacagagtcggtacctgttccataatatcattaactggaatggaaaagtagtcagttgaaatcgtttacatacttggtaacaaagctcacatactgcaagaaattcaaaattgtagtattgtcattttgatgattagaaattttagtgtatcaaatgacacatgaaataagtagaccccagctaaagctagggatatttgtagtgcctgatctgggagtcggaaaacctgggttctgggtccagctctgccatactaagtaacctaaggctagcaaaaaaaaaaggggggatgggcttggagcagaagggattgtggtcatttccacttccgatatgcatgcgtctttaagttttagatagcatcctgtttgtaatttagagtttatacgtgtcctagaactgtgccatccagcacagtagccaccagccccatgtggcactgaacacttgaagcaggactagaccaaattgaggtgcgctaaagtgtaaaacgtgtaacagatttcaaagacacagcccccaaaaagtaagataactccttaaaaattgtatatatttgttacatattgaaatgctagtttggatagatttagttaagtgaaatatgttcttaaaattaatttcacctgtttattaggtatctactagaaaatttaaaattatgtggcttgcatttgcagttcatatcatattgtatttttattggacagcactgctctagagaaagcaaagctccttaaatatatcggatgtaaagattaaaacagacatgaacaaaaatgtgtaaacaaatatgaacatttattagctttttttttttttttttttgagatggagtctcgctctgtcacctaggccggagtacagtggcaccatctcagctcactgcaacctctgcctcccaagtagctggaactacagatgcccgccaccatgccgggtatttttggtagagacggggtttctccatgttggccaggctggtctcaaactcctgatctcaggtgatccgcctgcccggcctcccaaagtgctgtaattacaggtgtgagccaccacacccagctattagcttcttttatcatatattttttaatgtaagaaagattaggaaactaactttattgaggcatctaaactaacagggttttttatttttaaattatgaaaataatgcatactcagtagataagtatttaaataacacagcagtgtataaactagaactaatttctaattatgtgtagagacagtatctcactatattgcccaggctgtgatctacctgccttggccttctaacgtgctgggattacaggcataagccactccacctggctttatttttgtttcttttgcttaaaaatgtattgtatccaaacatagtactttatgatctaatttttaggcttatggcatatcttggacattctcccatgtcaaattttccctaaaatgtctaggaatgtttggttataaatatacttacacatatatattagatggaatatggaatttgatataaattccatattgttattattccatgttgttaatacaggtcaagtattctttatctgaaatgcttggaaccaggagtgtttcggatttgattttctccgattttggaatatttgcaataattactgagcatccctaatctaaaaatcccccaaatgctacagtgagcatttcctttgagcatcatgatgtcactcaaaaagttttgggttttggagcatttcggattttcagattataggtgcttaacctgtataatataaataagcaattaatttttggttctaattgaaaatgtatcttttcctctgtggatccaaattgatattttgatgcataaatggtttgtcatgatagcatgaggtttgagtgccatatacggtctgtcatatgctttaaaatgaaaaagtgcttagtggagcagcactttttcatttactgaaatgtaatgaaatttactgaaaggccaaaagaaattgatacaatttttaaagcgct
